United States Patent
Luke et al.

(10) Patent No.: US 11,401,555 B2
(45) Date of Patent: Aug. 2, 2022

(54) GENETIC POLYMORPHISMS ASSOCIATED WITH STROKE, METHODS OF DETECTION AND USES THEREOF

(71) Applicant: CELERA CORPORATION, San Juan Capistrano, CA (US)

(72) Inventors: May Luke, San Francisco, CA (US); James J. Devlin, Lafayette, CA (US)

(73) Assignee: Celera Corporation, San Juan Capistrano, CA (US)

( * ) Notice: Subject to any disclaimer, the term of this patent is extended or adjusted under 35 U.S.C. 154(b) by 0 days.

(21) Appl. No.: 16/814,085

(22) Filed: Mar. 10, 2020

(65) Prior Publication Data
US 2020/0377950 A1 Dec. 3, 2020

Related U.S. Application Data

(63) Continuation of application No. 15/790,581, filed on Oct. 23, 2017, now abandoned, which is a continuation of application No. 14/886,595, filed on Oct. 19, 2015, now abandoned, which is a continuation of application No. 13/655,905, filed on Oct. 19, 2012, now abandoned, which is a continuation of application No. 12/389,313, filed on Feb. 19, 2009, now abandoned.

(60) Provisional application No. 61/066,584, filed on Feb. 20, 2008.

(51) Int. Cl.
| | | |
|---|---|---|
| C12Q 1/6883 | (2018.01) |
| A61K 31/22 | (2006.01) |
| A61K 31/35 | (2006.01) |
| A61K 31/40 | (2006.01) |
| A61K 31/404 | (2006.01) |
| A61K 31/435 | (2006.01) |

(52) U.S. Cl.
CPC ........... *C12Q 1/6883* (2013.01); *A61K 31/22* (2013.01); *A61K 31/35* (2013.01); *A61K 31/40* (2013.01); *A61K 31/404* (2013.01); *A61K 31/435* (2013.01); *C12Q 2600/118* (2013.01); *C12Q 2600/156* (2013.01); *C12Q 2600/172* (2013.01)

(58) Field of Classification Search
None
See application file for complete search history.

(56) References Cited

U.S. PATENT DOCUMENTS

2001/0009761 A1 * 7/2001 Wright ................ C12Q 1/6827
435/6.1

OTHER PUBLICATIONS

Helgadottie et al. (Science Jun. 2007 vol. 316 p. 1491) (Year: 2007).*
Chen et al. (Cell Metab 2007 vol. 6 p. 164-179) (Year: 2007).*
Roux et al (PCR Methods and Applications (1995) vol. 4, pp. s185-s194) (Year: 1995).*

* cited by examiner

*Primary Examiner* — Katherine D Salmon
(74) *Attorney, Agent, or Firm* — Celera Corporation

(57) ABSTRACT

The present invention provides compositions and methods based on genetic polymorphisms that are associated with vascular diseases such as stroke. In particular, the present invention relates to genetic polymorphisms that have utility for such uses as predicting disease risk or predicting an individual's response to a treatment such as statins, including groups of polymorphisms that may be used as a signature marker set for such uses, as well as nucleic acid molecules containing the polymorphisms, variant proteins encoded by such nucleic acid molecules, reagents for detecting the polymorphic nucleic acid molecules and proteins, and methods of using the nucleic acid and proteins as well as methods of using reagents for their detection.

18 Claims, 2 Drawing Sheets

Specification includes a Sequence Listing.

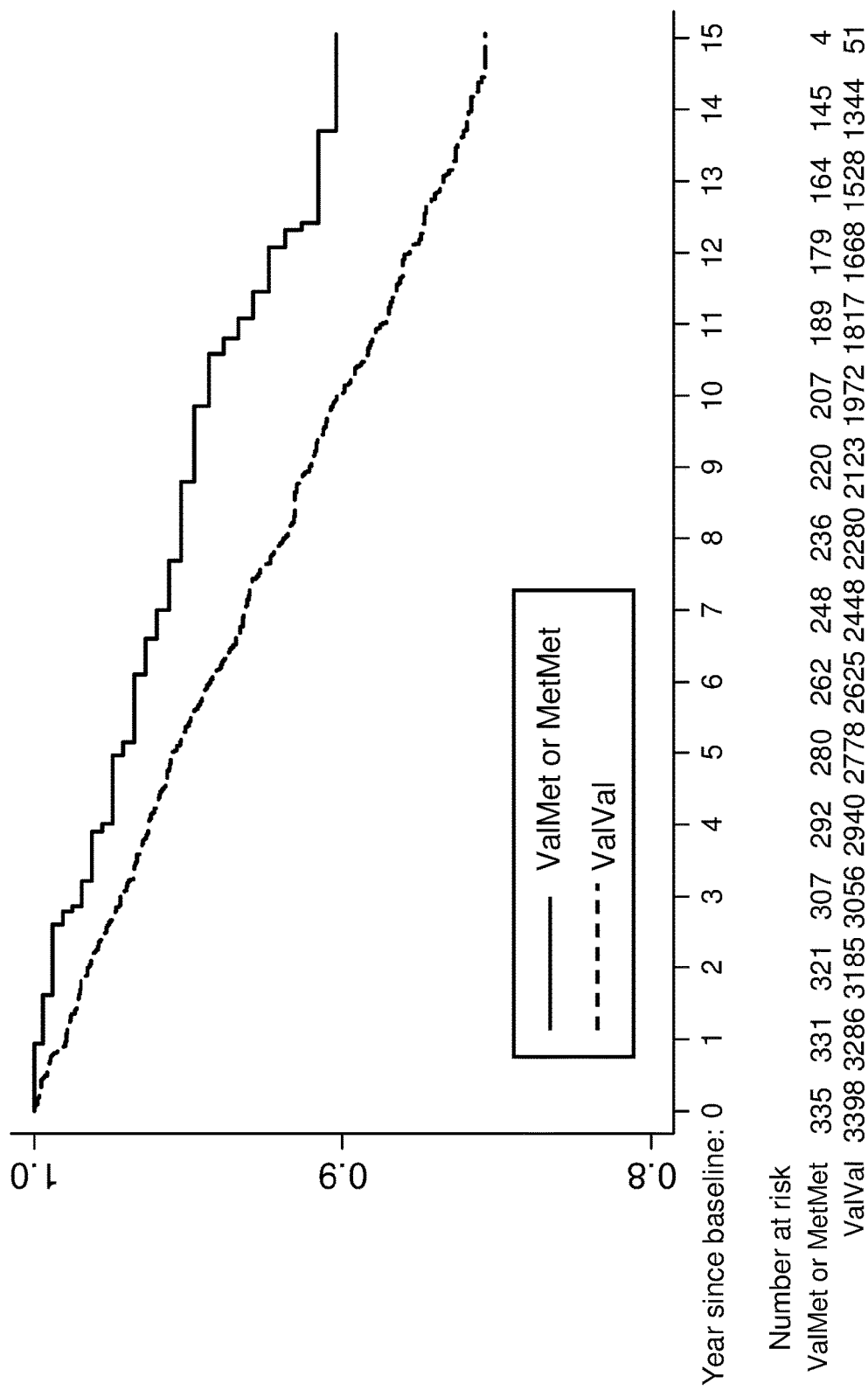

GENETIC POLYMORPHISMS ASSOCIATED WITH STROKE, METHODS OF DETECTION AND USES THEREOF

CROSS-REFERENCE TO RELATED APPLICATIONS

This application is a continuation application of U.S. non-provisional application Ser. No. 15/790,581, filed on Oct. 23, 2017, which is a continuation application of U.S. non-provisional application Ser. No. 14/886,595, filed on Oct. 19, 2015, which is a continuation of U.S. non-provisional application Ser. No. 13/655,905, filed on Oct. 19, 2012, which is a continuation application of U.S. non-provisional application Ser. No. 12/389,313, filed on Feb. 19, 2009, which claims priority to U.S. provisional application Ser. No. 61/066,584, filed on Feb. 20, 2008, the contents of each of which are hereby incorporated by reference in their entirety into this application.

FIELD OF THE INVENTION

The present invention is in the field of vascular disease, particularly stroke, and drug response, particularly response to statin treatment. In particular, the present invention relates to specific single nucleotide polymorphisms (SNPs) in the human genome, and their association with vascular disease, including but not limited to cerebrovascular diseases such as stroke, and/or variability in responsiveness to statin treatment (including preventive treatment) between different individuals. The SNPs disclosed herein can be used, for example, as targets for diagnostic/prognostic reagents as well as for therapeutic agents. In particular, the SNPs of the present invention are useful for identifying an individual who is at an increased or decreased risk of having a stroke, for early detection of stroke risk, for providing clinically important information for the prevention and/or treatment of stroke, for predicting the seriousness or consequences of stroke in an individual, for determining the prognosis of an individual's recovery from stroke, for screening and selecting therapeutic agents, and for predicting a patient's response to therapeutic agents such as evaluating the likelihood of an individual responding positively to statins, particularly for the treatment or prevention of stroke. The SNPs disclosed herein are also useful for human identification applications. Methods, assays, kits, and reagents for detecting the presence of these polymorphisms and their encoded products are provided.

BACKGROUND OF THE INVENTION

Stroke and Other Vascular Diseases

Vascular diseases encompass a number of related pathologies including cerebrovascular diseases such as stroke, as well as carotid artery disease, coronary artery disease, peripheral artery disease, aortic aneurysm, and vascular dementia.

Stroke is a prevalent and serious cerebrovascular disease. It affects 4.7 million individuals in the United States, with 500,000 first attacks and 200,000 recurrent cases yearly. Approximately one in four men and one in five women aged 45 years will have a stroke if they live to their 85th year. About 25% of those who have a stroke die within a year. In fact, stroke is the third leading cause of mortality in the United States and is responsible for 170,000 deaths a year. Among those who survive a stroke attack, 30 to 50% do not regain functional independence. Stroke therefore is the most common cause of disability and the second leading cause of dementia (Heart Disease and Stroke Statistics—2004 Update, American Heart Association).

Stroke occurs when an artery bringing oxygen and nutrients to the brain either ruptures, causing hemorrhagic stroke, or gets occluded, causing ischemic stroke. Ischemic stroke can be caused by thrombi formation at the site of an atherosclerotic plaque rupture (this type of ischemic stroke is interchangeably referred to as thrombotic or atherothrombotic stroke) or by emboli (clots) that have traveled from another part of the vasculature (this type of ischemic stroke is referred to as embolic stroke), often from the heart (this type of embolic stroke may be referred to as cardioembolic stroke). In both ischemic and hemorrhagic stroke, a cascade of cellular changes due to ischemia or increased cranial pressure leads to injuries or death of the brain cells. In the United States, the majority (about 80-90%) of stroke cases are ischemic (Rathore, et al., *Stroke* 33:2718-2721 ((2002)), including 30% large-vessel thrombotic (also referred to as large-vessel occlusive disease), 20% small-vessel thrombotic (also referred to as small-vessel occlusive disease), and 30% embolic or cardiogenic (caused by a clot originating from elsewhere in the body, e.g., from blood pooling due to atrial fibrillation, or from carotid artery stenosis). The ischemic form of stroke results from obstruction of blood flow in cerebral blood vessels, and it shares common pathological etiology with atherosclerosis and thrombosis.

About 10-20% of stroke cases are of the hemorrhagic type (Rathore, et al., *Stroke* 33:2718-2721 ((2002)), involving bleeding within or around the brain. Bleeding within the brain is known as cerebral hemorrhage, which is often linked to high blood pressure. Bleeding into the meninges surrounding the brain is known as a subarachnoid hemorrhage, which could be caused by a ruptured cerebral aneurysm, an arteriovenous malformation, or a head injury. The hemorrhagic stroke, although less prevalent, poses a greater danger. Whereas about 8% of ischemic stroke cases result in death within 30 days, about 38% of hemorrhagic stroke cases result in death within the same time period (Collins, et al., *J. Clin. Epidemiol.* 56:81-87 (2003)).

Known risk factors for stroke can be divided into modifiable and non-modifiable risk factors. Older age, male sex, black or Hispanic ethnicity, and family history of stroke are non-modifiable risk factors. Modifiable risk factors include hypertension, smoking, increased insulin levels, asymptomatic carotid disease, cardiac vessel disease, and hyperlipidemia.

Multiple reports based on twin studies (Brass et al., *Stroke.* 1992; 23:221-223 and Bak et al., *Stroke.* 2002; 33:769-774) and family studies (Welin L, et al. *N Engl J Med.* 1987; 317:521-526 and Jousilahti et al., *Stroke.* 1997; 28:1361-136) have shown that genetics contributes to risk of stroke independently of traditional risk factors. A number of genetic markers have been reported to be associated with stroke and some examples of stroke-related markers include MTHFR, ACE, NOTCH3, IL-6, PON1, fibrinogen-beta, and lipoprotein lipase (Casas, et al., *Arch. Neurol.,* 61:1652-1661 (2004)).

The acute nature of stroke leaves physicians with little time to prevent or lessen the devastation of brain damage. Strategies to diminish the impact of stroke include prevention and treatment with thrombolytic and, possibly, neuroprotective agents. The success of preventive measures will depend on the identification of risk factors in individual patients and means to modulate their impact.

Although some risk factors for stroke are not modifiable, such as age and family history, other underlying pathology or risk factors of stroke such as atherosclerosis, hypertension, smoking, diabetes, aneurysm, and atrial fibrillation, are chronic and amenable to effective life-style changes, pharmacological, and interventional as well as surgical treatments. Early recognition of patients with informative risk factors, and especially those with a family history, using a non-invasive test of genetic markers associated with stroke will enable physicians to target the highest risk individuals for aggressive risk reduction.

Thus, there is a need for the identification of new genetic markers that are predictive of an individual's predisposition to the development of stroke and other vascular diseases. Furthermore, the discovery of genetic markers which are useful in identifying individuals who are at an increased risk of having a stroke may lead to, for example, better preventive and therapeutic strategies, economic models, and health care policy decisions.

Reduction of coronary and cerebrovascular events and total mortality by treatment with HMG-CoA reductase inhibitors (statins) has been demonstrated in a number of randomized, double blinded, placebo-controlled prospective trials (Waters, D. D., Clin Cardiol, 2001. 24(8 Suppl): p. 1113-7, Singh, B. K. and J. L. Mehta, Curr Opin Cardiol, 2002. 17(5): p. 503-11). These drugs have their primary effect through the inhibition of hepatic cholesterol synthesis, thereby upregulating LDL receptors in the liver. The resultant increase in LDL catabolism results in decreased circulating LDL, a major risk factor for vascular disease.

In addition to LDL-lowering, a variety of potential non-lipid lowering effects have been suggested to play a role in cardiovascular risk reduction by statins. These include anti-inflammatory effects on various vascular cell types including foam cell macrophages, improved endothelial responses, inhibition of platelet reactivity thereby decreasing hypercoaguability, and many others (Puddu, P., G. M. Puddu, and A. Muscari, Acta Cardiol, 2001. 56(4): p. 225-31, Albert, M. A., et al., JAMA, 2001. 286(1): p. 64-70, Rosenson, R. S., Curr Cardiol Rep, 1999. 1(3): p. 225-32, Dangas, G., et al., Thromb Haemost, 2000. 83(5): p. 688-92, Crisby, M., Drugs Today (Barc), 2003. 39(2): p. 137-43, Liao, J. K., Int J Clin Pract Suppl, 2003(134): p. 51-7). However, because hypercholesterolemia is a factor in many of these additional pathophysiologic mechanisms that are reversed by statins, many of these statin benefits may be a consequence of LDL lowering.

Statins can be divided into two types according to their physicochemical and pharmacokinetic properties. Statins such as lovastatin, simvastatin, atorvastatin, and cerevastatin are hydrophobic in nature and, as such, diffuse across membranes and thus are highly cell permeable. Hydrophilic statins such as pravastatin are more polar, such that they utilize specific cell surface transporters for cellular uptake (Ziegler, K. and W. Stunkel, Biochim Biophys Acta, 1992. 1139(3): p. 203-9, Yamazaki, M., et al., Am J Physiol, 1993. 264(1 Pt 1): p. G36-44, Komai, T., et al., Biochem Pharmacol, 1992. 43(4): p. 667-70). The latter statin utilizes a transporter, OATP2, the tissue distribution of which is confined to the liver and, therefore, they are relatively hepato-specific inhibitors (Hsiang, B., et al., J Biol Chem, 1999. 274(52): p. 37161-8). The former statins, which do not utilize specific transport mechanisms, are available to all cells and they can directly impact a much broader spectrum of cells and tissues. These differences in properties may influence the spectrum of activities that each statin possesses. Pravastatin, for instance, has a low myopathic potential in animal models and myocyte cultures compared to other hydrophobic statins (Masters, B. A., et al., Toxicol Appl Pharmacol, 1995. 131(1): p. 163-74. Nakahara, K., et al., Toxicol Appl Pharmacol, 1998. 152(1): p. 99-106, Reijneveld, J. C., et al., Pediatr Res, 1996. 39(6): p. 1028-35).

Evidence from gene association studies is accumulating to indicate that responses to drugs are, indeed, at least partly under genetic control. As such, pharmacogenetics—the study of variability in drug responses attributed to hereditary factors in different populations—may significantly assist in providing answers toward meeting this challenge (Roses, A. D., Nature, 2000. 405(6788): p. 857-65, Mooser, V., et al., J Thromb Haemost, 2003. 1(7): p. 1398-1402, Humma, L. M. and S. G. Terra, Am. J. Health Syst Pharm, 2002. 59(13): p. 1241-52). Numerous associations have been reported between selected genotypes, as defined by SNPs and other sequence variations, and specific responses to cardiovascular drugs. Polymorphisms in several genes have been suggested to influence responses to statins including CETP (Kuivenhoven, J. A., et al., N Engl J Med, 1998. 338(2): p. 86-93), beta-fibrinogen (de Maat, M. P., et al., Arterioscler Thromb Vasc Biol, 1998. 18(2): p. 265-71), hepatic lipase (Zambon, A., et al., Circulation, 2001. 103(6): p. 792-8), lipoprotein lipase (Jukema, J. W., et al., Circulation, 1996. 94(8): p. 1913-8), glycoprotein Ma (Bray, P. F., et al., Am J Cardiol, 2001. 88(4): p. 347-52), stromelysin-1 (de Maat, M. P., et al., Am J Cardiol, 1999. 83(6): p. 852-6), and apolipoprotein E (Gerdes, L. U., et al., Circulation, 2000. 101 (12): p. 1366-71, Pedro-Botet, J., et al., Atherosclerosis, 2001. 158(1): p. 183-93). Some of these variants were shown to effect clinical events while others were associated with changes in surrogate endpoints.

Thus, there is also a need to identify genetic markers for stratifying stroke patients based on their likelihood of responding to drug therapy, particularly statin treatment.

SNPs

The genomes of all organisms undergo spontaneous mutation in the course of their continuing evolution, generating variant forms of progenitor genetic sequences (Gusella, Ann. Rev. Biochem. 55, 831-854 (1986)). A variant form may confer an evolutionary advantage or disadvantage relative to a progenitor form or may be neutral. In some instances, a variant form confers an evolutionary advantage to the species and is eventually incorporated into the DNA of many or most members of the species and effectively becomes the progenitor form. Additionally, the effects of a variant form may be both beneficial and detrimental, depending on the circumstances. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence gives rise to genetic polymorphisms, including SNPs.

Approximately 90% of all polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences of the allele (e.g., sequences that vary in less than $1/100$ or $1/1000$ members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel" (Weber et al., "Human diallelic insertion/deletion polymorphisms", *Am J Hum Genet* 2002 October; 71(4):855-82).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of the SNPs are bi-allelic, and are thus often referred to as "bi-allelic markers", or "di-allelic markers".

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases (Stephens et al. *Science* 293, 489-493, 20 Jul. 2001). As used herein, the term "haplotype" refers to a set of two or more alleles on a single chromosome. The term "diplotype" refers to a combination of two haplotypes that a diploid individual carries. The term "double diplotype", also called "two-locus diplotype", refers to a combination of diplotypes at two distinct loci for an individual.

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as stroke and related pathologies and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as stroke. Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. (Linder et al. (1997), *Clinical Chemistry*, 43, 254; Marshall (1997), *Nature Biotechnology*, 15, 1249; International Patent Application WO 97/40462, Spectra Biomedical; and Schafer et al. (1998), *Nature Biotechnology*, 16: 3).

SUMMARY OF THE INVENTION

The present invention relates to the identification of SNPs, unique combinations of SNPs, and haplotypes or diplotypes of SNPs, that are associated with stroke (e.g., an increased or decreased risk of having a stroke), and/or with drug response, particularly response to statin treatment (including preventive treatment) such as for the treatment or prevention of stroke. The polymorphisms disclosed herein are directly useful as targets for the design of diagnostic and prognostic reagents and the development of therapeutic and preventive agents, such as for use in determining an individual's predisposition to having a stroke, and for treatment or prevention of stroke and related pathologies such as other vascular diseases, as well as for predicting a patient's response to therapeutic agents such as statins, particularly for the treatment or prevention of stroke. Furthermore, the polymorphisms disclosed herein may also be used for predicting an individual's responsiveness to statins for the treatment or prevention of disorders other than stroke, such as cancer, and may also be used for predicting an individual's responsiveness to drugs other than statins that are used to treat or prevent stroke.

Based on the identification of SNPs associated with stroke, and/or response to statin treatment, the present invention also provides methods of detecting these variants as well as the design and preparation of detection reagents needed to accomplish this task. The invention specifically provides, for example, SNPs associated with stroke, and/or responsiveness to statin treatment, isolated nucleic acid molecules (including DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of having a first or recurrent stroke, methods for prognosing the severity or consequences of stroke, methods of treating an individual who has an increased risk for stroke, and methods for identifying individuals (e.g., determining a particular individual's likelihood) who have an altered (i.e., increased or decreased) likelihood of responding to statin treatment (or more or less likely to experience undesirable side effects from a treatment), particularly statin treatment of stroke, based on the presence or absence of one or more particular nucleotides (alleles) at one or more SNPs disclosed herein or the detection of one or more encoded variant products (e.g., variant mRNA transcripts or variant proteins), methods of screening for compounds useful in the treatment or prevention of a disorder associated with a variant gene/protein, compounds identified by these methods, methods of treating or preventing disorders mediated by a variant gene/protein, etc. The present invention also provides methods for identifying individuals who possess SNPs that are associated with an increased risk of stroke, and yet can benefit from being treated with statin because statin treatment can lower their risk of stroke.

The exemplary utilities described herein for the stroke-associated SNPs and statin response-associated SNPs disclosed herein apply to both first (primary) and recurrent stroke. For example, the SNPs disclosed herein can be used for determining the risk for a first stroke in an individual who has never had a stroke in the past, and can also be used for determining the risk for a recurrent stroke in an individual who has previously had a stroke.

The present invention further provides methods for selecting or formulating a treatment regimen (e.g., methods for determining whether or not to administer statin treatment to an individual who has previously had a stroke, or who is at risk for having a stroke in the future, methods for selecting a particular statin-based treatment regimen such as dosage and frequency of administration of statin, or a particular form/type of statin such as a particular pharmaceutical formulation or statin compound, methods for administering an alternative, non-statin-based treatment to individuals who are predicted to be unlikely to respond positively to statin treatment, etc.), and methods for determining the likelihood of experiencing toxicity or other undesirable side effects from statin treatment, etc. The present invention also provides methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment and/or excluding individuals from the trial who are unlikely to respond positively from the statin treatment). The present invention further provides methods for reducing an individual's risk of having a stroke by administering statin treatment, including preventing a first or recurrent stroke by administering statin treatment, when said individual carries one or more SNPs identified herein as being associated with stroke risk or stroke statin response.

In certain exemplary embodiments of the invention, the SNP is selected from the group consisting of the following (the name of the gene, or chromosome, that contains the SNP is indicated in parentheses): rs3900940/hCV7425232 (MYH15), rs3814843/hCV11476411 (CALM1), rs2200733/hCV16158671 (chromosome 4q25), and rs10757274/hCV26505812 (chromosome 9p21), and combinations of any number of these SNPs, as well as any of these SNP in combination with other genetic markers. Exemplary embodiments of the invention provide compositions (e.g., detection reagents and kits) and methods of using these SNPs for stroke-related utilities, such as for determining an individual's risk of having a stroke or whether an individual will benefit from treatment with statins or other therapies. For example, certain embodiments provide methods of using any of rs3900940/hCV7425232 (MYH15), rs3814843/hCV11476411 (CALM1), rs2200733/hCV16158671 (chromosome 4q25), and/or rs10757274/hCV26505812 (chromosome 9p21) for determining stroke risk in an individual, and methods of using rs10757274/hCV26505812 (chromosome 9p21) for determining whether an individual will benefit from statin treatment.

In Tables 1-2, the present invention provides gene information, transcript sequences (SEQ ID NOS:1-80), encoded amino acid sequences (SEQ ID NOS:81-160), genomic sequences (SEQ ID NOS:260-435), transcript-based context sequences (SEQ ID NOS:161-259) and genomic-based context sequences (SEQ ID NOS:436-1566) that contain the SNPs of the present invention, and extensive SNP information that includes observed alleles, allele frequencies, populations/ethnic groups in which alleles have been observed, information about the type of SNP and corresponding functional effect, and, for cSNPs, information about the encoded polypeptide product. The transcript sequences (SEQ ID NOS:1-80), amino acid sequences (SEQ ID NOS:81-160), genomic sequences (SEQ ID NOS:260-435), transcript-based SNP context sequences (SEQ ID NOS:161-259), and genomic-based SNP context sequences (SEQ ID NOS:436-1566) are also provided in the Sequence Listing.

In certain exemplary embodiments, the invention provide methods for identifying an individual who has an altered risk for having a first or recurrent stroke, in which the method comprises detecting a single nucleotide polymorphism (SNP) in any of the nucleotide sequences of SEQ ID NOS:1-80 and 161-1566, particularly as represented by any of the genomic context sequences of SEQ ID NOS:436-1566, in said individual's nucleic acids, wherein the SNP is specified in Table 1 and/or Table 2, and the presence of the SNP is indicative of an altered risk for stroke in said individual. In certain exemplary embodiment of the present invention, SNPs that occur naturally in the human genome are provided as isolated nucleic acid molecules. These SNPs are associated with stroke and related pathologies such as other vascular diseases. Other vascular diseases include, but are not limited to, cerebrovascular disease, carotid artery disease, coronary artery disease, peripheral artery disease, aortic aneurysm, and vascular dementia. In particular the SNPs are associated with either an increased or decreased risk of having a stroke. As such, they can have a variety of uses in the diagnosis and/or treatment of stroke and related pathologies. One aspect of the present invention relates to an isolated nucleic acid molecule comprising a nucleotide sequence in which at least one nucleotide is a SNP that is proprietary to Applera, or Celera. In an alternative embodiment, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In yet another embodiment of the invention, a reagent for detecting a SNP in the context of its naturally-occurring flanking nucleotide sequences (which can be, e.g., either DNA or mRNA) is provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment.

Various embodiments of the invention also provide kits comprising SNP detection reagents, and methods for detecting the SNPs disclosed herein by employing detection reagents. In a specific embodiment, the present invention provides for a method of identifying an individual having an increased or decreased risk of having a stroke by detecting the presence or absence of one or more SNP alleles disclosed herein. Preferably, the SNP allele can be an allele of a SNP selected from the group consisting of the following (the name of the gene, or chromosome, that contains the SNP is indicated in parentheses): rs3900940/hCV7425232 (MYH15), rs3814843/hCV11476411 (CALM1), rs2200733/hCV16158671 (chromosome 4q25), and rs10757274/hCV26505812 (chromosome 9p21), and combinations of any number of these SNPs, as well as any of these SNP in combination with other genetic markers.

In another embodiment, a method for diagnosing stroke or related pathologies by detecting the presence or absence of one or more SNPs or SNP alleles disclosed herein is provided. In another embodiment, the invention provides a method of identifying an individual having an altered (either increased or decreased) risk of having a stroke by detecting the presence or absence of one or more SNPs or SNP alleles disclosed herein. Thus, an exemplary embodiment of the invention provides a method of identifying an individual who has an increased risk of having a stroke by determining which nucleotide (allele) is present at one or more SNPs disclosed herein. An alternative exemplary embodiment of the invention provides a method of identifying an individual who has a decreased risk of having a stroke by determining which nucleotide (allele) is present at one or more SNPs disclosed herein.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment of stroke and related pathologies such as other vascular diseases.

An aspect of this invention is a method for treating or preventing a first or recurrent stroke in a human subject wherein said human subject harbors a SNP, gene, transcript, and/or encoded protein identified in Tables 1-2, which method comprises administering to said human subject a therapeutically or prophylactically effective amount of one or more agents (e.g., statins) counteracting the effects of the disease, such as by inhibiting (or stimulating) the activity of the gene, transcript, and/or encoded protein identified in Tables 1-2.

Another aspect of this invention is a method for identifying an agent useful in therapeutically or prophylactically treating stroke and related pathologies in a human subject wherein said human subject harbors a SNP, gene, transcript, and/or encoded protein identified in Tables 1-2, which method comprises contacting the gene, transcript, or encoded protein with a candidate agent (e.g., a statin) under conditions suitable to allow formation of a binding complex between the gene, transcript, or encoded protein and the candidate agent and detecting the formation of the binding complex, wherein the presence of the complex identifies said agent.

Another aspect of this invention is a method for treating stroke and related pathologies in a human subject, which method comprises:

(i) determining that said human subject harbors a SNP, gene, transcript, and/or encoded protein identified in Tables 1-2, and (ii) administering to said subject a therapeutically or prophylactically effective amount of one or more agents (e.g., statins) counteracting the effects of the disease.

Yet another aspect of this invention is a method for evaluating the suitability of a patient for stroke treatment comprising determining the genotype of said patient with respect to a particular set of SNP markers, said SNP markers comprising a plurality of individual SNPs (e.g., about 2-7 SNPs) in Tables 1-2, and calculating a score using an appropriate algorithm based on the genotype of said patient, the resulting score being indicative of the suitability of said patient undergoing stroke treatment.

Another aspect of the invention is a method of treating a stroke patient comprising administering an appropriate drug in a therapeutically effective amount to said stroke patient whose genotype has been shown to contain a plurality of SNPs as described in Table 1 or Table 2.

Another aspect of the invention is a method for identifying a human who is likely to benefit from statin treatment (as used herein, "treatment" includes preventive as well as therapeutic treatment), in which the method comprises detecting the presence of a statin response-associated SNP (e.g., an allele associated with increased statin benefit) disclosed herein in said human's nucleic acids, wherein the presence of the SNP indicates that said human is likely to benefit from statin treatment.

Another aspect of the invention is a method for identifying a human who is likely to benefit from statin treatment, in which the method comprises detecting the presence of a SNP that is in LD with a statin response-associated SNP disclosed herein in said human's nucleic acids, wherein the presence of the SNP indicates that said human is likely to benefit from statin treatment.

Exemplary embodiments of the invention include methods of using a statin response-associated SNP disclosed herein for determining whether an individual will benefit from statin treatment (e.g., determining whether an individual should be administered statin to reduce their likelihood of having a stroke). The statin response-associated SNPs disclosed here can be used for predicting response to any statin (HMG-CoA reductase inhibitors), including but not limited to, pravastatin (Pravachol®), atorvastatin (Lipitor®), storvastatin, rosuvastatin (Crestor®), fluvastatin (Le- CRF CDR is identical to the sequence listing as provided on the CDR Duplicate Copy 1 and Duplicate Copy 2.

The material contained on the CD-R labeled CRF is hereby incorporated by reference pursuant to 37 CFR 1.77 (b)(4).

LENGTHY TABLES

The patent contains a lengthy table section. A copy of the table is available in electronic form from the USPTO web site (https://seqdata.uspto.gov/?pageRequest=docDetail&DocID=US11401555B2). An electronic copy of the table will also be available from the USPTO upon request and payment of the fee set forth in 37 CFR 1.19(b)(3).

scol®), lovastatin (Mevacor®), and simvastatin (Zocor®), as well as combination therapies that include a statin such as simvastatin+ezetimibe (Vytorin®), lovastatin+niacin extended-release (Advicor®), and atorvastatin+amlodipine besylate (Caduet®).

In certain exemplary embodiments of the invention, methods are directed to the determination of which patients would have greater protection against stroke when they are given an intensive statin treatment as compared to a standard statin treatment. In certain embodiments, the statin can comprise a statin selected from the group consisting of atorvastatin, pravastatin, and storvastatin. In certain embodiments, intensive statin treatment comprises administering higher doses of a statin and/or increasing the frequency of statin administration as compared with standard statin treatment. In certain further embodiments, intensive statin treatment can utilize a different type of statin than standard statin treatment; for example, atorvastatin can be used for intensive statin treatment and pravastatin can be used for standard statin treatment.

Many other uses and advantages of the present invention will be apparent to those skilled in the art upon review of the detailed description of the preferred embodiments herein. Solely for clarity of discussion, the invention is described in the sections below by way of non-limiting examples.

Description of the File Contained on the CD-R Named CD000022ORD-CDR

The CD-R named CD000022ORD-CDR contains the following text (ASCII) file:

1) File SEQLIST_CD000022ORD.txt provides the Sequence Listing. The Sequence Listing provides the transcript sequences (SEQ ID NOS:1-80) and protein sequences (SEQ ID NOS:81-160) as shown in Table 1, and genomic sequences (SEQ ID NOS:260-435) as shown in Table 2, for each stroke-associated gene that contains one or more SNPs of the present invention. Also provided in the Sequence Listing are context sequences flanking each SNP, including both transcript-based context sequences as shown in Table 1 (SEQ ID NOS:161-259) and genomic-based context sequences as shown in Table 2 (SEQ ID NOS:436-1566). The context sequences generally provide 100 bp upstream (5') and 100 bp downstream (3') of each SNP, with the SNP in the middle of the context sequence, for a total of 200 bp of context sequence surrounding each SNP.

File SEQLIST_CD000022ORD.txt is 21,295 KB in size, and was created on Feb. 18, 2009. A computer readable format of the sequence listing is also submitted herein on a separate CDR labeled CRF. The information recorded in the Description of Table 1 and Table 2

Table 1 and Table 2 disclose the SNP and associated gene/transcript/protein information of the present invention. For each gene, Table 1 and Table 2 each provide a header containing gene/transcript/protein information, followed by a transcript and protein sequence (in Table 1) or genomic sequence (in Table 2), and then SNP information regarding each SNP found in that gene/transcript.

NOTE: SNPs may be included in both Table 1 and Table 2; Table 1 presents the SNPs relative to their transcript sequences and encoded protein sequences, whereas Table 2 presents the SNPs relative to their genomic sequences (in some instances Table 2 may also include, after the last gene sequence, genomic sequences of one or more intergenic regions, as well as SNP context sequences and other SNP information for any SNPs that lie within these intergenic regions). SNPs can readily be cross-referenced between Tables based on their hCV (or, in some instances, hDV) identification numbers.

The gene/transcript/protein information includes:
a gene number (1 through n, where n=the total number of genes in the Table)
a Celera hCG and UID internal identification numbers for the gene
a Celera hCT and UID internal identification numbers for the transcript (Table 1 only)
a public Genbank accession number (e.g., RefSeq NM number) for the transcript (Table 1 only)
a Celera hCP and UID internal identification numbers for the protein encoded by the hCT transcript (Table 1 only)
a public Genbank accession number (e.g., RefSeq NP number) for the protein (Table 1 only)
an art-known gene symbol
an art-known gene/protein name
Celera genomic axis position (indicating start nucleotide position-stop nucleotide position)
the chromosome number of the chromosome on which the gene is located
an OMIM (Online Mendelian Inheritance in Man; Johns Hopkins University/NCBI) public reference number for obtaining further information regarding the medical significance of each gene
alternative gene/protein name(s) and/or symbol(s) in the OMIM entry NOTE: Due to the presence of alternative splice forms, multiple transcript/protein entries can be provided for a single gene entry in Table 1; i.e., for a single Gene Number, multiple entries may be provided in series that differ in their transcript/protein information and sequences.

Following the gene/transcript/protein information is a transcript sequence and protein sequence (in Table 1), or a genomic sequence (in Table 2), for each gene, as follows:
  transcript sequence (Table 1 only) (corresponding to SEQ ID NOS:1-80 of the Sequence Listing), with SNPs identified by their IUB codes (transcript sequences can include 5' UTR, protein coding, and 3' UTR regions). (NOTE: If there are differences between the nucleotide sequence of the hCT transcript and the corresponding public transcript sequence identified by the Genbank accession number, the hCT transcript sequence (and encoded protein) is provided, unless the public sequence is a RefSeq transcript sequence identified by an NM number, in which case the RefSeq NM transcript sequence (and encoded protein) is provided. However, whether the hCT transcript or RefSeq NM transcript is used as the transcript sequence, the disclosed SNPs are represented by their IUB codes within the transcript.)
  the encoded protein sequence (Table 1 only) (corresponding to SEQ ID NOS:81-160 of the Sequence Listing)
  the genomic sequence of the gene (Table 2 only), including 6 kb on each side of the gene boundaries (i.e., 6 kb on the 5' side of the gene plus 6 kb on the 3' side of the gene) (corresponding to SEQ ID NOS:260-435 of the Sequence Listing).

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (and such SNPs are identified as "INTERGENIC" for SNP type).

NOTE: The transcript, protein, and transcript-based SNP context sequences are provided in both Table 1 and in the Sequence Listing. The genomic and genomic-based SNP context sequences are provided in both Table 2 and in the Sequence Listing. SEQ ID NOS are indicated in Table 1 for each transcript sequence (SEQ ID NOS:1-80), protein sequence (SEQ ID NOS:81-160), and transcript-based SNP context sequence (SEQ ID NOS:161-259), and SEQ ID NOS are indicated in Table 2 for each genomic sequence (SEQ ID NOS:260-435), and genomic-based SNP context sequence (SEQ ID NOS:436-1566).

The SNP information includes:
  context sequence (taken from the transcript sequence in Table 1, and taken from the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS:161-259; the genomic-based SNP context sequences in Table 2 are provided in the Sequence Listing as SEQ ID NOS:436-1566).
  Celera hCV internal identification number for the SNP (in some instances, an "hDV" number is given instead of an "hCV" number)
  SNP position [position of the SNP within the given transcript sequence (Table 1) or within the given genomic sequence (Table 2)]
  SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs)) (NOTE: multiple "Applera" source entries for a single SNP indicate that the same SNP was covered by multiple overlapping amplification products and the re-sequencing results (e.g., observed allele counts) from each of these amplification products is being provided).

For the following SNPs provided in Table 1 and/or 2, the SNP source falls into one of the following three categories: 1) SNPs for which the SNP source is only "Applera" and none other, 2) SNPs for which the SNP source is only "Celera Diagnostics" and none other, and 3) SNPs for which the SNP source is both "Applera" and "Celera Diagnostics" but none other (the hCV identification number and SEQ ID NO for the SNP's genomic context sequence in Table 2 are indicated): hCV22275299 (SEQ ID NO:482), hCV25615822 (SEQ ID NO:639), hCV25651109 (SEQ ID NO:840), hCV25951678 (SEQ ID NO:1013), and hCV25615822 (SEQ ID NO:1375). These SNPs have not been observed in any of the public databases (dbSNP, HGBASE, and HGMD), and were also not observed during shotgun sequencing and assembly of the Celera human genome sequence (i.e., "Celera" SNP source).

Population/allele/allele count information in the format of [population1(first_allele,count1second_allele,count) population2(first_allele,count1second_allele,count) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["-" in the allele field represents a deletion allele of an insertion/deletion ("indel") polymorphism (in which case the corresponding insertion allele, which may be comprised of one or more nucleotides, is indicated in the allele field on the opposite side of the "I"); "-" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC1"=human individual DNA (anonymized samples) from 24 individuals of self-described PACIFIC RIM heritage; "CAUC1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library. Six male and 6 female; "SC_12_AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library (six male and six female).

NOTE: For SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

(NOTE: semicolons separate population/allele/count information corresponding to each indicated SNP source; i.e., if four SNP sources are indicated, such as "Celera", "dbSNP", "HGBASE", and "HGMD", then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information)

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary]

Protein coding information (Table 1 only), where relevant, in the format of [protein SEQ ID NO:#, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides sequences (SEQ ID NOS:1567-1914) of exemplary primers that can be used to assay certain SNPs by allele-specific PCR, such as for stroke-related uses.

Table 3 provides the following:

the column labeled "Marker" provides an hCV identification number for each SNP that can be detected using the corresponding primers.

the column labeled "Alleles" designates the two alternative alleles (i.e., nucleotides) at the SNP site. These alleles are targeted by the allele-specific primers (the allele-specific primers are shown as Primer 1 and Primer 2). Note that alleles may be presented in Table 3 based on a different orientation (i.e., the reverse complement) relative to how the same alleles are presented in Tables 1-2.

the column labeled "Primer 1 (Allele-Specific Primer)" provides an allele-specific primer that is specific for an allele designated in the "Alleles" column.

the column labeled "Primer 2 (Allele-Specific Primer)" provides an allele-specific primer that is specific for the other allele designated in the "Alleles" column.

the column labeled "Common Primer" provides a common primer that is used in conjunction with each of the allele-specific primers (i.e., Primer 1 and Primer 2) and which hybridizes at a site away from the SNP position.

All primer sequences are given in the 5' to 3' direction.

Each of the nucleotides designated in the "Alleles" column matches or is the reverse complement of (depending on the orientation of the primer relative to the designated allele) the 3' nucleotide of the allele-specific primer (i.e., either Primer 1 or Primer 2) that is specific for that allele.

Description of Table 4

Table 4 provides a list of LD SNPs that are related to and derived from certain interrogated SNPs. The interrogated SNPs, which are shown in column 1 (which indicates the hCV identification numbers of each interrogated SNP) and column 2 (which indicates the public rs identification numbers of each interrogated SNP) of Table 4, are statistically significantly associated with stroke as shown in the tables. These LD SNPs are provided as an example of SNPs which can also serve as markers for disease association based on their being in LD with an interrogated SNP. The criteria and process of selecting such LD SNPs, including the calculation of the $r^2$ value and the $r^2$ threshold value, are described in Example Eight, below.

In Table 4, the column labeled "Interrogated SNP" presents each marker as identified by its unique hCV identification number. The column labeled "Interrogated rs" presents the publicly known identifier rs number for the corresponding hCV number. The column labeled "LD SNP" presents the hCV numbers of the LD SNPs that are derived from their corresponding interrogated SNPs. The column labeled "LD SNP rs" presents the publicly known rs number for the corresponding hCV number. The column labeled "Power" presents the level of power where the $r^2$ threshold is set. For example, when power is set at 0.51, the threshold $r^2$ value calculated therefrom is the minimum $r^2$ that an LD SNP must have in reference to an interrogated SNP, in order for the LD SNP to be classified as a marker capable of being associated with a disease phenotype at greater than 51% probability. The column labeled "Threshold $r^2$" presents the minimum value of $r^2$ that an LD SNP must meet in reference to an interrogated SNP in order to qualify as an LD SNP. The column labeled "$r^2$" presents the actual $r^2$ value of the LD SNP in reference to the interrogated SNP to which it is related.

Description of Tables 5-38

Table 5 provides baseline characteristics of ARIC participants in the ischemic stroke study.

Table 6 provides SNPs associated with incident ischemic stroke in the ARIC study.

See Example One for further information relating to Tables 5-6.

Tables 7, 8, and 9 provide SNPs, identified from among the 51 SNPs analyzed in ARIC participants, that predict ischemic stroke risk that were identified by Cox proportional hazard analysis as each having a two-sided p-value of <0.2 after adjusting for age and sex and also a hazard ratio (HRR)>1.0 in whites (Table 7), blacks (Table 8), and both whites and blacks (Table 9) (the p-values shown in Tables 7-9 are two-sided p-values; thus, the one-sided p-values for these SNPs are half of these two-sided p-values). See "Supplemental Analysis of SNPs in the ARIC Study" section for further information relating to Tables 7-9.

Table 10 provides baseline characteristics of CHS participants in the ischemic stroke study.

Table 11 provides SNPs associated with incident ischemic stroke in white participants of CHS.

Table 12 provides SNPs associated with incident ischemic stroke in African American participants of CHS.

Table 13 shows that Val allele homozygotes of ABCG2 Val12Met, compared with the Met allele carriers, are associated with increased risk of incident ischemic stroke in both white and African American Participants of CHS.

See Example Two for further information relating to Tables 10-13.

Table 14 provides three SNPs that predict ischemic stroke risk that were identified by Cox proportional hazard analysis as each having one-sided p-values of <=0.05 in whites after adjusting for age and sex, and also after adjusting for traditional risk factors. See "Supplemental Analysis of SNPs in the CHS Study" section for further information relating to Table 14.

Table 15 provides characteristics of noncardioembolic stroke cases and healthy controls in the Vienna Stroke Registry (VSR) study.

Table 16 provides characteristics of six SNPs tested for association with noncardioembolic stroke in VSR.

Table 17 provides results of analysis for association of six SNPs with noncardioembolic stroke in VSR. In Table 17, individuals with missing genotype or traditional risk factor information were excluded from case and control counts; Model 1 was adjusted for age and sex; Model 2 was adjusted for age, sex, smoking, hypertension, diabetes, dyslipidemia, and BMI; and "q" is the false discovery rate q value.

See Example Three for further information relating to Tables 15-17.

Table 18 provides SNPs associated (2-sided p-value of <0.2) with ischemic stroke (labeled "ischemic" in the "outcome" column), atherothrombotic stroke (labeled "athero" in the "outcome" column), and/or early-onset stroke (labeled "early-onset" in the "outcome" column) in the VSR study either before or after adjustment for traditional risk factors (results after adjustment are labeled "yes" and results before adjustment are labeled "no" in the "adjust?" column) (the p-values shown in Table 18 are two-sided p-values; thus, the one-sided p-values for these SNPs are half of these two-sided p-values). See "Supplemental Analysis of SNPs in the Vienna Stroke Registry" section for further information relating to Table 18.

Table 19 (provided as Tables 19A-C to reduce the table width, thus the order of the rows corresponds to the same markers and studies across each of Tables 19A-C) provides 61 SNPs that were associated with stroke risk in the UCSF/CCF study (1-sided p<0.05 or 2-sided p<0.1) and had the same risk allele as in the VSR study. Table 19 provides the stroke association data in both the UCSF/CCF and the VSR studies. In Table 19A, the column labeled "RefAllele" refers to the major allele and the column labeled "Allele" refers to the alternative (minor) allele. Where the "OR" (in Table 19C) is greater than one, carrying the minor allele has greater stroke risk compared to carrying the major (reference) allele, so the minor allele would be the risk allele. Where the "OR" (in Table 19C) is less than one, the major allele would be the risk allele. See Example Four below for further information relating to Table 19.

Tables 20-21 provide SNPs that showed significant association with stroke risk in the German West Study (which may be interchangeably referred to herein as the "Muenster" Stroke Study). Table 20 provides SNPs associated with stroke risk that have the same risk allele and 2-sided p-values that are less than 0.1 (equivalent to 1-sided p-values that are less than 0.05), and Table 21 provides SNPs associated with stroke risk that have the same risk allele and 2-sided p-values that are between 0.1 and 0.2 (equivalent to 1-sided p-values that are between 0.05 and 0.1). In Tables 20-21, the following abbreviations are used for the endpoints in the column labeled "outcome": "ischemic_stk"=ischemic stroke, "nonce_stk"=noncardioembolic stroke (ischemic strokes that were not cardioembolic in origin), "CE_stk"=cardioembolic stroke, "athero_stk"=atherothrombotic stroke, "lacunar_stk"=Lacunar stroke, "nohd_stk"=no heart disease stroke (ischemic stroke cases excluding those with a history of heart disease), "recurrent_stk"=recurrent stroke (stroke cases that also had a prior history of stroke), and "EO_stk"=early onset stroke (cases that are younger than the median age of all cases, and controls that were older than the median age of all controls). See Example Five below for further information relating to Tables 20-21.

Tables 22-32 and 37-38 provide SNPs associated with stroke risk or stroke statin response (SSR) in two pravastatin trials: CARE ("Cholesterol and Recurrent Events" study, which is comprised of individuals who have had an MI) and PROSPER ("Prospective Study of Pravastatin in the Elderly at Risk" study, which is comprised of elderly individuals with or without a history of cardiovascular disease). SNPs that were significantly associated with stroke risk in CARE are provided in Tables 22, 24, and 26. SNPs that were significantly associated with SSR in CARE are provided in Tables 23, 25, and 27. Results of the analysis of the MYH15 SNP (rs3900940/hcv7425232) for association with stroke risk in CARE are provided in Table 28. SNPs that were significantly associated with stroke risk in PROSPER are provided in Table 29 (which lists SNPs having P_all<0.2, which is the p-value based on the entire study cohort) and Table 30 (which lists SNPs having P_placebo<0.2, which is the p-value based on just the placebo group). SNPs that were significantly associated with SSR in PROSPER are provided in Table 31 (which lists SNPs having $P_{int}$<0.1) and Table 32 (which lists SNPs having $P_{int}$<0.2), which provide results of analyses of pravastatin-treated versus placebo-treated individuals. Tables 37-38 provide the results of further analyses of the chromosome 9p21 SNP rs10757274 (hCV26505812) for association with SSR in CARE (Table 37) and PROSPER (Table 38), including both unadjusted and adjusted analyses (adjusted for factors such as age, gender, smoking status, hypertension, diabetes, BMI, and LDL and HDL levels). Table 37 provides results in CARE, and Table 38 provides results in PROSPER (whether each analysis is unadjusted or adjusted is indicated in the "adjust" column in Table 37, or by "unadj" and "adj" column labels in Tables 38).

With respect to Tables 22-32 and 37-38, the columns labeled "Genotype" (in Tables 22-28 and 37), "Geno_Placebo" (in Tables 29-30 and 38), and "Geno_Resp" (in Tables 31-32 and 38) indicate the genotype which the given stroke risk or SSR results correspond to. All the p-values (including $P_{int}$ values) provided in Tables 22-32 and 37-38 are two-sided p-values (two-sided p-value cutoffs of 0.1 and 0.2 are equivalent to one-sided p-value cutoffs of 0.05 and 0.1, respectively). In Tables 23, 25, 27, 31-32, and 37-38 (which include results pertaining to SSR), the p-value (which is labeled "p-value" in Tables 23, 25, 27, and 37, and labeled "p_resp" in Tables 31-32 and 38) refers to the significance of the statin benefit (i.e., the HR of pravastatin-treated versus placebo-treated carriers of a given genotype), whereas the $P_{int}$ value (which is labeled as "pval_intx" in Tables 23, 25, 27, and 37, and labeled "p_int_resp" in Tables 31-32 and 38) refers to the significance of the genotype by treatment interaction, i.e., the significance of the difference in statin response among three groups defined by the three genotypes (homozygotes of each of the two alternative alleles, plus heterozygotes, as indicated in the column labeled "Genotype" or "Geno") or two groups defined by the carriers and noncarriers of one or the other allele ("Dom" or "Rec", as indicated in the column labeled "Mode"). In Tables 29-32 and 38, the columns labeled "LOWER_PLACEBO" and "UPPER_PLACEBO" (Tables 29-30 and 38), and "LOWER_RESP" and "UPPER_RESP" (Tables 31-32 and 38), refer to the lower and upper 95% confidence intervals for the hazard ratios. See Example Six below for further information relating to Tables 22-32 and 37-38.

Tables 33-36 provide SNPs that showed significant association with stroke risk in the Cardiovascular Health Study (CHS). Specifically, SNPs that are associated with stroke risk in white or black individuals with 2-sided p-values less than 0.1 (equivalent to 1-sided p-values less than 0.05) are provided in Table 33 (white individuals) and Table 34 (black individuals), and SNPs that are associated with stroke risk in white or black individuals with 2-sided p-values between 0.1 and 0.2 (equivalent to 1-sided p-values between 0.05 and 0.1) are provided in Table 35 (white individuals) and Table 36 (black individuals). Association was analyzed for three related stroke end points, which are indicated in Tables 33-36 by the following abbreviations in the column labeled "endpt": "stroke"=stroke (all subtypes), "ischem"=ischemic stroke (excludes hemorrhagic stroke), and "athero"=atherothrombotic stroke (excludes hemorrhagic stroke and cardioembolic stroke). See Example Seven below for further information relating to Tables 33-36.

In the tables, the following abbreviations may be used: "ProbChiSq"=p-value, "PVALUE_2DF" or "2DF P-VALUE"=p-value with two degrees of freedom, "PVAL_INTX" or "P_INT_RESP"=$P_{int}$ (the significance of the genotype by treatment interaction—see description of Tables 23, 25, 27, 31-32, and 37-38 above), "std.ln(OR)"=the standard deviation of the natural log of the OR, "Hom"=homozygotes, "Het"=heterozygotes, "cnt"=count, "frq"=frequency, "dom"=dominant, "rec"=recessive, "gen"=genotypic, "add"=additive, "HW"=Hardy-Weinberg, "TIA"=transient ischemic stroke (also known as a mini stroke), "events"=number of strokes (including TIA) in the study cohort, "DIAB", "DIABADA", or "DIABETES_1"=diabetes, "HTN" or "HYPERTEN_1"=hypertension, "ENDPT4F1"=endpoint of stroke or TIA (official endpoint of the CARE Study), "TIMEVAR"=length of time from baseline to the time of event/endpoint, "TIMETO_EP4F1"=length of time from baseline to the time of endpoint ENDPT4F1 (stroke or TIA), "TRF"=traditional risk factors, "BMI"=body mass index, "AGEBL"=age, "GEND01"=gender, "PRESSM" or "CURRSMK"=smoking status, "LDLADJBL" or "BASE_LDL"=low-density lipoprotein (LDL) cholesterol, and "HDL44BL" or "BASE_HDL"=high-density lipoprotein (HDL) cholesterol ("BASE_LDL" and "BASE_HDL" adjustments are based on continuous variables rather than discrete cutoffs). Two-"sided" p-values may be interchangeably referred to as two-"tailed" p-values.

Throughout the tables, "HR" or "HRR" refers to the hazard ratio, "OR" refers to the odds ratio, terms such as "90% CI" or "95% CI" refer to the 90% or 95% confidence interval (respectively) for the hazard ratio or odds ratio ("CI"/"confidence interval" and "CL"/"confidence limit" may be used herein interchangeably), and terms such as "OR99CI.L" and "OR99CI.U" refer to the lower and upper 99% confidence intervals (respectively) for the odds ratio. Hazard ratios ("HR" or "HRR") or odds ratios (OR) that are greater than one indicate that a given allele (or combination of alleles such as a haplotype, diplotype, or two-locus diplotype) is a risk allele (which may also be referred to as a susceptibility allele), whereas hazard ratios or odds ratios that are less than one indicate that a given allele is a non-risk allele (which may also be referred to as a protective allele). For a given risk allele, the other alternative allele at the SNP position (which can be derived from the information provided in Tables 1-2, for example) may be considered a non-risk allele. For a given non-risk allele, the other alternative allele at the SNP position may be considered a risk allele.

Thus, with respect to disease risk (e.g., stroke), if the risk estimate (odds ratio or hazard ratio) for a particular allele at a SNP position is greater than one, this indicates that an individual with this particular allele has a higher risk for the disease than an individual who has the other allele at the SNP position. In contrast, if the risk estimate (odds ratio or hazard ratio) for a particular allele is less than one, this indicates that an individual with this particular allele has a reduced risk for the disease compared with an individual who has the other allele at the SNP position.

With respect to drug response (e.g., response to a statin), if the risk estimate (odds ratio or hazard ratio) of those treated with pravastatin compared with those treated with a placebo within a particular genotype is less than one, this indicates that an individual with this particular genotype would benefit from the drug (an odds ratio or hazard ratio equal to one would indicate that the drug has no effect). As used herein, the term "benefit" (with respect to a preventive or therapeutic drug treatment) is defined as achieving a reduced risk for a disease that the drug is intended to treat or prevent (e.g., stroke) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

For stroke risk and statin response associations based on samples from the CARE and PROSPER trials described herein, stroke risk is assessed by comparing the risk of stroke for a given genotype with the risk of stroke for a reference genotype either in the placebo arm of the trial or in the whole study population of the trial, and statin response is assessed by comparing the risk of stroke in the pravastatin arm of the trial with the risk of stroke in the placebo arm of the trial for the same genotype.

BRIEF DESCRIPTION OF THE FIGURES

FIGS. 1a-1b show a comparison of Kaplan-Meier estimates of the cumulative incidence of ischemic stroke among Val allele homozygotes of the ABCG2 Val12Met SNP (rs2231137/hCV15854171) and among Met allele carriers in white (FIG. 1a) and in African American (FIG. 1b) participants of CHS (see Example Two).

DETAILED DESCRIPTION OF EXEMPLARY EMBODIMENTS OF THE INVENTION

Figure 1B:
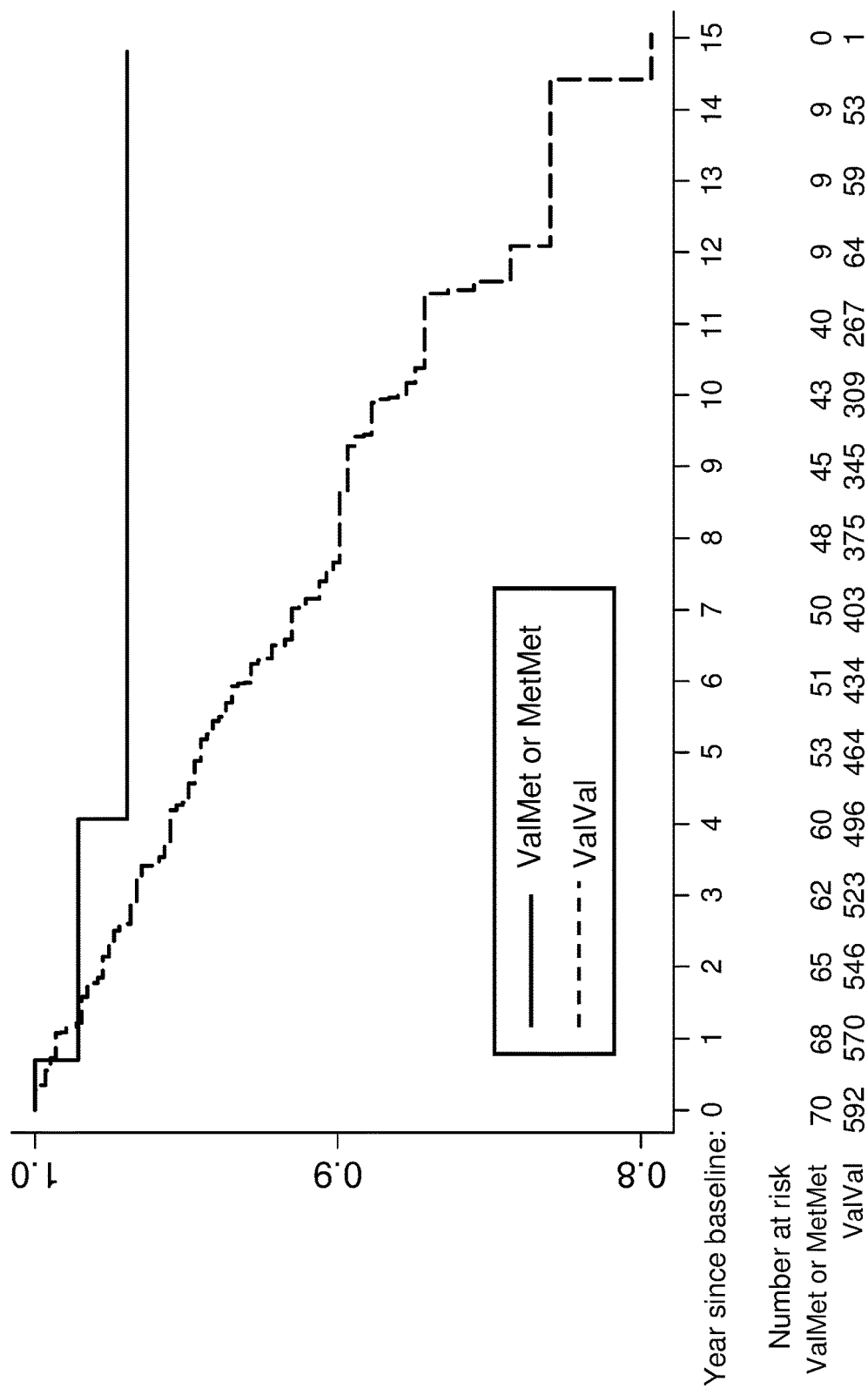

The present invention provides SNPs associated with stroke risk, and SNPs that are associated with an individual's responsiveness to therapeutic agents, particularly statins, which may be used for the treatment (including preventive treatment) of stroke. The present invention further provides nucleic acid molecules containing SNPs, methods and reagents for the detection of the SNPs disclosed herein, uses of these SNPs for the development of detection reagents, and assays or kits that utilize such reagents. The SNPs disclosed herein are useful for diagnosing, prognosing, screening for, and evaluating predisposition to stroke and related pathologies in humans. The drug response-associated SNPs disclosed herein are particularly useful for predicting, screening for, and evaluating response to statin treatment, particularly treatment or prevention of stroke using statins, in humans. Furthermore, such SNPs and their encoded products are useful targets for the development of therapeutic and preventive agents.

A large number of SNPs have been identified from re-sequencing DNA from 39 individuals, and they are indicated as "Applera" SNP source in Tables 1-2. Their allele frequencies observed in each of the Caucasian and African-American ethnic groups are provided. Additional SNPs included herein were previously identified during shotgun sequencing and assembly of the human genome, and they are indicated as "Celera" SNP source in Tables 1-2. Furthermore, the information provided in Table 1-2, particularly the allele frequency information obtained from 39 individuals and the identification of the precise position of each SNP within each gene/transcript, allows haplotypes (i.e., groups of SNPs that are co-inherited) to be readily inferred. The present invention encompasses SNP haplotypes, as well as individual SNPs.

Thus, the present invention provides individual SNPs associated with stroke, and/or drug response (particularly statin response), as well as combinations of SNPs and haplotypes in genetic regions associated with stroke, polymorphic/variant transcript sequences (SEQ ID NOS:1-80) and genomic sequences (SEQ ID NOS:260-435) containing SNPs, encoded amino acid sequences (SEQ ID NOS: 81-160), and both transcript-based SNP context sequences (SEQ ID NOS:161-259) and genomic-based SNP context sequences (SEQ ID NOS:436-1566) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining the risk of an individual of having a stroke, methods of determining if an individual is likely to respond to a particular treatment such as statins (particularly for treating or preventing stroke), methods of screening for compounds useful for treating disorders associated with a variant gene/protein such as stroke, compounds identified by these screening methods, methods of using the disclosed SNPs to select a treatment/preventive strategy or therapeutic agent (e.g., a statin), methods of treating or preventing a disorder associated with a variant gene/protein, and methods of using the SNPs of the present invention for human identification.

For example, certain embodiments provide methods of using any of rs3900940/hCV7425232 (MYH15), rs3814843/hCV11476411 (CALM1), rs2200733/hCV16158671 (chromosome 4q25), and/or rs10757274/hCV26505812 (chromosome 9p21) for determining stroke risk in an individual, and methods of using rs10757274/hCV26505812 (chromosome 9p21) for determining whether an individual will benefit from statin treatment.

Since vascular disorders/diseases share certain similar features that may be due to common genetic factors that are involved in their underlying mechanisms, the SNPs identified herein as being particularly associated with stroke may be used as diagnostic/prognostic markers or therapeutic targets for other vascular diseases such as coronary heart disease (CHD), atherosclerosis, cardiovascular disease, congestive heart failure, congenital heart disease, and pathologies and symptoms associated with various heart diseases (e.g., angina, hypertension), as well as for predicting responses to drugs such as statins that are used to treat cardiovascular diseases.

The present invention further provides methods for selecting or formulating a treatment regimen (e.g., methods for determining whether or not to administer statin treatment to an individual who has previously had a stroke, or who is at risk for having a stroke in the future, methods for selecting a particular statin-based treatment regimen such as dosage and frequency of administration of statin, or a particular form/type of statin such as a particular pharmaceutical formulation or statin compound, methods for administering an alternative, non-statin-based treatment to individuals who are predicted to be unlikely to respond positively to statin treatment, etc.), and methods for determining the likelihood of experiencing toxicity or other undesirable side effects from statin treatment, etc. The present invention also provides methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment and/or excluding individuals from the trial who are unlikely to respond positively from the statin treatment).

The present invention provides novel SNPs associated with stroke and related pathologies, as well as SNPs that were previously known in the art, but were not previously known to be associated with stroke or response to statin treatment. Accordingly, the present invention provides novel compositions and methods based on the novel SNPs disclosed herein, and also provides novel methods of using the known, but previously unassociated, SNPs in methods relating to evaluating an individual's likelihood of having a first or recurrent stroke, prognosing the severity of stroke in an individual, or prognosing an individual's recovery from stroke, and methods relating to evaluating an individual's likelihood of responding to statin treatment (particularly statin treatment, including preventive treatment, of stroke). In Tables 1-2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD).

Particular SNP alleles of the present invention can be associated with either an increased risk of having a stroke (or related pathologies), or a decreased risk of having a stroke. SNP alleles that are associated with a decreased risk of having a stroke may be referred to as "protective" alleles, and SNP alleles that are associated with an increased risk of having a stroke may be referred to as "susceptibility" alleles, "risk" alleles, or "risk factors". Thus, whereas certain SNPs (or their encoded products) can be assayed to determine whether an individual possesses a SNP allele that is indicative of an increased risk of having a stroke (i.e., a susceptibility allele), other SNPs (or their encoded products) can be assayed to determine whether an individual possesses a SNP allele that is indicative of a decreased risk of having a stroke (i.e., a protective allele). Similarly, particular SNP alleles of the present invention can be associated with either an increased or decreased likelihood of responding to a particular treatment or therapeutic compound (e.g., statins), or an increased or decreased likelihood of experiencing toxic effects from a particular treatment or therapeutic compound. The term "altered" may be used herein to encompass either of these two possibilities (e.g., an increased or a decreased risk/likelihood).

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/protein (the art-known protein may be interchangeably referred to as the "wild-type", "reference", or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation, i.e., a SNP that creates a premature stop codon, a SNP that generates a read-through mutation by abolishing a stop codon, or due to any SNP disclosed by the present invention that otherwise alters the structure, function/activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide", "peptide", and "protein" are used interchangeably.

As used herein, an "allele" may refer to a nucleotide at a SNP position (wherein at least two alternative nucleotides are present in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO:X or its complement". Typically, the sequence surrounding a SNP may be recited when referring to a SNP, however the sequence is not intended as a structural limitation beyond the specific SNP position itself. Rather, the sequence is recited merely as a way of referring to the SNP (in this example, "SEQ ID NO:X or its complement" is recited in order to refer to the SNP located at position 101 of SEQ ID NO:X, but SEQ ID NO:X or its complement is not intended as a structural limitation beyond the specific SNP position itself). A SNP is a variation at a single nucleotide position and therefore it is customary to refer to context sequence (e.g., SEQ ID NO:X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2).

With respect to an individual's risk for a disease or predicted drug responsiveness (e.g., based on the presence or absence of one or more SNPs disclosed herein in the individual's nucleic acid), terms such as "assigning" or "designating" may be used herein to characterize the individual's risk for the disease.

As used herein, the term "benefit" (with respect to a preventive or therapeutic drug treatment) is defined as achieving a reduced risk for a disease that the drug is intended to treat or prevent (e.g., stroke) by administrating the drug treatment (e.g., a statin), compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/siRNA, and microRNA molecules, etc.), vaccines, etc., which may be used for therapeutic and/or preventive treatment of a disease (e.g., stroke).

The statin response-associated SNPs disclosed herein are useful with respect to any statin (HMG-CoA reductase inhibitor), including but not limited to pravastatin (Pravachol®), atorvastatin (Lipitor®), storvastatin, rosuvastatin (Crestor®), fluvastatin (Lescol®), lovastatin (Mevacor®), and simvastatin (Zocor®), as well as combination therapies that include a statin such as simvastatin+ezetimibe (Vytorin®), lovastatin+niacin extended-release (Advicor®), and atorvastatin+amlodipine besylate (Caduet®).

Furthermore, the drug response-associated SNPs disclosed herein may also be used for predicting an individual's responsiveness to drugs other than statins that are used to treat or prevent stroke, and these SNPs may also be used for predicting an individual's responsiveness to statins for the treatment or prevention of disorders other than stroke, particularly cancer. For example, the use of statins in the treatment of cancer is reviewed in: Hindler et al., "The role of statins in cancer therapy", *Oncologist.* 2006 March; 11(3):306-15; Demierre et al., "Statins and cancer prevention", *Nat Rev Cancer.* 2005 December; 5(12):930-42; Stamm et al., "The role of statins in cancer prevention and treatment", *Oncology.* 2005 May; 19(6):739-50; and Sleijfer et al., "The potential of statins as part of anti-cancer treatment", *Eur J Cancer.* 2005 March; 41(4):516-22, each of which is incorporated herein by reference in their entirety.

Drug response with respect to statins may be referred to herein as "stroke statin response" or "SSR".

The various methods described herein, such as correlating the presence or absence of a polymorphism with an altered (e.g., increased or decreased) risk (or no altered risk) for stroke (and/or correlating the presence or absence of a polymorphism with the predicted response of an individual to a drug such as a statin), can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) risk (or no altered risk) for stroke for the individual. Computer software can also perform the step of correlating the presence or absence of a polymorphism in an individual with the predicted response of the individual to a therapeutic agent (such as a statin) or other treatment. Accordingly, certain embodiments of the invention provide a computer (or other apparatus/device) programmed to carry out any of the methods described herein.

Reports, Programmed Computers, Business Methods, and Systems

The results of a test (e.g., an individual's risk for stroke or an individual's predicted drug responsiveness such as statin response, based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practitioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's risk for stroke, or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/biological implications, such as increased or decreased disease risk, for individuals having a certain allele/genotype at the SNP). Thus, for example, the report can include disease risk or other medical/biological significance (e.g., drug responsiveness, etc.) as well as optionally also including the allele/genotype information, or the report may just include allele/genotype information without including disease risk or other medical/biological significance (such that an individual viewing the report can use the allele/genotype information to determine the associated disease risk or other medical/biological significance from a source outside of the report itself, such as from a medical practitioner, publication, website, etc., which may optionally be linked to the report such as by a hyperlink).

A report can further be "transmitted" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the disease risk (e.g., an individual's risk for stroke) or other result (e.g., disease diagnosis or prognosis, drug responsiveness, etc.) based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's risk for stroke (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample) can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, kits for collecting a biological sample from a customer (e.g., a buccal swab for collecting buccal cells) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory which assays the samples for one or more SNPs disclosed herein (such as to determine the customer's risk for stroke) and optionally provides a report to the customer (of the customer's disease risk based on their SNP genotype(s), for example) or provides the results of the assay to another party (e.g., a doctor, genetic counselor, hospital, etc.) which optionally provides a report to the customer (of the customer's disease risk based on their SNP genotype(s), for example).

Certain further embodiments of the invention provide a system for determining an individual's stroke risk, or whether an individual will benefit from statin treatment (or other therapy) in reducing stroke risk. Certain exemplary systems comprise an integrated "loop" in which an individual (or their medical practitioner) requests a determination of such individual's stroke risk (or drug response, etc.), this determination is carried out by testing a sample from the individual, and then the results of this determination are provided back to the requestor. For example, in certain systems, a sample (e.g., blood or buccal cells) is obtained from an individual for testing (the sample may be obtained by the individual, or for example, by a medical practitioner), the sample is submitted to a laboratory (or other facility) for testing (e.g., determining the genotype of one or more SNPs disclosed herein), and then the results of the testing are sent to the patient (which optionally can be done by first sending the results to an intermediary, such as a medical practitioner, who then provides or otherwise conveys the results to the individual), thereby forming an integrated loop system for determining an individual's stroke risk (or drug response, etc.). The portions of the system in which the results are transmitted (e.g., between any of a testing facility, a medical practitioner, and/or the individual) can be carried out by way of electronic or signal transmission (e.g., by computer such as via e-mail or the internet, by providing the results on a website or computer network server which may optionally be a secure database, by phone or fax, or by any other wired or wireless transmission methods known in the art).

Isolated Nucleic Acid Molecules and SNP Detection Reagents & Kits

Tables 1 and 2 provide a variety of information about each SNP of the present invention that is associated with stroke, including the transcript sequences (SEQ ID NOS:1-80), genomic sequences (SEQ ID NOS:260-435), and protein sequences (SEQ ID NOS:81-160) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS:161-259 correspond to transcript-based SNP context sequences disclosed in Table 1, and SEQ ID NOS:436-1566 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

The present invention provides isolated nucleic acid molecules that contain one or more SNPs disclosed Table 1 and/or Table 2. Preferred isolated nucleic acid molecules contain one or more SNPs identified as Applera or Celera proprietary. Isolated nucleic acid molecules containing one or more SNPs disclosed in at least one of Tables 1-2 may be interchangeably referred to throughout the present text as "SNP-containing nucleic acid molecules". Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated". Nucleic acid molecules present in non-human transgenic animals, which do not naturally occur in the animal, are also considered "isolated". For example, recombinant DNA molecules contained in a vector are considered "isolated". Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances, the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are provided in Table 1 and in the Sequence Listing (SEQ ID NOS:1-80), and polymorphic genomic sequences are provided in Table 2 and in the Sequence Listing (SEQ ID NOS:260-435). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences provided in Tables 1-2 (transcript sequences are provided in Table 1 as SEQ ID NOS: 1-80, genomic sequences are provided in Table 2 as SEQ ID NOS:260-435, transcript-based SNP context sequences are provided in Table 1 as SEQ ID NO:161-259, and genomic-based SNP context sequences are provided in Table 2 as SEQ ID NO:436-1566) and their complements. A fragment typically comprises a contiguous nucleotide sequence at least about 8 or more nucleotides, more preferably at least about 12 or more nucleotides, and even more preferably at least about 16 or more nucleotides. Further, a fragment could comprise at least about 18, 20, 22, 25, 30, 40, 50, 60, 80, 100, 150, 200, 250 or 500 (or any other number in-between) nucleotides in length. The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195; and 4,683,202; PCR Technology: *Principles and Applications for DNA Amplification*, ed. H. A. Erlich, Freeman Press, NY, NY, 1992), ligase chain reaction (LCR) (Wu and Wallace, *Genomics* 4:560, 1989; Landegren et al., *Science* 241:1077, 1988), strand displacement amplification (SDA) (U.S. Pat. Nos. 5,270,184; and 5,422,252), transcription-mediated amplification (TMA) (U.S. Pat. No. 5,399,491), linked linear amplification (LLA) (U.S. Pat. No. 6,027,923), and the like, and isothermal amplification methods such as nucleic acid sequence based amplification (NASBA), and self-sustained sequence replication (Guatelli et al., *Proc. Natl. Acad. Sci. USA* 87: 1874, 1990). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten-fold, fifty-fold, one hundred-fold, one thousand-fold, or ten thousand-fold increase as compared to its starting amount in a test sample. In a typical PCR amplification, a polynucleotide of interest is often amplified at least fifty thousand-fold in amount over the unamplified genomic DNA, but the precise amount of amplification needed for an assay typically depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1-2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product (however, as indicated above, the SNP of interest may be located anywhere along the length of the amplified product).

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are provided in Table 1 as SEQ ID NOS:1-80, genomic sequences are provided in Table 2 as SEQ ID NOS:260-435, transcript-based SNP context sequences are provided in Table 1 as SEQ ID NO:161-259, and genomic-based SNP context sequences are provided in Table 2 as SEQ ID NO:436-1566), or any nucleic acid molecule that encodes any of the variant proteins provided in Table 1 (SEQ ID NOS:81-160). A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences shown in Table 1 and/or Table 2 (transcript sequences are provided in Table 1 as SEQ ID NOS:1-80, genomic sequences are provided in Table 2 as SEQ ID NOS:260-435, transcript-based SNP context sequences are provided in Table 1 as SEQ ID NO:161-259, and genomic-based SNP context sequences are provided in Table 2 as SEQ ID NO:436-1566), or any nucleic acid molecule that encodes any of the variant proteins provided in Table 1 (SEQ ID NOS:81-160). A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are provided in Table 1 as SEQ ID NOS:1-80, genomic sequences are provided in Table 2 as SEQ ID NOS:260-435, transcript-based SNP context sequences are provided in Table 1 as SEQ ID NO:161-259, and genomic-based SNP context sequences are provided in Table 2 as SEQ ID NO:436-1566), or any nucleic acid molecule that encodes any of the variant proteins provided in Table 1 (SEQ ID NOS:81-160). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art (Sambrook and Russell, 2000, Molecular Cloning: A Laboratory Manual, Cold Spring Harbor Press, NY).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof (Sambrook and Russell, 2000, Molecular Cloning: A Laboratory Manual, Cold Spring Harbor Press, NY). Furthermore, isolated nucleic acid molecules, particularly SNP detection reagents such as probes and primers, can also be partially or completely in the form of one or more types of nucleic acid analogs, such as peptide nucleic acid (PNA) (U.S. Pat. Nos. 5,539,082; 5,527,675; 5,623,049; 5,714,331). The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art (see, e.g., Corey, "Peptide nucleic acids: expanding the scope of nucleic acid recognition", *Trends Biotechnol.* 1997 June; 15(6):224-9, and Hyrup et al., "Peptide nucleic acids (PNA): synthesis, properties and potential applications", *Bioorg Med Chem.* 1996 January; 4(1):5-23). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone (Lagriffoul et al., Bioorganic & Medicinal Chemistry Letters, 4: 1081-1082 (1994), Petersen et al., Bioorganic & Medicinal Chemistry Letters, 6: 793-796 (1996), Kumar et al., Organic Letters 3(9): 1269-1272 (2001), WO96/04000). PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1-2). Variation can occur in either or both the coding and non-coding regions. The variations can produce conservative and/or non-conservative amino acid substitutions.

Further variants of the nucleic acid molecules disclosed in Tables 1-2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences shown in Tables 1-2, and can encode a polypeptide that varies to some degree from the specific polypeptide sequences shown in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. (*Computational Molecular Biology*, Lesk, A. M., ed., Oxford University Press, New York, 1988; *Biocomputing: Informatics and Genome Projects*, Smith, D. W., ed., Academic Press, New York, 1993; Computer Analysis of Sequence Data, Part 1, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). In a preferred embodiment, the percent identity between two amino acid sequences is determined using the Needleman and Wunsch algorithm (*J. Mol. Biol.* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package (Devereux, J., et al., *Nucleic Acids Res.* 12(1):387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases to, for example, identify other family members or related sequences. Such searches can be performed using the NBLAST and XBLAST programs (version 2.0) of Altschul, et al. (*J. Mol. Biol.* 215:403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (*Nucleic Acids Res.* 25(17):3389-3402 (1997)). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol. Biol.* 25, 365-389 (1994)) and KERR (Dufresne et al., *Nat Biotechnol* 2002 December; 20(12):1269-71). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (provided in Table 1 as SEQ ID NOS: 1-80), genomic sequences (provided in Table 2 as SEQ ID NOS:260-435), and context sequences (transcript-based context sequences are provided in Table 1 as SEQ ID NOS:161-259; genomic-based context sequences are provided in Table 2 as SEQ ID NOS:436-1566), can be used for the design of SNP detection reagents. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs provided in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences provided in Table 1 and/or Table 2 (transcript-based context sequences are provided in Table 1 as SEQ ID NOS:161-259; genomic-based context sequences are provided in Table 2 as SEQ ID NOS:436-1566). Another example of a detection reagent is a primer which acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g., probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS:1-80), genomic sequences (SEQ ID NOS:260-435), and SNP context sequences (transcript-based context sequences are provided in Table 1 as SEQ ID NOS:161-259; genomic-based context sequences are provided in Table 2 as SEQ ID NOS:436-1566) disclosed in the Sequence Listing and in Tables 1-2. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm which starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides which detect single nucleotide variations in target sequences may be referred to by such terms as "allele-specific oligonucleotides", "allele-specific probes", or "allele-specific primers". The design and use of allele-specific probes for analyzing polymorphisms is described in, e.g., *Mutation Detection A Practical Approach*, ed. Cotton et al. Oxford University Press, 1998; Saiki et al., *Nature* 324, 163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: Prehybridization with a solution containing 5× standard saline phosphate EDTA (SSPE), 0.5% NaDodSO$_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment which is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are not limited to, the phosphotriester method described by Narang et al., 1979, *Methods in Enzymology* 68:90; the phosphodiester method described by Brown et al., 1979, *Methods in Enzymology* 68:109, the diethylphosphoamidate method described by Beaucage et al., 1981, *Tetrahedron Letters* 22:1859; and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity (Gibbs, 1989, *Nucleic Acid Res.* 17 2427-2448). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention.

Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118,801 and 5,312,728), or other stemless or linear beacon probe (Livak et al., 1995, PCR Method Appl. 4:357-362; Tyagi et al., 1996, Nature Biotechnology 14: 303-308; Nazarenko et al., 1997, Nucl. Acids Res. 25:2516-2521; U.S. Pat. Nos. 5,866,336 and 6,117,635).

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems", as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g., a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays", "microarrays", and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in U.S. Pat. No. 5,837,832, Chee et al., PCT application WO95/11995 (Chee et al.), Lockhart, D. J. et al. (1996; *Nat. Biotech.* 14: 1675-1680) and Schena, M. et al. (1996; *Proc. Natl. Acad. Sci.* 93: 10614-10619), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics", *Biotechnol Annu Rev.* 2002; 8:85-101; Sosnowski et al., "Active microelectronic array system for DNA hybridization, genotyping and pharmacogenomic applications", *Psychiatr Genet.* 2002 December; 12(4):181-92; Heller, "DNA microarray technology: devices, systems, and applications", *Annu Rev Biomed Eng.* 2002; 4:129-53. Epub 2002 Mar. 22; Kolchinsky et al., "Analysis of SNPs and other genomic variations using gel-based chips", *Hum Mutat.* 2002 April; 19(4):343-60; and McGall et al., "High-density genechip oligonucleotide probe arrays", *Adv Biochem Eng Biotechnol.* 2002; 77:21-42.

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology*, John Wiley & Sons, N.Y. (1989), 6.3.1-6.3.6.

In other embodiments, the arrays are used in conjunction with chemiluminescent detection technology. The following patents and patent applications, which are all hereby incorporated by reference, provide additional information pertaining to chemiluminescent detection: U.S. patent application Ser. Nos. 10/620,332 and 10/620,333 describe chemiluminescent approaches for microarray detection; U.S. Pat. Nos. 6,124,478, 6,107,024, 5,994,073, 5,981,768, 5,871,938, 5,843,681, 5,800,999, and 5,773,628 describe methods and compositions of dioxetane for performing chemiluminescent detection; and U.S. published application US2002/0110828 discloses methods and compositions for microarray controls.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells), biopsies, buccal cells (e.g., as obtained by buccal swabs), or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art (see, e.g., Weigl et al., "Lab-on-a-chip for drug development", *Adv Drug Deliv Rev.* 2003 Feb. 24; 55(3):349-77). In such microfluidic devices, the containers may be referred to as, for example, microfluidic "compartments", "chambers", or "channels".

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micromachined channels and to change the liquid flow rate for pumping across different sections of the microchip. See, for example, U.S. Pat. No. 6,153,073, Dubrow et al., and U.S. Pat. No. 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, especially in the diagnosis and treatment of stroke and related pathologies. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule provided in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations (Sambrook and Russell, 2000, Molecular Cloning: A Laboratory Manual, Cold Spring Harbor Press, Cold Spring Harbor, N.Y.).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining whether an individual with the polymorphisms is at risk for stroke and related pathologies. Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences provided in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allow, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which specific nucleotide (i.e., allele) is present at each of one or more SNP positions, such as a SNP position in a nucleic acid molecule disclosed in Table 1 and/or Table 2, is referred to as SNP genotyping. The present invention provides methods of SNP genotyping, such as for use in determining predisposition to stroke or related pathologies, or determining responsiveness to a form of treatment, or in genome mapping or SNP association analysis, etc.

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput", *Pharmacogenomics J.* 2003; 3(2):77-96; Kwok et al., "Detection of single nucleotide polymorphisms", *Curr Issues Mol Biol.* 2003 April; 5(2): 43-60; Shi, "Technologies for individual genotyping: detection of genetic polymorphisms in drug targets and disease genes", *Am J Pharmacogenomics.* 2002; 2(3):197-205; and Kwok, "Methods for genotyping single nucleotide polymorphisms", *Annu Rev Genomics Hum Genet* 2001; 2:235-58. Exemplary techniques for high-throughput SNP genotyping are described in Marnellos, "High-throughput SNP analysis for genetic association studies", *Curr Opin Drug Discov Devel.* 2003 May; 6(3):317-21. Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et A, *Science* 230:1242 (1985); Cotton et al., *PNAS* 85:4397 (1988); and Saleeba et A, *Meth. Enzymol.* 217:286-295 (1992)), comparison of the electrophoretic mobility of variant and wild type nucleic acid molecules (Orita et al., *PNAS* 86:2766 (1989); Cotton et A, *Mutat. Res.* 285:125-144 (1993); and Hayashi et al., *Genet. Anal. Tech. Appl.* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and 51 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in assays for determining predisposition to stroke and related pathologies, and can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA: U.S. Pat. Nos. 6,027,889, 6,268,148, 5,494,810, 5,830,711, and 6,054,564 describe OLA strategies for performing SNP detection; WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array; U.S. application US01/17329 (and Ser. No. 09/584,905) describes OLA (or LDR) followed by PCR, wherein zipcodes are incorporated into OLA probes, and amplified PCR products are determined by electrophoretic or universal zipcode array readout; U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry", *Rapid Commun Mass Spectrom.* 2003; 17(11):1195-202.

The following references provide further information describing mass spectrometry-based methods for SNP genotyping: Bocker, "SNP and mutation discovery using base-specific cleavage and MALDI-TOF mass spectrometry", *Bioinformatics.* 2003 July; 19 Suppl 1:144-153; Storm et al., "MALDI-TOF mass spectrometry-based SNP genotyping", *Methods Mol Biol.* 2003; 212:241-62; Jurinke et al., "The use of Mass ARRAY technology for high throughput genotyping", *Adv Biochem Eng Biotechnol.* 2002; 77:57-74; and Jurinke et al., "Automated genotyping using the DNA MassArray technology", *Methods Mol Biol.* 2002; 187:179-92.

SNPs can also be scored by direct DNA sequencing. A variety of automated sequencing procedures can be utilized ((1995) Biotechniques 19:448), including sequencing by mass spectrometry (see, e.g., PCT International Publication No. WO94/16101; Cohen et al., *Adv. Chromatogr.* 36:127-162 (1996); and Griffin et al., *Appl. Biochem. Biotechnol.* 38:147-159 (1993)). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel (Erlich, ed., PCR Technology, *Principles and Applications for DNA Amplification*, W.H. Freeman and Co, New York, 1992, Chapter 7).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying a patient population for clinical trial for a treatment regimen, predicting the likelihood that an individual will experience toxic side effects from a therapeutic agent, and human identification applications such as forensics.

Analysis of Genetic Association Between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies (*Modern Epidemiology*, Lippincott Williams & Wilkins (1998), 609-622). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

In both types of observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease (Genetic Data Analysis, Weir B., Sinauer (1990)).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions) (Applied Logistic Regression, Hosmer and Lemeshow, Wiley (2000)). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $R^2$, are typically calculated for the markers within a gene to elucidate the haplotype structure. Recent studies (Daly et al, *Nature Genetics*, 29, 232-235, 2001) in linkage disequilibrium indicate that SNPs within a gene are organized in block pattern, and a high degree of linkage disequilibrium exists within blocks and very little linkage disequilibrium exists between blocks. Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed (Schaid et al, *Am. J. Hum. Genet.*, 70, 425-434, 2002) that score tests can be done on haplotypes using the program "haplo.score". In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the p-value of the tests reaches that level. In an exploratory analysis where positive hits will be followed up in subsequent confirmatory testing, an unadjusted p-value <0.2 (a significance level on the lenient side), for example, may be used for generating hypotheses for significant association of a SNP with certain phenotypic characteristics of a disease. It is preferred that a p-value <0.05 (a significance level traditionally used in the art) is achieved in order for a SNP to be considered to have an association with a disease. It is more preferred that a p-value <0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wise error rates at 0.05. While there are different methods to adjust for multiple testing to control for different kinds of error rates, a commonly used but rather conservative method is Bonferroni correction to control the experiment-wise or family-wise error rate (*Multiple comparisons and multiple tests*, Westfall et al, SAS Institute (1999)). Permutation tests to control for the false discovery rates, FDR, can be more powerful (Benjamini and Hochberg, Journal of the Royal Statistical Society, Series B 57, 1289-1300, 1995, *Resampling-based Multiple Testing*, Westfall and Young, Wiley (1993)). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies (*Modern Epidemiology*, Lippincott Williams & Wilkins, 1998, 643-673). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies (Ewens and Spielman, *Am. J. Hum. Genet.* 62, 450-458, 1995) when prevalence of the disease is associated with different subpopulation groups. Such bias can also lead to a loss of statistical power in genetic association studies. To detect population stratification, Pritchard and Rosenberg (Pritchard et al. *Am. J. Hum. Gen.* 1999, 65:220-228) suggested typing markers that are unlinked to the disease and using results of association tests on those markers to determine whether there is any population stratification. When stratification is detected, the genomic control (GC) method as proposed by Devlin and Roeder (Devlin et al. *Biometrics* 1999, 55:997-1004) can be used to adjust for the inflation of test statistics due to population stratification. GC method is robust to changes in population structure levels as well as being applicable to DNA pooling designs (Devlin et al. *Genet. Epidem.* 20001, 21:273-284).

While Pritchard's method recommended using 15-20 unlinked microsatellite markers, it suggested using more than 30 biallelic markers to get enough power to detect population stratification. For the GC method, it has been shown (Bacanu et al. *Am. J. Hum. Genet.* 2000, 66:1933-1944) that about 60-70 biallelic markers are sufficient to estimate the inflation factor for the test statistics due to population stratification. Hence, 70 intergenic SNPs can be chosen in unlinked regions as indicated in a genome scan (Kehoe et al. *Hum. Mol. Genet.* 1999, 8:237-245).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks (*Applied Regression Analysis*, Draper and Smith, Wiley (1998)). Moreover, other techniques can also be used for setting up classification. Such techniques include, but are not limited to, MART, CART, neural network, and discriminant analyses that are suitable for use in comparing the performance of different methods (The Elements of Statistical Learning, Hastie, Tibshirani & Friedman, Springer (2002)).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the susceptibility allele(s).

The SNPs of the invention may contribute to stroke and related pathologies in an individual in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose", "diagnosis", and "diagnostics" include, but are not limited to any of the following: detection of a vascular disease that an individual may presently have, predisposition/susceptibility screening (i.e., determining an individual's risk of having a stroke, such as whether an individual has an increased or decreased risk of having a stroke in the future), determining a particular type or subclass of vascular disease or stroke in an individual who has a vascular disease or who has had a stroke, confirming or reinforcing a previously made diagnosis of stroke or vascular disease, pharmacogenomic evaluation of an individual to determine which therapeutic or preventive agent or strategy that individual is most likely to benefit from or to predict whether a patient is likely to benefit from a particular therapeutic or preventive agent or strategy, predicting whether a patient is likely to experience toxic or other undesirable side effects from a particular therapeutic or preventive agent or strategy, evaluating the future prognosis of an individual who has had a stroke or who has a vascular disease, and determining the risk that an individual who has already had a stroke will have one or more strokes again in the future (i.e., re-occurring strokes). Such diagnostic uses may be based on the SNPs individually or in combination or SNP haplotypes of the present invention.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium". In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for determining predisposition to stroke and related pathologies (e.g., has a significant statistical association with the condition and/or is recognized as a causative polymorphism for the condition), then the skilled artisan would recognize that other SNP sites which are in LD with this SNP site would also be useful for diagnosing the condition. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., stroke) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include, for example, other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Table 4, for example.

Linkage disequilibrium in the human genome is reviewed in the following references: Wall et al., "Haplotype blocks and linkage disequilibrium in the human genome,", *Nat Rev Genet.* 2003 August; 4(8):587-97 (August 2003); Garner et al. et al., "On selecting markers for association studies: patterns of linkage disequilibrium between two and three diallelic loci,", *Genet Epidemiol.* 2003 January; 24(1):57-67 (January 2003); Ardlie et al. et al., "Patterns of linkage disequilibrium in the human genome,", *Nat Rev Genet.* 2002 April; 3(4):299-309 (April 2002); (erratum in *Nat Rev Genet* 2002 July; 3(7):566 (July 2002); and Remm et al. et al., "High-density genotyping and linkage disequilibrium in the human genome using chromosome 22 as a model,"; *Curr Opin Chem Biol.* 2002 February; 6(1):24-30 (February 2002); J. B. S. Haldane, "JBS (1919) The combination of linkage values, and the calculation of distances between the loci of linked factors,". *J Genet* 8:299-309 (1919); G. Mendel, G. (1866) *Versuche über Pflanzen-Hybriden. Verhandlungen des naturforschenden Vereines in Brünn* [(*Proceedings of the Natural History Society of Brünn*)] (1866); Lewin B (1990) *Genes IV*, B. Lewin, ed., Oxford University Press, New York, N.Y. USA (1990); D. L. Hartl D L and A. G. Clark A G (1989) *Principles of Population Genetics* 2$^{nd}$ ed., Sinauer Associates, Inc., Ma Sunderland, Mass., USA (1989); J. H. Gillespie J H (2004) *Population Genetics: A Concise Guide.* 2$^{nd}$ ed., Johns Hopkins University Press. (2004) USA; R. C. Lewontin, "RC (1964) The interaction of selection and linkage. I. General considerations; heterotic models,". *Genetics* 49:49-67 (1964); P. G. Hoel, P G (1954) *Introduction to Mathematical Statistics* 2$^{nd}$ ed., John Wiley & Sons, Inc., N.Y. New York, USA (1954); R. R. Hudson, R R "(2001) Two-locus sampling distributions and their application,". *Genetics* 159:1805-1817 (2001); A. P. Dempster A P, N. M. Laird, D. B. N M, Rubin, "DB (1977) Maximum likelihood from incomplete data via the EM algorithm,". *J R Stat Soc* 39:1-48 (1977); L. Excoffier L, M. Slatkin, M "(1995) Maximum-likelihood estimation of molecular haplotype frequencies in a diploid population,". *Mol Biol Evol* 12(5):921-927 (1995); D. A. Tregouet DA, S. Escolano S, L. Tiret L, A. Mallet A, J. L. Golmard, J L "(2004) A new algorithm for haplotype-based association analysis: the Stochastic-EM algorithm,". *Ann Hum Genet* 68(Pt 2):165-177 (2004); A. D. Long A D and C. H. Langley C H, "(1999) The power of association studies to detect the contribution of candidate genetic loci to variation in complex traits,". *Genome Research* 9:720-731 (1999); A. Agresti, A (1990) *Categorical Data Analysis.*, John Wiley & Sons, Inc., N.Y. New York, USA (1990); K. Lange, K (1997) *Mathematical and Statistical Methods for Genetic Analysis*, Springer-Verlag New York, Inc., N.Y. New York, USA (1997); The International HapMap Consortium, "(2003) The International HapMap Project,". *Nature* 426:789-796 (2003); The International HapMap Consortium, "(2005) A haplotype map of the human genome,". *Nature* 437:1299-1320 (2005); G. A. Thorisson G A, A. V. Smith A V, L. Krishnan L, L. D. Stein LD (2005), "The International HapMap Project Web Site,". *Genome Research* 15:1591-1593 (2005); G. McVean, C. C. A. G, Spencer C C A, R. Chaix R (2005), "Perspectives on human genetic variation from the HapMap project,". *PLoS Genetics* 1(4):413-418 (2005); J. N. Hirschhorn J N, M. J. Daly, M J "(2005) Genome-wide association studies for common diseases and complex traits,". *Nat Genet* 6:95-108 (2005); S. J. Schrodi, "S J (2005) A probabilistic approach to large-scale association scans: a semi-Bayesian method to detect disease-predisposing alleles,". *SAGMB* 4(1):31 (2005); W. Y. S. Wang W Y S, B. J. Barratt B J, D. G. Clayton D G, J. A. Todd, "J A (2005) Genome-wide association studies: theoretical and practical concerns,". *Nat Rev Genet* 6:109-118 (2005); J. K. Pritchard J K, M. Przeworski, "M (2001) Linkage disequilibrium in humans: models and data,". *Am J Hum Genet* 69:1-14 (2001).

As discussed above, one aspect of the present invention is the discovery that SNPs which are in certain LD distance with the interrogated SNP can also be used as valid markers for identifying an increased or decreased risks of having or developing stroke. As used herein, the term "interrogated SNP" refers to SNPs that have been found to be associated with an increased or decreased risk of disease using genotyping results and analysis, or other appropriate experimental method as exemplified in the working examples described in this application. As used herein, the term "LD SNP" refers to a SNP that has been characterized as a SNP associating with an increased or decreased risk of diseases due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B_1$ on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1$, $A_1B_2$, $A_2B_1$ and $A_2B_2$. Denote the frequencies of these four haplotypes with the following notation.

$$P_{11}=\text{freq}(A_1B_1) \qquad (1)$$

$$P_{12}=\text{freq}(A_1B_2) \qquad (2)$$

$$P_{21}=\text{freq}(A_2B_1) \qquad (3)$$

$$P_{22}=\text{freq}(A_2B_2) \qquad (4)$$

The allele frequencies at the two markers are then the sum of different haplotype frequencies, it is straightforward to write down a similar set of equations relating single-marker allele frequencies to two-marker haplotype frequencies:

$$p_1=\text{freq}(A_1)=P_{11}+P_{12} \qquad (5)$$

$$p_2=\text{freq}(A_2)=P_{21}+P_{22} \qquad (6)$$

$$q_1=\text{freq}(B_1)=P_{11}+P_{21} \qquad (7)$$

$$q_2=\text{freq}(B_2)=P_{12}+P_{22} \qquad (8)$$

Note that the four haplotype frequencies and the allele frequencies at each marker must sum to a frequency of 1.

$$P_{11}+P_{12}+P_{21}+P_{22}=1 \qquad (9)$$

$$p_1+p_2=1 \qquad (10)$$

$$q_1+q_2=1 \qquad (11)$$

If there is no correlation between the alleles at the two markers, one would expect that the frequency of the haplotypes would be approximately the product of the composite alleles. Therefore, $$P_{11} \approx p_1 q_1 \qquad (12)$$

$$P_{12} \approx p_1 q_2 \qquad (13)$$

$$P_{21} \approx p_2 q_1 \qquad (14)$$

$$P_{22} \approx p_2 q_2 \qquad (15)$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D=P_{11}-p_1q_1 \qquad (16)$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D=P_{11}P_{22}-P_{12}P_{21} \qquad (17)$$

If one transforms D by squaring it and subsequently dividing by the product of the allele frequencies of $A_1, A_2, B_1$ and $B_2$, the resulting quantity, called $r^2$, is equivalent to the square of the Pearson's correlation coefficient commonly used in statistics (e.g. Hoel, 1954).

$$r^2 = \frac{D^2}{p_1 p_2 q_1 q_2} \qquad (18)$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs}=\text{freq}(A_1 \text{ in cases}) \qquad (19)$$

$$p_{2,cs}=\text{freq}(A_2 \text{ in cases}) \qquad (20)$$

$$q_{1,cs}=\text{freq}(B_1 \text{ in cases}) \qquad (21)$$

$$q_{2,cs}=\text{freq}(B_2 \text{ in cases}) \qquad (22)$$

Similarly, $$p_{1,ct}=\text{freq}(A_1 \text{ in controls}) \qquad (23)$$

$$p_{2,ct}=\text{freq}(A_2 \text{ in controls}) \qquad (24)$$

$$q_{1,ct}=\text{freq}(B_1 \text{ in controls}) \qquad (25)$$

$$q_{2,ct}=\text{freq}(B_2 \text{ in controls}) \qquad (26)$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1/A_2B_2$ or $A_1B_2/A_2B_1$. One such algorithm to estimate haplotype frequencies is the expectation-maximization (EM) algorithm first formalized by Dempster et al. (1977). This algorithm is often used in genetics to infer haplotype frequencies from genotype data (e.g., Excoffier and Slatkin (1995); Tregouet et al., (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2$ N samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs} + N_{ct}}; \quad (27)$$

where $N_{cs}$ and $N_{ct}$ are the numbers of diploid cases and controls, respectively. This is necessary to handle situations where the numbers of cases and controls are not equivalent. For equal case and control sample sizes, $N_{cs}=N_{ct}=N$, the value of the effective number of chromosomes is simply n=2N—as expected. Let power be calculated for a significance level $\alpha$ (such that traditional P-values below $\alpha$ will be deemed statistically significant). Define the standard Gaussian distribution function as $\Phi(\cdot)$. Mathematically, $$\Phi(x) = \frac{1}{\sqrt{2\pi}} \int_{-\infty}^{x} e^{-\frac{\theta^2}{2}} d\theta \quad (28)$$

Alternatively, the following error function notation (Erf) may also be used, $$\Phi(x) = \frac{1}{2}\left[1 + Erf\left(\frac{x}{\sqrt{2}}\right)\right] \quad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by $\beta$ the error rate for not detecting truly disease-associated markers. Therefore, $1-\beta$ is the classical definition of statistical power. Substituting the Pritchard-Pzreworski result into the sample size, the power to detect disease association at a significance level of $\alpha$ is given by the approximation $$1 - \beta \cong \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right]; \quad (30)$$

where $Z_u$ is the inverse of the standard normal cumulative distribution evaluated at u ($u \in (0,1)$). $Z_u = \Phi^{-1}(u)$, where $\Phi(\Phi^{-1}(u)) = \Phi^{-1}(\Phi(u)) = u$. For example, setting $\alpha=0.05$, and therefore $1-\alpha/2=0.975$, $Z_{0.975}=1.95996$ is obtained. Next, setting power equal to a threshold of a minimum power of T, $$T = \Phi\left[\frac{|q_{1,cs} - q_{1,ct}|}{\sqrt{\frac{q_{1,cs}(1-q_{1,cs}) + q_{1,ct}(1-q_{1,ct})}{r^2 n}}} - Z_{1-\alpha/2}\right] \quad (31)$$

and solving for $r^2$, the following threshold $r^2$ is obtained:

$$r_T^2 = \frac{[q_{1,cs}(1-q_{1,cs}) + q_{1,ct}(1-q_{1,ct})]}{n(q_{1,cs} - q_{1,ct})^2}[\Phi^{-1}(T) + Z_{1-\alpha/2}]^2 \quad (32)$$

Or, $$r_T^2 = \frac{(Z_T + Z_{1-\alpha/2})^2}{n}\left[\frac{q_{1,cs} - (q_{1,cs})^2 + q_{1,ct} - (q_{1,ct})^2}{(q_{1,cs} - q_{1,ct})^2}\right] \quad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r_T^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

The contribution or association of particular SNPs and/or SNP haplotypes with disease phenotypes, such as stroke, enables the SNPs of the present invention to be used to develop superior diagnostic tests capable of identifying individuals who express a detectable trait, such as stroke, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with stroke might indicate a probability of 20% that an individual is at risk of having a stroke, whereas detection of five SNPs, each of which correlates with stroke, might indicate a probability of 80% that an individual is at risk of having a stroke. To further increase the accuracy of diagnosis or predisposition screening, analysis of the SNPs of the present invention can be combined with that of other polymorphisms or other risk factors of stroke, such as disease symptoms, pathological characteristics, family history, diet, environmental factors or lifestyle factors.

It will, of course, be understood by practitioners skilled in the treatment, prevention, or diagnosis of stroke that the present invention generally does not intend to provide an absolute identification of individuals who are at risk (or less at risk) of having a stroke, and/or pathologies related to stroke such as other vascular diseases, but rather to indicate a certain increased (or decreased) degree or likelihood of developing the disease (e.g., having a stroke) based on statistically significant association results. However, this information is extremely valuable as it can be used to, for example, initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or a SNP pattern associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to stroke.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Pharmacogenomics and Therapeutics/Drug Development

The present invention provides methods for assessing the pharmacogenomics of a subject harboring particular SNP alleles or haplotypes or diplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin. Exp. Pharmacol. Physiol.* 23(10-11):983-985 (1996); and Linder,

*Clin. Chem.* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating stroke. Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus, pharmacogenomics based on the SNPs disclosed herein has the potential to both save lives and reduce healthcare costs substantially.

It is also well known in the art that markers that are diagnostically useful in distinguishing patients at higher risk of developing a disease (such as stroke) from those who are at a decreased risk of developing the disease can be useful in identifying those patients who are more likely to respond to drug treatments targeting those pathways involving genes where the diagnostic SNPs reside. See references Gerdes, et al., *Circulation,* 2000; 101:1366-1371, Kuivenhoven, et al., *N Engl J Med* 1998; 338:86-93, Stolarz, et al., *Hypertension* 2004; 44:156-162, Chartier-Harlin, et al., *Hum. Mol. Genet.* 1994 April; 3(4):569-74, Roses, et al., *The Pharmacogenomics Journal* 2006, 1-19.

In that regard, embodiments of the present invention can be very useful in assisting clinicians to select individuals who are more likely to have a stroke and who are therefore good candidates for receiving therapy for the prevention or treatment of stroke, thus warranting administration of the above-mentioned drug treatments to such individuals. On the other hand, individuals who are deemed to have a low risk of having a stroke, using SNP markers discovered herein, can be spared the aggravation and wastefulness of the drug treatment due to the reduced benefit of such treatment in view of its cost and potential side effects.

Pharmacogenomics in general is discussed further in Rose et al., "Pharmacogenetic analysis of clinically relevant genetic polymorphisms", *Methods Mol Med.* 2003; 85:225-37. Pharmacogenomics as it relates to Alzheimer's disease and other neurodegenerative disorders is discussed in Cacabelos, "Pharmacogenomics for the treatment of dementia", *Ann Med.* 2002; 34(5):357-79, Maimone et al., "Pharmacogenomics of neurodegenerative diseases", *Eur J Pharmacol.* 2001 Feb. 9; 413(1):11-29, and Poirier, "Apolipoprotein E: a pharmacogenetic target for the treatment of Alzheimer's disease", *Mol Diagn.* 1999 December; 4(4):335-41. Pharmacogenomics as it relates to cardiovascular disorders is discussed in Siest et al., "Pharmacogenomics of drugs affecting the cardiovascular system", *Clin Chem Lab Med.* 2003 April; 41(4):590-9, Mukherjee et al., "Pharmacogenomics in cardiovascular diseases", *Prog Cardiovasc Dis.* 2002 May-June; 44(6):479-98, and Mooser et al., "Cardiovascular pharmacogenetics in the SNP era", *J Thromb Haemost.* 2003 July; 1(7):1398-402. Pharmacogenomics as it relates to cancer is discussed in McLeod et al., "Cancer pharmacogenomics: SNPs, chips, and the individual patient", *Cancer Invest.* 2003; 21(4):630-40 and Watters et al., "Cancer pharmacogenomics: current and future applications", *Biochim Biophys Acta.* 2003 Mar. 17; 1603(2):99-111.

The SNPs of the present invention also can be used to identify novel therapeutic targets for stroke. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke (ed.), Marcel Dekker, Inc.: New York (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates (see, e.g., Thompson, *Drug Discovery Today*, 7 (17): 912-917 (2002)). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation", *Curr Opin Drug Discov Devel.* 2003 July; 6(4):561-9; Stephens et al., "Antisense oligonucleotide therapy in cancer", *Curr Opin Mol Ther.* 2003 April; 5(2): 118-22; Kurreck, "Antisense technologies. Improvement through novel chemical modifications", *Eur J Biochem.* 2003 April; 270(8):1628-44; Dias et al., "Antisense oligonucleotides: basic concepts and mechanisms", *Mol Cancer Ther.* 2002 March; 1(5):347-55; Chen, "Clinical development of antisense oligonucleotides as anti-cancer therapeutics", Methods *Mol Med.* 2003; 75:621-46; Wang et al., "Antisense anticancer oligonucleotide therapeutics", *Curr Cancer Drug Targets.* 2001 November; 1(3):177-96; and Bennett, "Efficiency of antisense oligonucleotide drug discovery", *Antisense Nucleic Acid Drug Dev.* 2002 June; 12(3):215-24.

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as stroke, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs (Thompson, *Drug Discovery Today,* 7 (17): 912-917 (2002)). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference", *Nat Biotechnol.* 2004 March; 22(3):326-30. Epub 2004 Feb. 1; Chi et al., "Genomewide view of gene silencing by small interfering RNAs", *PNAS* 100(11):6343-6346, 2003; Vickers et al., "Efficient Reduction of Target RNAs by Small Interfering RNA and RNase H-dependent Antisense Agents", *J. Biol. Chem.* 278: 7108-7118, 2003; Agami, "RNAi and related mechanisms and their potential use for therapy", *Curr Opin Chem Biol.* 2002 December; 6(6):829-34; Lavery et al., "Antisense and RNAi: powerful tools in drug target discovery and validation", *Curr Opin Drug Discov Devel.* 2003 July; 6(4):561-9; Shi, "Mammalian RNAi for the masses", *Trends Genet* 2003 January; 19(1):9-12), Shuey et al., "RNAi: gene-silencing in therapeutic intervention", *Drug Discovery Today* 2002 October; 7(20):1040-1046; McManus et al., *Nat Rev Genet* 2002 October; 3(10):737-47; Xia et al., *Nat Biotechnol* 2002 October; 20(10):1006-10; Plasterk et al., *Curr Opin Genet Dev* 2000 October; 10(5):562-7; Bosher et al., *Nat Cell Biol* 2000 February; 2(2):E31-6; and Hunter, *Curr Biol* 1999 Jun. 17; 9(12):R440-2).

A subject suffering from a pathological condition, such as stroke, ascribed to a SNP may be treated so as to correct the genetic defect (see Kren et al., *Proc. Natl. Acad. Sci. USA* 96:10349-10354 (1999)). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

The invention further provides a method for identifying a compound or agent that can be used to treat or prevent stroke. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a stroke patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as stroke that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

The SNP-containing nucleic acid molecules of the present invention are also useful for monitoring the effectiveness of modulating compounds on the expression or activity of a variant gene, or encoded product, in clinical trials or in a treatment regimen. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

In another aspect of the present invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to humans diagnostically tested for one or more SNPs or SNP haplotypes provided by the present invention.

The SNPs/haplotypes of the present invention are also useful for improving many different aspects of the drug development process. For instance, an aspect of the present invention includes selecting individuals for clinical trials based on their SNP genotype. For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Furthermore, the SNPs of the present invention may explain why certain previously developed drugs performed poorly in clinical trials and may help identify a subset of the population that would benefit from a drug that had previously performed poorly in clinical trials, thereby "rescuing" previously developed drugs, and enabling the drug to be made available to a particular stroke patient population that can benefit from it.

SNPs have many important uses in drug discovery, screening, and development. A high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. (Jazwinska, *A Trends Guide to Genetic Variation and Genomic Medicine,* 2002 March; S30-S36).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants (Rothberg, *Nat Biotechnol* 2001 March; 19(3):209-11). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population (Jazwinska, *A Trends Guide to Genetic Variation and Genomic Medicine,* 2002 March; S30-S36).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1-2, are useful in conjunction with a variety of toxicology methods established in the art, such as those set forth in *Current Protocols in Toxicology,* John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1-2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

Pharmaceutical Compositions and Administration Thereof

Any of the stroke-associated proteins, and encoding nucleic acid molecules, disclosed herein can be used as therapeutic targets (or directly used themselves as therapeutic compounds) for treating or preventing stroke and related pathologies, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70 kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in Remington's Pharmaceutical Sciences, edited by E. W. Martin (Mack Publishing Company, $18^{th}$ ed., 1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80 wt %.

Therapeutic compounds can be administered alone or in combination with other therapeutic compounds or in combination with one or more other active ingredient(s). For example, an inhibitor or stimulator of a stroke-associated protein can be administered in combination with another agent that inhibits or stimulates the activity of the same or a different stroke-associated protein to thereby counteract the affects of stroke.

For further information regarding pharmacology, see *Current Protocols in Pharmacology*, John Wiley & Sons, Inc., N.Y.

Human Identification Applications

In addition to their diagnostic, risk assessment, preventive, and therapeutic uses in stroke and related pathologies, the SNPs provided by the present invention are also useful as human identification markers for such applications as forensics, paternity testing, and biometrics (see, e.g., Gill, "An assessment of the utility of single nucleotide polymorphisms (SNPs) for forensic purposes", *Int J Legal Med.* 2001; 114(4-5):204-10). Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked (i.e., inherited independently). Thus, preferred sets of SNPs can be selected from among the SNPs disclosed herein, which may include SNPs on different chromosomes, SNPs on different chromosome arms, and/or SNPs that are dispersed over substantial distances along the same chromosome arm.

Furthermore, among the SNPs disclosed herein, preferred SNPs for use in certain forensic/human identification applications include SNPs located at degenerate codon positions (i.e., the third position in certain codons which can be one of two or more alternative nucleotides and still encode the same amino acid), since these SNPs do not affect the encoded protein. SNPs that do not affect the encoded protein are expected to be under less selective pressure and are therefore expected to be more polymorphic in a population, which is typically an advantage for forensic/human identification applications. However, for certain forensics/human identification applications, such as predicting phenotypic characteristics (e.g., inferring ancestry or inferring one or more physical characteristics of an individual) from a DNA sample, it may be desirable to utilize SNPs that affect the encoded protein.

For many of the SNPs disclosed in Tables 1-2 (which are identified as "Applera" SNP source), Tables 1-2 provide SNP allele frequencies obtained by re-sequencing the DNA of chromosomes from 39 individuals (Tables 1-2 also provide allele frequency information for "Celera" source SNPs and, where available, public SNPs from dbEST, HGBASE, and/or HGMD). The allele frequencies provided in Tables 1-2 enable these SNPs to be readily used for human identification applications. Although any SNP disclosed in Table 1 and/or Table 2 could be used for human identification, the closer that the frequency of the minor allele at a particular SNP site is to 50%, the greater the ability of that SNP to discriminate between different individuals in a population since it becomes increasingly likely that two randomly selected individuals would have different alleles at that SNP site. Using the SNP allele frequencies provided in Tables 1-2, one of ordinary skill in the art could readily select a subset of SNPs for which the frequency of the minor allele is, for example, at least 1%, 2%, 5%, 10%, 20%, 25%, 30%, 40%, 45%, or 50%, or any other frequency in-between. Thus, since Tables 1-2 provide allele frequencies based on the re-sequencing of the chromosomes from 39 individuals, a subset of SNPs could readily be selected for human identification in which the total allele count of the minor allele at a particular SNP site is, for example, at least 1, 2, 4, 8, 10, 16, 20, 24, 30, 32, 36, 38, 39, 40, or any other number in-between.

Furthermore, Tables 1-2 also provide population group (interchangeably referred to herein as ethnic or racial groups) information coupled with the extensive allele frequency information. For example, the group of 39 individuals whose DNA was re-sequenced was made-up of 20 Caucasians and 19 African-Americans. This population group information enables further refinement of SNP selection for human identification. For example, preferred SNPs for human identification can be selected from Tables 1-2 that have similar allele frequencies in both the Caucasian and African-American populations; thus, for example, SNPs can be selected that have equally high discriminatory power in both populations. Alternatively, SNPs can be selected for which there is a statistically significant difference in allele frequencies between the Caucasian and African-American populations (as an extreme example, a particular allele may be observed only in either the Caucasian or the African-American population group but not observed in the other population group); such SNPs are useful, for example, for predicting the race/ethnicity of an unknown perpetrator from a biological sample such as a hair or blood stain recovered at a crime scene. For a discussion of using SNPs to predict ancestry from a DNA sample, including statistical methods, see Frudakis et al., "A Classifier for the SNP-Based Inference of Ancestry", *Journal of Forensic Sciences* 2003; 48(4):771-782.

SNPs have numerous advantages over other types of polymorphic markers, such as short tandem repeats (STRs). For example, SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artefacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. A SNP, on the other hand, comprises a single nucleotide, and generally a short conserved region on either side of the SNP position for primer and/or probe binding. This makes SNPs more amenable to typing in highly degraded or aged biological samples that are frequently encountered in forensic casework in which DNA may be fragmented into short pieces.

SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units than has been previously seen in the population, or more or less repeat alleles than are included in a reference allelic ladder. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis.

SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, and therefore the statistical significance of a matching genotype may be questionable. All these advantages of SNP analysis are considerable in light of the consequences of most DNA identification cases, which may lead to life imprisonment for an individual, or re-association of remains to the family of a deceased individual.

DNA can be isolated from biological samples such as blood, bone, hair, saliva, or semen, and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs known in the art or STRs, in order to identify an individual or to associate an individual with a particular biological sample.

Furthermore, the SNPs provided by the present invention can be genotyped for inclusion in a database of DNA genotypes, for example, a criminal DNA databank such as the FBI's Combined DNA Index System (CODIS) database. A genotype obtained from a biological sample of unknown source can then be queried against the database to find a matching genotype, with the SNPs of the present invention providing nucleotide positions at which to compare the known and unknown DNA sequences for identity. Accordingly, the present invention provides a database comprising novel SNPs or SNP alleles of the present invention (e.g., the database can comprise information indicating which alleles are possessed by individual members of a population at one or more novel SNP sites of the present invention), such as for use in forensics, biometrics, or other human identification applications. Such a database typically comprises a computer-based system in which the SNPs or SNP alleles of the present invention are recorded on a computer readable medium (see the section of the present specification entitled "Computer-Related Embodiments").

The SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child, with the SNPs of the present invention providing nucleotide positions at which to compare the putative father's and child's DNA sequences for identity. If the set of polymorphisms in the child attributable to the father does not match the set of polymorphisms of the putative father, it can be concluded, barring experimental error, that the putative father is not the father of the child. If the set of polymorphisms in the child attributable to the father match the set of polymorphisms of the putative father, a statistical calculation can be performed to determine the probability of coincidental match, and a conclusion drawn as to the likelihood that the putative father is the true biological father of the child.

In addition to paternity testing, SNPs are also useful for other types of kinship testing, such as for verifying familial relationships for immigration purposes, or for cases in which an individual alleges to be related to a deceased individual in order to claim an inheritance from the deceased individual, etc. For further information regarding the utility of SNPs for paternity testing and other types of kinship testing, including methods for statistical analysis, see Krawczak, "Informativity assessment for biallelic single nucleotide polymorphisms", *Electrophoresis* 1999 June; 20(8):1676-81.

The use of the SNPs of the present invention for human identification further extends to various authentication systems, commonly referred to as biometric systems, which typically convert physical characteristics of humans (or other organisms) into digital data. Biometric systems include various technological devices that measure such unique anatomical or physiological characteristics as finger, thumb, or palm prints; hand geometry; vein patterning on the back of the hand; blood vessel patterning of the retina and color and texture of the iris; facial characteristics; voice patterns; signature and typing dynamics; and DNA. Such physiological measurements can be used to verify identity and, for example, restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns (see, for example, O'Connor, *Stanford Technology Law Review* and U.S. Pat. No. 6,119,096).

Groups of SNPs, particularly the SNPs provided by the present invention, can be typed to uniquely identify an individual for biometric applications such as those described above. Such SNP typing can readily be accomplished using, for example, DNA chips/arrays. Preferably, a minimally invasive means for obtaining a DNA sample is utilized. For example, PCR amplification enables sufficient quantities of DNA for analysis to be obtained from buccal swabs or fingerprints, which contain DNA-containing skin cells and oils that are naturally transferred during contact. Further information regarding techniques for using SNPs in forensic/human identification applications can be found in, for example, *Current Protocols in Human Genetics*, John Wiley & Sons, N.Y. (2002), 14.1-14.7.

Variant Proteins, Antibodies, Vectors & Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are provided as SEQ ID NOS:81-160 in Table 1 and the Sequence Listing. These variants will generally be referred to herein as variant proteins/peptides/polypeptides, or polymorphic proteins/peptides/polypeptides of the present invention. The terms "protein", "peptide", and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below (Sambrook and Russell, 2000, Molecular Cloning: A Laboratory Manual, Cold Spring Harbor Laboratory Press, Cold Spring Harbor, N.Y.).

The present invention provides isolated variant proteins that comprise, consist of or consist essentially of amino acid sequences that contain one or more variant amino acids encoded by one or more codons which contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems", *Appl Microbiol Biotechnol*. 2003 January; 60(5):523-33. Epub 2002 Nov. 7; Graddis et al., "Designing proteins that work using recombinant technologies", *Curr Pharm Biotechnol*. 2002 December; 3(4):285-97; and Nilsson et al., "Affinity fusion strategies for detection, purification, and immobilization of recombinant proteins", *Protein Expr Purif*. 1997 October; 11(1):1-16.

The present invention also relates to further obvious variants of the variant polypeptides of the present invention, such as naturally-occurring mature forms (e.g., allelic variants), non-naturally occurring recombinantly-derived variants, and orthologs and paralogs of such proteins that share sequence homology. Such variants can readily be generated using art-known techniques in the fields of recombinant nucleic acid technology and protein biochemistry. It is understood, however, that variants exclude those known in the prior art before the present invention.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in, for example, Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis (Cunningham et al., *Science* 244:1081-1085 (1989)), particularly using the amino acid sequence and polymorphism information provided in Table 1. The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling (Smith et al., *J. Mol. Biol*. 224:899-904 (1992); de Vos et al. *Science* 255:306-312 (1992)).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as *Proteins—Structure and Molecular Properties,* 2nd Ed., T. E. Creighton, W. H. Freeman and Company, New York (1993); Wold, F., *Posttranslational Covalent Modification of Proteins*, B. C. Johnson, Ed., Academic Press, New York 1-12 (1983); Seifter et al., *Meth. Enzymol.* 182: 626-646 (1990); and Rattan et al., *Ann. N. Y. Acad. Sci.* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis) (*Current Protocols in Protein Science*, John Wiley & Sons, N.Y. (2002)).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art (see, e.g., Molecular Cloning: A Laboratory Manual, Cold Spring Harbor Laboratory Press, Sambrook and Russell, 2000, and Methods in Enzymology: Guide to Molecular Cloning Techniques, Academic Press, Berger, S. L. and A. R. Kimmel eds., 1987).

In a specific embodiment of the invention, the methods of the present invention include detection of one or more variant proteins disclosed herein. Variant proteins are disclosed in Table 1 and in the Sequence Listing as SEQ ID NOS:81-160. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another specific aspect of the invention, the variant proteins of the present invention are used as targets for diagnosing stroke or for determining predisposition to stroke in a human (e.g., determining whether an individual has an increased or decreased risk of having a stroke). Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with stroke that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays", *Anal Chem.* 1999 Jun. 15; 71(12): 294R-304R.

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or norepinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., *Nature* 354:82-84 (1991); Houghten et al., *Nature* 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., *Cell* 72:767-778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an endpoint assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein (Hodgson, *Bio/technology*, 1992, September 10(9), 973-80).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as stroke. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300) to identify other proteins that bind to or interact with the variant protein and are involved in variant protein activity. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc. Natl. Acad. Sci. USA*, 81:6851, 1984; Neuberger et al., *Nature* 312:604, 1984), a humanized antibody (U.S. Pat. Nos. 5,693,762; 5,585,089; and 5,565,332), a single-chain Fv (U.S. Pat. No. 4,946,778; Ward et al., *Nature* 334:544, 1989), a bispecific antibody with two binding specificities (Segal et al., *J. Immunol. Methods* 248:1, 2001; Carter, *J. Immunol. Methods* 248:7, 2001), a diabody, a triabody, and a tetrabody (Todorovska et al., *J. Immunol. Methods,* 248:47, 2001), as well as a Fab conjugate (dimer or trimer), and a minibody.

Many methods are known in the art for generating and/or identifying antibodies to a given target antigen (Harlow, Antibodies, Cold Spring Harbor Press, (1989)). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology (Kohler and Milstein, *Nature,* 256:495, 1975), which immortalizes cells secreting a specific monoclonal antibody. The immortalized cell lines can be created in vitro by fusing two different cell types, typically lymphocytes, and tumor cells. The hybridoma cells may be cultivated in vitro or in vivo. Additionally, fully human antibodies can be generated by transgenic animals (He et al., *J. Immunol.,* 169:595, 2002). Fd phage and Fd phagemid technologies may be used to generate and select recombinant antibodies in vitro (Hoogenboom and Chames, *Immunol. Today* 21:371, 2000; Liu et al., *J. Mol. Biol.* 315:1063, 2002). The complementarity-determining regions of an antibody can be identified, and synthetic peptides corresponding to such regions may be used to mediate antigen binding (U.S. Pat. No. 5,637,677).

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and acquorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease", *Expert Rev Vaccines.* 2003 February; 2(1):53-9; Ross et al., "Anticancer antibodies", *Am J Clin Pathol.* 2003 April; 119(4):472-85; Goldenberg, "Advancing role of radiolabeled antibodies in the therapy of cancer", *Cancer Immunol Immunother.* 2003 May; 52(5):281-96. Epub 2003 Mar. 11; Ross et al., "Antibody-based therapeutics in oncology", *Expert Rev Anticancer Ther.* 2003 February; 3(1):107-21; Cao et al., "Bispecific antibody conjugates in therapeutics", *Adv Drug Deliv Rev.* 2003 Feb. 10; 55(2):171-97; von Mehren et al., "Monoclonal antibody therapy for cancer", *Annu Rev Med.* 2003; 54:343-69. Epub 2001 Dec. 3; Hudson et al., "Engineered antibodies", *Nat Med.* 2003 January; 9(1):129-34; Brekke et al., "Therapeutic antibodies for human diseases at the dawn of the twenty-first century", *Nat Rev Drug Discov.* 2003 January; 2(1):52-62 (Erratum in: *Nat Rev Drug Discov.* 2003 March; 2(3):240); Houdebine, "Antibody manufacture in transgenic animals and comparisons with other systems", *Curr Opin Biotech-* nol. 2002 December; 13(6):625-9; Andreakos et al., "Monoclonal antibodies in immune and inflammatory diseases", *Curr Opin Biotechnol.* 2002 December; 13(6):615-20; Kellermann et al., "Antibody discovery: the use of transgenic mice to generate human monoclonal antibodies for therapeutics", *Curr Opin Biotechnol.* 2002 December; 13(6):593-7; Pini et al., "Phage display and colony filter screening for high-throughput selection of antibody libraries", *Comb Chem High Throughput Screen.* 2002 November; 5(7):503-10; Batra et al., "Pharmacokinetics and biodistribution of genetically engineered antibodies", *Curr Opin Biotechnol.* 2002 December; 13(6):603-8; and Tangri et al., "Rationally engineered proteins or antibodies with absent or reduced immunogenicity", *Curr Med Chem.* 2002 December; 9(24):2191-9.

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as stroke. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, particularly stroke. Antibodies specific for a variant protein encoded by a SNP-containing nucleic acid molecule of the present invention can be used to assay for the presence of the variant protein, such as to screen for predisposition to stroke as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol (Leong et al., *Cytokine* 16:106, 2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors (see, e.g., Sambrook and Russell, 2000, Molecular Cloning: A Laboratory Manual, Cold Spring Harbor Laboratory Press, Cold Spring Harbor, N.Y.).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papoviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, 2000, Molecular Cloning: A Laboratory Manual, Cold Spring Harbor Laboratory Press, Cold Spring Harbor, N.Y.

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *E. coli*, *Streptomyces*, and *Salmonella typhimurium*. Eukaryotic host cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-415 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (Gottesman, S., *Gene Expression Technology: Methods in Enzymology* 185, Academic Press, San Diego, Calif. (1990) 119-128). Alternatively, the sequence of the SNP-containing nucleic acid molecule of interest can be altered to provide preferential codon usage for a specific host cell, for example, *E. coli* (Wada et al., *Nucleic Acids Res.* 20:2111-2118 (1992)).

The SNP-containing nucleic acid molecules can also be expressed by expression vectors that are operative in yeast. Examples of vectors for expression in yeast (e.g., *S. cerevisiae*) include pYepSec1 (Baldari, et al., *EMBO J.* 6:229-234 (1987)), pMFa (Kurjan et al., *Cell* 30:933-943(1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol. Cell Biol.* 3:2156-2165 (1983)) and the pVL series (Lucklow et al., *Virology* 170:31-49 (1989)).

In certain embodiments of the invention, the SNP-containing nucleic acid molecules described herein are expressed in mammalian cells using mammalian expression vectors. Examples of mammalian expression vectors include pCDM8 (Seed, B. *Nature* 329:840(1987)) and pMT2PC (Kaufman et al., *EMBO J.* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, 2000, Molecular Cloning: A Laboratory Manual, Cold Spring Harbor Laboratory, Cold Spring Harbor Laboratory Press, Cold Spring Harbor, N.Y.).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described in, for example, U.S. Pat. Nos. 4,736,866 and 4,870,009, both by Leder et al., U.S. Pat. No. 4,873,191 by Wagner et al., and in Hogan, B., *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1 (Lakso et al. *PNAS* 89:6232-6236 (1992)). Another example of a recombinase system is the FLP recombinase system of *S. cerevisiae* (O'Gorman et al. *Science* 251:1351-1355 (1991)). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described in, for example, Wilmut, I. et al. *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems", *Curr Opin Biotechnol.* 2002 December; 13(6):625-9; Petters et al., "Transgenic animals as models for human disease", *Transgenic Res.* 2000; 9(4-5):347-51; discussion 345-6; Wolf et al., "Use of transgenic animals in understanding molecular mechanisms of toxicity", *J Pharm Pharmacol.* 1998 June; 50(6):567-74; Echelard, "Recombinant protein production in transgenic animals", *Curr Opin Biotechnol.* 1996 October; 7(5):536-40; Houdebine, "Transgenic animal bioreactors", *Transgenic Res.* 2000; 9(4-5):305-20; Pirity et al., "Embryonic stem cells, creating transgenic animals", *Methods Cell Biol.* 1998; 57:279-93; and Robl et al., "Artificial chromosome vectors and expression of complex proteins in transgenic animals", *Theriogenology.* 2003 Jan. 1; 59 (1):107-13.

Examples

The following examples are offered to illustrate, but not to limit the claimed invention.

Example One: SNPs Associated with Stroke in the Atherosclerosis Risk in Communities (ARIC) Study Overview 51 SNPs associated with coronary heart disease (CHD) in multiple antecedent studies (Bare et al. 2007) were analyzed to determine whether these SNPs are associated with incident ischemic stroke in the Atherosclerosis Risk in Communities (ARIC) study. To carry out this analysis, 495 validated ischemic strokes were identified from the multi-ethnic ARIC cohort of 14,215 individuals by following the cohort for an average of 13.5 years for potential cerebrovascular events. Risk alleles for 51 SNPs were specified based on the results from at least two antecedent studies in which these SNPs were associated with CHD. As a result of this analysis, Cox proportional hazards models, adjusted for age and gender, identified three SNPs in whites/Caucasians (these terms are used herein interchangeably) and two SNPs in blacks/African Americans (these terms are used herein interchangeably) that were associated (p<0.05) with incident stroke and had the same risk allele as specified by the antecedent studies. The rs11628722 polymorphism in SERPINA9 was associated with incident ischemic stroke in both whites and blacks. Thus, genetic variation in SERPINA9 was associated with incident stroke in both whites and blacks, even after taking into account traditional risk factors.

Subjects and Methods

The Atherosclerosis Risk in Communities (ARIC) Study

Study participants were selected from the ARIC Study, a prospective investigation of atherosclerosis and its clinical sequelae involving 15,792 individuals aged 45-64 years at recruitment (1986-1989). Subjects were selected by probability sampling from four communities: Forsyth County, N.C.; Jackson, Miss. (blacks only); Northwestern suburbs of Minneapolis, Minn.; and Washington County, Md. The initial clinical exams included a home interview to ascertain cardiovascular risk factors, socioeconomic factors and family medical history, clinical examination and blood drawing for laboratory determinations. A detailed description of the ARIC study design and methods has been published elsewhere (ARIC Investigators (1989) "The Atherosclerosis Risk in Communities (ARIC) Study: design and objectives". *American Journal of Epidemiology* 129: 687-702).

Incident Ischemic Stroke

Ischemic stroke was determined by contacting participants annually to identify hospitalizations during the previous year, and by surveying discharge lists from local hospitals and death certificates from state vital statistics offices for potential cerebrovascular events (ARIC Investigators (1989) *American Journal of Epidemiology* 129: 687-702; Rosamond et al. (1999) *Stroke* 30: 736-743). Hospital records were obtained, abstracted and classified by computer algorithm and physician review. Details on quality assurance for ascertainment and classification of ischemic stroke events have been published elsewhere (Rosamond et al. (1999) *Stroke* 30: 736-743). Ischemic stroke events were defined as validated definite or probable hospitalized embolic or thrombotic brain infarctions. Participants were excluded from this analysis if they had a positive or unknown history of prevalent stroke; transient ischemic attack/stroke symptoms or CHD at the initial visit; ethnic background other than white or black; an ethnic background of black but were not from Jackson, Miss.; restrictions on use of their DNA; or missing data for any of the traditional cardiovascular or cerebrovascular risk factors. The remaining 14,215 participants were followed for incident ischemic stroke for a mean of 13.5 years and 495 incident ischemic stroke cases were identified.

Examination and Laboratory Measures

Cardiovascular risk factors considered in this study were measured at baseline and included age, gender, waist-to-hip ratio, diabetes, hypertension, and smoking status. The ratio of waist (umbilical level) and hip (maximum buttocks) circumference was calculated as a measure of fat distribution. Diabetes was defined by a fasting glucose level ≥126 mg/dl, a nonfasting glucose level ≥200 mg/dl, or a self-reported physician diagnosis of diabetes or use of diabetes medication. Seated blood pressure was measured three times with a random-zero sphygmomanometer and the last two measurements were averaged. An interviewer-administered questionnaire was used to assess use of antihypertensive medications. Hypertension was defined as systolic blood pressure ≥140 mmHg or diastolic blood pressure ≥90 mmHg or current use of antihypertensive medication. Cigarette smoking status was classified as current or not current. The study protocol was approved by the Institutional Review Boards of the collaborating institutions, and informed written consent was obtained from each participant.

SNP Selection and Genotype Determination

Fifty-one functional SNPs associated with CHD in multiple antecedent studies, other than the ARIC study, were considered in this study. A detailed description of the antecedent studies is presented elsewhere (Bare et al., *Genetics in Medicine*. 2007 October; 9(10):682-9). Briefly, risk alleles for 49 SNPs were specified based on significant association with myocardial infarction in at least two antecedent case-control studies. These studies involved myocardial infarction cases and controls recruited by either the Cleveland Clinic Foundation Heart Center, Cleveland, Ohio (CCF) or the Genomic Resource in Arteriosclerosis at the University of California, San Francisco (UCSF). All cases in these two studies had a history of myocardial infarction and the controls did not, and all subjects were self-described, non-Hispanic Caucasians. The risk alleles for two additional SNPs were specified based on an association with CHD in the placebo arms of two CHD prevention trials: the Cholesterol and Recurrent Events (CARE) study (Sacks et al. (1996) *New England Journal of Medicine* 335: 1001-1009) and the West of Scotland Coronary Prevention Study (WOSCOPS) (Packard et al. (2000) *New England Journal of Medicine* 343: 1148-1155). One of these SNPs (rs20455 in KIF6) was significantly associated with CHD after correction for multiple testing (Iakoubova et al., *Journal of the American College of Cardiology*. 2008; 51:435-43). The second SNP associated with CHD in CARE and WOSCOPS was rs11666735 in FCAR (Iakoubova et al. (2006) *Arteriosclerosis, Thrombosis and Vascular Biology* 26: 2763-2768).

Genotyping of the 51 SNPs in the ARIC study was carried out using PCR-based amplification of genomic DNA followed by an allele-specific oligonucleotide ligation assay similar to a previously described procedure (Iannone et al. (2000) *Cytometry* 39: 131-140).

Statistical Analyses

Agreement of genotype frequencies with Hardy-Weinberg equilibrium expectations was tested separately in whites and blacks using a $\chi^2$ goodness-of-fit test in non-cases, stratified by ethnicity. Deviation from Hardy-Weinberg equilibrium was determined by a p-value less than 0.05. Cox proportional hazards models were used to model time to incident ischemic stroke. The follow-up time interval was defined as the time between the initial clinical visit and the end of follow-up, which for cases was the date of the first ischemic stroke event and for non-cases was Dec. 31, 2002, the date of death, or the date of last contact if lost to follow-up. Each model was evaluated separately in whites and blacks and included a given SNP (modeled as the additive effect of the pre-specified risk allele), age and gender. Additional risk factors evaluated as potential confounders in the Cox proportional hazards models included waist-to-hip ratio, diabetes, hypertension, and smoking status (Folsom et al., (1999) *Diabetes Care* 22: 1077-1083). SNPs and risk factors were assessed for statistical significance in the models by the Wald statistic. A two-sided p-value of 0.05 was used to assess statistical significance with ischemic stroke and no attempt was made to adjust for multiple comparisons within this study.

Results

Race-specific proportions, means and standard deviations for the traditional risk factors are presented in Table 5. Mean values and proportions differed significantly (p<0.03) between incident ischemic stroke cases and non-cases for all risk factors.

Three SNPs in whites (in SERPINA9, PALLD and IER2) and two SNPs in blacks (in SERPINA9 and EXOD1) were associated (p≤0.05) with ischemic stroke, after adjusting for age and gender, and had the same risk allele as specified by the antecedent studies (Table 6, Model 1). One additional SNP in EIF2AK2 was associated with ischemic stroke in whites, but the risk allele in the ARIC study differed from the risk allele identified in the antecedent CHD studies. The rs11628722 polymorphism in SERPINA9 was associated with incident ischemic stroke in both ethnicities (whites HRR=1.31, 95% CI: 1.00-1.70; blacks HRR=1.26, 95% CI: 1.03-1.53).

For the four SNPs that were associated in either ethnic group, traditional cardiovascular risk factors were included in the Cox proportional hazards models to evaluate possible confounding. The observed hazards ratios were essentially unchanged with addition of these risk factors to the prediction models (Table 6, Model 2).

Discussion

This study investigated whether 51 putative functional SNPs associated with CHD in multiple antecedent studies predict ischemic stroke among white and black individuals from the large prospective ARIC study. Three SNPs in whites and two SNPs in blacks were associated with incident ischemic stroke, even after taking into account established risk factors. The rs11628722 polymorphism in SERPINA9 was associated with ischemic stroke in both whites and blacks from the ARIC study.

It is noteworthy that the association between SERPINA9 and stroke was observed in both whites and blacks in this study. This SNP has been associated with myocardial infarction in two case-control studies and this study shows an association with stroke in both whites and blacks from the ARIC study. SERPINA9 is a member of clade A of the large superfamily of serine peptidase inhibitors known as serpins. Serpins are protease inhibitors that use a conformational change to inhibit target enzymes, and are involved in many cellular processes, such as coagulation, fibrinolysis, complement fixation, matrix remodeling and apoptosis (Law et al. (2006) *Genome Biology* 7: 216). A recent study indicated that SERPINA9 was significantly upregulated in the hippocampal tissues from Alzheimer's disease transgenic mice versus age-matched controls (Jee et al (2006) *Neurochemistry Research* 31: 1035-1044). This study suggests that SERPINA9 may also be expressed in the human brain, consistent with the findings described herein of an association between polymorphic variation in this gene and ischemic stroke.

In addition to SERPINA9, polymorphisms in palladin (PALLD) and immediate early response 2 (IER2) were associated with ischemic stroke in whites and a polymorphism in exonuclease domain containing 1 (EXOD1) was associated in blacks. PALLD encodes a component of the cytoskeleton that controls cell shape and motility. Vascular remodeling may lead to atherosclerosis, and the shape and cytoskeletal organization of endothelial cells is an important part of this process. Mechanical stress and strain also plays a role in atherosclerotic vascular remodeling and immediate early response genes have been shown to mediate the mechanical stress-induced pathological process in the blood vessel (Liu et al. (1999) *Critical Reviews in Biomedical Engineering* 27: 75-148). Although little is known about EXOD1, exonucleases have been shown to play a role in both myocardial infarction and stroke. Given their functional roles, PALLD, IER2 and EXOD1 potentially play a role in the atherosclerotic pathway. Additionally, PALLD, IER2 and EXOD1 are all expressed in the heart and brain.

A strength of this study is the prospective cohort design. The large sample size allows for the assessment of exposures (e.g. genetic factors) of modest effect. All analyses for this study were performed separately in whites and blacks.

Thus, a small subset of gene variants previously associated with CHD in antecedent studies were found to also be associated with incident ischemic stroke in ARIC. In particular, SERPINA9 was associated with stroke in both whites and blacks and this association does not appear to be mediated by traditional risk factors.

Supplemental Analysis of SNPs in the ARIC Study

In a further analysis of the 51 SNPs in the ARIC participants, SNPs that predict ischemic stroke risk were identified by Cox proportional hazard analysis and included SNPs with a two-sided p-value of <0.2 after adjusting for age and sex and a hazard ratio (HRR)>1.0. These SNPs are shown in Tables 7-9 (the p-values shown in Tables 7-9 are two-sided p-values; thus, the one-sided p-values for these SNPs are half of these two-sided p-values). SNPs that predict ischemic stroke after adjusting for age and sex (two-sided p-value <0.2 and HRR >1.0) in the white ARIC participants and separately in the black ARIC participants are shown in Table 7 (whites) and Table 8 (blacks). SNPs that predict ischemic stroke after adjusting for age and sex in both the black and the white ARIC populations with the same risk alleles are listed in Table 9.

Example Two: SNPs Associated with Stroke in the Cardiovascular Health Study (CHS) Overview 74 SNPs, which had been associated with coronary heart disease (CHD) (Shiffman et al., *Arterioscler Thromb Vasc Biol.* 2008 January; 28(1):173-9, incorporated herein by reference in its entirety), were analyzed to determine whether these SNPs are associated with incident ischemic stroke. To carry out this analysis, the risk allele was prespecified for each of the 74 SNPs based on antecedent studies of CHD. Cox proportional hazards models were used that adjusted for traditional risk factors to estimate the associations of these SNPs with incident ischemic stroke during 14 years of follow-up in a population-based study of older adults referred to as the Cardiovascular Health Study (CHS). As a result of this analysis, the prespecified risk alleles of 7 of the 74 SNPs (in HPS1, ITGAE, ABCG2, MYH15, FSTL4, CALM1, and BAT2) were associated with increased risk of stroke in white CHS participants (1-sided P<0.05, false discovery rate (FDR)=0.42). In African American participants, the prespecified risk alleles of 5 SNPs (in KRT4, LY6G5B, EDG1, DMXL2, and ABCG2) were associated with stroke (1-sided P<0.05, FDR=0.55). The Val12Met SNP in ABCG2 was associated with stroke in both white (hazard ratio 1.46, 90% CI 1.05 to 2.03) and African American (hazard ratio 3.59, 90% CI 1.11 to 11.6) participants of CHS. Kaplan-Meier estimates of the 10 year cumulative incidence of stroke were greater among Val allele homozygotes than among Met allele carriers in both white (10% versus 6%) and African American (12% versus 3%) participants of CHS. Thus, the Val12Met SNP in ABCG2 (encoding a transporter of sterols and xenobiotics) was associated with incident ischemic stroke in white and African American participants of CHS.

Materials and Methods

Cardiovascular Health Study

CHS is a prospective population-based study of risk factors for cardiovascular disease, including CHD and stroke, in older adults. Men and women aged 65 years and older were recruited from random samples of individuals on Medicare eligibility lists in four U.S. communities (Sacramento County, California; Washington County, Maryland; Forsyth County, N.C.; and Pittsburgh, Allegheny County, Pennsylvania) and from age-eligible members of the same households. Potential participants were excluded if they were institutionalized, not ambulatory at home, under hospice care, receiving radiation or chemotherapy for cancer, not expected to remain in the area for at least three years, or unable to be interviewed. CHS enrolled 5201 participants in 1989-90. An additional 687 African American participants entered the cohort in 1992-93. Participants who did not donate DNA or who did not consent to the use of their DNA for studies by private companies (n=514) as well as participants for whom the amount of DNA samples were insufficient (n=130) were excluded, leaving 5244 participants available for a genetic study. The institutional review board at each site approved the study methods, and all participants gave written informed consent. Details of CHS design[7] and recruitment[8] have been reported.

Participants completed a baseline clinic examination that included a medical history interview, physical examination, and blood draw.[9] Baseline self-reported myocardial infarction (MI) or stroke was confirmed by information from the clinic examination or by review of medical records or physician questionnaires.[10] Cardiovascular events during follow-up were identified at semi-annual contacts, which alternated between clinic visits and telephone calls. Suspected events were adjudicated according to standard criteria by a physician review panel using information from medical records, brain imaging studies[11] and, in some cases, interviews with the physician, participant, or a proxy informant.[12] Medicare utilization files were searched to ascertain events that may have been missed.[13]

At baseline, 722 of the 5244 participants available for a genetic study had a history of stroke or MI. Since the risk of incident ischemic stroke might be influenced by whether a patient had had a prior stroke or MI, these 722 participants were excluded from the analysis, leaving 4522 (3849 white and 673 African American) participants in this genetic study of first incident ischemic stroke. Baseline characteristics of these 4522 participants are presented in Table 10. During follow-up, 642 participants had an incident non-procedure-related stroke, and 47 of these 642 had an MI before their stroke, leaving 595 stroke events. Of these 595 stroke events, 72 (12%) were hemorrhagic, 46 (8%) were not classified for type, and the remaining 477 stroke events were classified as ischemic stroke events: the end point for this analysis.

Covariates

Risk estimates for ischemic stroke were adjusted for the following traditional risk factors: diabetes mellitus (defined by fasting serum glucose levels of at least 126 mg/dL or the use of either insulin or oral hypoglycemic medications), impaired fasting glucose (defined as fasting glucose levels between 110 and 125 mg/dL[14]), hypertension (defined by systolic blood pressure of at least 140 mmHg, diastolic blood pressure of at least 90 mmHg, or a physician's diagnosis of hypertension plus the use of anti-hypertensive medications[10]), current smoking, LDL-cholesterol, HDL-cholesterol, and body mass index (BMI). Other covariates included atrial fibrillation, carotid intima-media thickness (IMT), and genotypes. Atrial fibrillation was identified on the basis of 12-lead resting ECGs performed at the baseline examination. Tracings were read for atrial fibrillation or flutter at the CHS Electrocardiography Reading Center.[15] Ultrasonography of the common and internal carotid arteries was also performed at baseline. The IMT was defined as the mean of the maximum IMTs of the near and far walls of the left and right carotid arteries.[16] Genotypes of the CHS participants were determined by a multiplex method that combines PCR, allele-specific oligonucleotide ligation assays, and hybridization to oligonucleotides coupled to Luminex®100™ xMAP microspheres (Luminex, Austin, Tex.), followed by detection of the spectrally distinct microsphere on a Luminex 100 instrument (Shiffman et al., *Arterioscler Thromb Vasc Biol.* 2008 January; 28(1):173-9).

Prespecification of Risk Alleles for 74 SNPs Investigated in CHS

For each of the 74 SNPs that were genotyped in CHS, a risk allele was prespecified based on antecedent data (Shiffman et al., *Arterioscler Thromb Vasc Biol.* 2008 January; 28(1):173-9). For 14 of the 74 SNPs, genetic associations with CHD have been previously published.[17-21] The remaining 60 SNPs were associated with MI in one or more antecedent studies of MI as described (Shiffman et al., *Arterioscler Thromb Vasc Biol.* 2008 January; 28(1):173-9).

Statistics

Since the risk estimate for gene variants can differ between whites and African Americans, the association of SNPs with incident ischemic stroke in CHS was investigated in each race separately. Analyses of time to primary end point were conducted. Follow-up began at CHS enrollment and ended on the date of incident stroke of any type, incident MI, death, loss to follow-up, or Jun. 30, 2004, whichever occurred first. The median follow-up time was 11.2 years (11.9 years for the 1989-90 cohort and 10.7 years for the African American cohort).

Cox regression models were used to estimate hazard ratios of each SNP. In Model 1, Cox models were adjusted for baseline age (continuous) and sex. In Model 2, Cox models were adjusted for baseline age (continuous), sex, body mass index (continuous), current smoking, diabetes, impaired fasting glucose, hypertension, LDL-cholesterol (continuous), and HDL-cholesterol (continuous). Risk estimates were also further adjusted for two additional risk factors of ischemic stroke: atrial fibrillation and carotid IMT. The SNP variable in the Cox models was coded as 0 for the non-risk homozygote, 1 for those who carried 1 copy of the risk allele and 2 for those who carried 2 copies of the risk allele. Thus, the hazard ratios represent the log-additive increase in risk for each additional copy of the risk allele a subject carried, compared with the non-risk homozygotes. Because the hypotheses that the allele associated with increased risk of CHD would also be associated with increased risk of ischemic stroke was being testing, a 1-sided P-value was used to test the significance of the Cox model coefficients. Correspondingly, 90% confidence intervals were estimated for the hazard ratios (for hazard ratios greater than one, there is 95% confidence that a true risk estimate is greater than the lower bound of a 90% confidence interval). In white participants, this study had 80% or more power to detect associations between SNPs and incident ischemic stroke for SNPs that have relative risks of 1.3 and 1.5 (in an additive model) and risk allele frequencies of 0.13 and 0.05, respectively, assuming an alpha level of 0.05 and a 1-sided test. In African American participants, this study had 80% or more power to detect associations between SNPs and incident ischemic stroke for SNPs that have relative risks of 1.6 and 1.8 (in an additive model) and risk allele frequencies of 0.3 and 0.14, respectively. The cumulative incidence of stroke was estimated by the method of Kaplan and Meier. Data were analyzed using Stata Statistical Software.[22] The influence of multiple testing was evaluated using the false discovery rate (FDR)[23] to estimate the expected fraction of false positives in a group of SNPs with P values below a given threshold. FDR calculations were performed with R Statistical Software.[24]

Results

The baseline characteristics of the 3,849 white and 673 African American participants of CHS in this genetic study of ischemic stroke are presented in Table 10. There were 407 first incident ischemic stroke events in the white participants and 70 in the African American participants during follow-up (median of 11.2 years). The association between incident ischemic stroke and 74 SNPs that had previously been found to be associated with coronary heart disease (CHD) in one or more antecedent studies (Shiffman et al., *Arterioscler Thromb Vasc Biol.* 2008 January; 28(1):173-9) was investigated. Specifically, for each SNP, it was determined whether the allele that had been associated with increased risk of CHD (the risk allele) was also associated with increased risk of stroke.

In white participants of CHS, it was found that the risk alleles of 7 of these 74 SNPs were associated (P<0.05) with increased risk of stroke after adjusting for traditional risk factors (age, sex, body mass index, smoking, diabetes, impaired fasting glucose, hypertension, LDL-cholesterol, and HDL-cholesterol). These 7 SNPs were in HPS1, ITGAE, ABCG2, MYH15, FSTL4, CALM1, and BAT2. The additive (per allele) hazard ratios for stroke ranged from 1.15 to 1.49 (Table 11). In African American participants of CHS, it was found that the risk alleles of 5 SNPs (in KRT4, LY6G5B, EDG1, DMXL2, and ABCG2) were associated (P<0.05) with increased risk of stroke after adjusting for traditional risk factors. The hazard ratios for these 5 SNPs ranged from 1.40 to 3.59 (Table 12). The risk estimates for the 11 SNPs that were associated with stroke in either whites or African Americans (Tables 11 and 12) were essentially unchanged when further adjusted for atrial fibrillation and internal carotid artery IMT (data not shown).

To account for multiple comparisons, the FDR[23] was estimated for the set of SNPs found to be associated with incident ischemic stroke in CHS participants. These FDRs were 0.42 for the 7 SNPs in white participants and 0.55 for the 5 SNPs in African American participants of CHS.

ABCG2 Val12Met (rs2231137) was associated with incident ischemic stroke in both white and African American participants of CHS. The risk of ischemic stroke was higher in Val allele homozygotes than in Met allele carriers. The adjusted hazard ratio for Val allele homozygotes, compared with Met allele carriers, was 1.50 (90% CI 1.06 to 2.12) in white participants and 3.62 (90% CI 1.11 to 11.9) in African American participants (Table 13). The 10-year cumulative incidence of ischemic stroke was greater in Val allele homozygotes than in Met allele carriers in both the white (10% versus 6%) and African American (12% versus 3%, FIGS. 1a-1b) participants of CHS.

Discussion

Among 74 genetic variants tested in CHS, it was found that 7 were associated with incident ischemic stroke in white participants and 5 were associated with incident ischemic stroke in African American participants. In particular, an association between the Val allele of ABCG2 Val12Met and increased risk of incident ischemic stroke was identified, and this association was consistent in both whites and African Americans.

Three of the 11 gene variants associated with incident ischemic stroke in CHS had particularly notable associations with CHD in the antecedent studies. The first of these 3 gene variants was the Val allele of ABCG2 Val12Met (rs2231137). This gene variant had previously been found to be associated with angiographically defined severe coronary artery disease (CAD) in two case-control studies.[20]

ABCG2 encodes ATP-binding cassette, subfamily G, member 2, which is a protein that belongs to a large family of transporters. It is expressed on the cell surface of stem cells in bone marrow and skeletal muscle,[25] progenitor endothelial cells that are capable of vasculogenesis in adipose tissue,[26] and endothelial cells in blood vessels of the heart[27] and brain[28]. The ABCG2 protein has been reported recently to transport sterols.[29, 30] It is interesting to note that the related ATP-binding cassette proteins ABCA1,[31] ABCG5, and ABCG8[32] are transporters of lipids: variants of these transporters have been shown to cause lipid disorders such as Tangier disease[31] and sitosterolemia.[32] However, a well known function of the ABCG2 protein is to act as a multi-drug transporter of anticancer drugs, and the ABCG2 protein is over-expressed in drug-resistant cancer cells.[33] The Met variant of ABCG2 has been reported to confer lower drug resistance and has an altered pattern of localization when compared with the Val variant.[34] It is possible that the Met variant of the ABCG2 protein may function in the vascular endothelium and have an altered function as a transporter. Homozygotes of the Val allele of ABCG2 (88% of whites and 88% of African Americans) were at higher risk of stroke than carriers of the Met allele in CHS. Since there were only 16 homozygotes of the Met allele, the Met homozygotes were pooled with heterozygotes and used as the reference group. The Met allele could also be considered to be a protective allele in that the Met allele carriers had a lower risk of incident ischemic stroke than the Val allele homozygotes.

The second of the 3 gene variants with notable findings in antecedent studies is the Ala allele of MYH15 Thr1125Ala (rs3900940). In addition to being associated with MI in two antecedent association studies,[6] it was associated with increased risk of incident CHD in the white participants of the Atherosclerosis Risk in Communities Study.[21] MYH15 encodes myosin heavy polypeptide 15 and the Thr1125Ala SNP is located in the tail domain of the MYH15 protein.[35]

The third gene variant with notable findings in antecedent studies is the G allele of rs3814843 in the 3' untranslated region in CALM1. This SNP was associated with angiographically defined severe CAD in two case-control studies.[20] CALM1 encodes calmodulin 1 which binds calcium and functions in diverse signaling pathways, including those involved in cell division,[36] membrane trafficking,[37] and platelet aggregation.[38]

Thus, a small subset of gene variants previously associated with CHD in antecedent studies were found to also be associated with incident ischemic stroke in CHS. Notably, the Val allele of the Val12Met SNP in ABCG2 (which encodes a transporter of sterols and anticancer drugs) was associated with increased risk of incident ischemic stroke in both white and African American participants of CHS.

REFERENCES (CORRESPONDING TO EXAMPLE TWO)

1. Brass L M, Isaacsohn J L, Merikangas K R, Robinette C D. A study of twins and stroke. *Stroke*. 1992; 23:221-223
2. Bak S, Gaist D, Sindrup S H, Skytthe A, Christensen K. Genetic liability in stroke: a long-term follow-up study of Danish twins. *Stroke*. 2002; 33:769-774
3. Welin L, Svardsudd K, Wilhelmsen L, Larsson B, Tibblin G. Analysis of risk factors for stroke in a cohort of men born in 1913. *N Engl J Med*. 1987; 317:521-526
4. Jousilahti P, Rastenyte D, Tuomilehto J, Sarti C, Vartiainen E. Parental history of cardiovascular disease and risk of stroke. A prospective follow-up of 14371 middle-aged men and women in Finland. *Stroke*. 1997; 28:1361-1366
5. Rosamond W, Flegal K, Friday G, Furie K, Go A, Greenlund K, Haase N, Ho M, Howard V, Kissela B, Kittner S, Lloyd-Jones D, McDermott M, Meigs J, Moy C, Nichol G, O'Donnell C J, Roger V, Rumsfeld J, Sorlie P, Steinberger J, Thom T, Wasserthiel-Smoller S, Hong Y. Heart disease and stroke statistics—2007 update: a report from the American Heart Association Statistics Committee and Stroke Statistics Subcommittee. *Circulation*. 2007; 115:e69-171
6. Shiffman D, O'Meara E S, Bare L A, Rowland C M, Louie J Z, Arellano A R, Lumley T, Rice K, Iakoubova O, Luke M M, Young B A, Malloy M J, Kane J P, Ellis S G, Tracy R P, Devlin J J, Psaty B M. Association of gene variants with incident myocardial infarction in the Cardiovascular Health Study. *Arterioscler Thromb Vasc Biol*. 2008; 28:173-179
7. Fried L P, Borhani N O, Enright P, Furberg C D, Gardin J M, Kronmal R A, Kuller L H, Manolio T A, Mittelmark M B, Newman A, et al. The Cardiovascular Health Study: design and rationale. *Ann Epidemiol*. 1991; 1:263-276
8. Tell G S, Fried L P, Hermanson B, Manolio T A, Newman A B, Borhani N O. Recruitment of adults 65 years and older as participants in the Cardiovascular Health Study. *Ann Epidemiol*. 1993; 3:358-366
9. Cushman M, Cornell E S, Howard P R, Bovill E G, Tracy R P. Laboratory methods and quality assurance in the Cardiovascular Health Study. *Clin Chem*. 1995; 41:264-270
10. Psaty B M, Kuller L H, Bild D, Burke G L, Kittner S J, Mittelmark M, Price T R, Rautaharju P M, Robbins J. Methods of assessing prevalent cardiovascular disease in the Cardiovascular Health Study. *Ann Epidemiol*. 1995; 5:270-277

11. Longstreth W T, Jr., Bernick C, Fitzpatrick A, Cushman M, Knepper L, Lima J, Furberg C D. Frequency and predictors of stroke death in 5,888 participants in the Cardiovascular Health Study. *Neurology.* 2001; 56:368-375

12. Price T R, Psaty B, O'Leary D, Burke G, Gardin J. Assessment of cerebrovascular disease in the Cardiovascular Health Study. *Ann Epidemiol.* 1993; 3:504-507

13. Ives D G, Fitzpatrick A L, Bild D E, Psaty B M, Kuller L H, Crowley P M, Cruise R G, Theroux S. Surveillance and ascertainment of cardiovascular events. The Cardiovascular Health Study. *Ann Epidemiol.* 1995; 5:278-285

14. American Diabetes Association. Report of the Expert Committee on the Diagnosis and Classification of Diabetes Mellitus. *Diabetes Care.* 1997; 20:1183-1197

15. Rautaharju P M, MacInnis P J, Warren J W, Wolf H K, Rykers P M, Calhoun H P. Methodology of ECG interpretation in the Dalhousie program; NOVACODE ECG classification procedures for clinical trials and population health surveys. *Methods Inf Med.* 1990; 29:362-374

16. O'Leary D H, Polak J F, Wolfson S K, Jr., Bond M G, Bommer W, Sheth S, Psaty B M, Sharrett A R, Manolio T A. Use of sonography to evaluate carotid atherosclerosis in the elderly. The Cardiovascular Health Study. CHS Collaborative Research Group. *Stroke.* 1991; 22:1155-1163

17. Shiffman D, Ellis S G, Rowland C M, Malloy M J, Luke M M, Iakoubova O A, Pullinger C R, Cassano J, Aouizerat B E, Fenwick R G, Reitz R E, Catanese J J, Leong D U, Zellner C, Sninsky J J, Topol E J, Devlin J J, Kane J P. Identification of four gene variants associated with myocardial infarction. *Am J Hum Genet.* 2005; 77:596-605

18. Shiffman D, Rowland C M, Louie J Z, Luke M M, Bare L A, Bolonick J I, Young B A, Catanese J J, Stiggins C F, Pullinger C R, Topol E J, Malloy M J, Kane J P, Ellis S G, Devlin J J. Gene variants of VAMP8 and HNRPUL1 are associated with early-onset myocardial infarction. *Arterioscler Thromb Vasc Biol.* 2006; 26:1613-1618

19. Iakoubova O A, Tong C H, Chokkalingam A P, Rowland C M, Kirchgessner T G, Louie J Z, Ploughman L M, Sabatine M S, Campos H, Catanese J J, Leong D U, Young B A, Lew D, Tsuchihashi Z, Luke M M, Packard C J, Zerba K E, Shaw P M, Shepherd J, Devlin J J, Sacks F M. Asp92Asn polymorphism in the myeloid IgA Fc receptor is associated with myocardial infarction in two disparate populations: CARE and WOSCOPS. *Arterioscler Thromb Vasc Biol.* 2006; 26:2763-2768

20. Luke M M, Kane J P, Liu D M, Rowland C M, Shiffman D, Cassano J, Catanese J J, Pullinger C R, Leong D U, Arellano A R, Tong C H, Movsesyan I, Naya-Vigne J, Noordhof C, Feric N T, Malloy M J, Topol E J, Koschinsky M L, Devlin J J, Ellis S G. A polymorphism in the protease-like domain of apolipoprotein(a) is associated with severe coronary artery disease. *Arterioscler Thromb Vasc Biol.* 2007; 27:2030-2036

21. Bare L A, Morrison A C, Rowland C M, Shiffman D, Luke M M, Iakoubova O A, Kane J P, Malloy M J, Ellis S G, Pankow J S, Willerson J T, Devlin J J, Boerwinkle E. Five common gene variants identify elevated genetic risk for coronary heart disease. *Genet Med.* 2007; 9:682-689

22. StataCorp. Stata Statistical Software: Release 9. 2005

23. Benjamini Y, Hochberg Y. Controlling the false discovery rate: A new and powerful approach to multiple testing. *Journal of the Royal Statistical Society.* 1995; Serials B:1289-1300

24. R Development Core Team. R: A language and environment for statistical computing, reference index version 2.3.0. 2005

25. Zhou S, Schuetz J D, Bunting K D, Colapietro A M, Sampath J, Morris J J, Lagutina I, Grosveld G C, Osawa M, Nakauchi H, Sorrentino B P. The ABC transporter Bcrp1/ABCG2 is expressed in a wide variety of stem cells and is a molecular determinant of the side-population phenotype. *Nat Med.* 2001; 7:1028-1034

26. Miranville A, Heeschen C, Sengenes C, Curat C A, Busse R, Bouloumie A. Improvement of postnatal neovascularization by human adipose tissue-derived stem cells. *Circulation.* 2004; 110:349-355

27. Meissner K, Heydrich B, Jedlitschky G, Meyer Zu Schwabedissen H, Mosyagin I, Dazert P, Eckel L, Vogelgesang S, Warzok R W, Bohm M, Lehmann C, Wendt M, Cascorbi I, Kroemer H K. The ATP-binding cassette transporter ABCG2 (BCRP), a marker for side population stem cells, is expressed in human heart. *J Histochem Cytochem.* 2006; 54:215-221

28. Zhang W, Mojsilovic-Petrovic J, Andrade M F, Zhang H, Ball M, Stanimirovic D B. The expression and functional characterization of ABCG2 in brain endothelial cells and vessels. *Faseb J.* 2003; 17:2085-2087

29. Janvilisri T, Venter H, Shahi S, Reuter G, Balakrishnan L, van Veen H W. Sterol transport by the human breast cancer resistance protein (ABCG2) expressed in *Lactococcus lactis. J Biol Chem.* 2003; 278:20645-20651

30. Janvilisri T, Shahi S, Venter H, Balakrishnan L, van Veen H W. Arginine-482 is not essential for transport of antibiotics, primary bile acids and unconjugated sterols by the human breast cancer resistance protein (ABCG2). *Biochem J.* 2005; 385:419-426

31. Oram J F. Tangier disease and ABCA1. *Biochim Biophys Acta.* 2000; 1529:321-330

32. Schmitz G, Langmann T, Heimerl S. Role of ABCG1 and other ABCG family members in lipid metabolism. *J Lipid Res.* 2001; 42:1513-1520

33. Maliepaard M, van Gastelen M A, de Jong L A, Pluim D, van Waardenburg R C, Ruevekamp-Helmers M C, Floot B G, Schellens J H. Overexpression of the BCRP/MXR/ABCP gene in a topotecan-selected ovarian tumor cell line. *Cancer Res.* 1999; 59:4559-4563

34. Mizuarai S, Aozasa N, Kotani H. Single nucleotide polymorphisms result in impaired membrane localization and reduced atpase activity in multidrug transporter ABCG2. *Int J Cancer.* 2004; 109:238-246

35. Desjardins P R, Burkman J M, Shrager J B, Allmond L A, Stedman H H. Evolutionary implications of three novel members of the human sarcomeric myosin heavy chain gene family. *Mol Biol* Evol. 2002; 19:375-393

36. Moisoi N, Erent M, Whyte S, Martin S, Bayley P M. Calmodulin-containing substructures of the centrosomal matrix released by microtubule perturbation. *J Cell Sci.* 2002; 115:2367-2379

37. Tyteca D, van Ijzendoorn S C, Hoekstra D. Calmodulin modulates hepatic membrane polarity by protein kinase C-sensitive steps in the basolateral endocytic pathway. *Exp Cell Res.* 2005; 310:293-302

38. Oury C, Sticker E, Cornelissen H, De Vos R, Vermylen J, Hoylaerts M F. ATP augments von Willebrand factor-dependent shear-induced platelet aggregation through Ca2+-calmodulin and myosin light chain kinase activation. *J Biol Chem.* 2004; 279:26266-26273.

Supplemental Analysis of SNPs in the CHS Study

In a further analysis of 77 SNPs, which include the SNPs analyzed in the CHS study described herein in Example Two along with additional SNPs found to be associated with CHD risk in a Cholesterol and Recurrent Event (CARE) trial and a WOSCOPS trial (Shiffman et al., *Arterioscler Thromb Vasc Biol.* 2008 January; 28(1):173-977), three additional SNPs that predict ischemic stroke risk were identified by Cox proportional hazard analysis that had one-sided p-values of <=0.05 in whites after adjusting for age and sex, and also after adjusting for all traditional risk factors including smoking, diabetes, hypertension, HDL-C, LDL-C, and BMI (similar to what was described in Shiffman et al., *Arterioscler Thromb Vasc Biol.* 2008 January; 28(1):173-9). These three SNPs are shown in Table 14. Also, as shown in Table 14, the hazard ratios were consistent in blacks and whites for SNPs rs2243682/hCV1624173 and rs34868416/hCV25951678.

Example Three: SNPs Associated with Noncardioembolic Stroke in the Vienna Stroke Registry Overview For SNPs that had been associated with coronary heart disease (CHD) in previous studies such as Atherosclerosis Risk in Communities (ARIC) (e.g., Bare, et al. (2007), *Genet Med* 9(10):682-9 and McPherson, et al. (2007), *Science* 316(5830):1488-91), carriers of the CHD risk alleles for each SNP were analyzed for increased risk of noncardioembolic stroke in the Vienna Stroke Registry (VSR). In a case-control study, 562 noncardioembolic stroke cases from VSR[7] and 815 healthy controls from the city of Vienna[8] were genotyped for each of the SNPs. The allele previously associated with CHD risk was pre-specified as the risk allele, and this risk allele was tested for association with noncardioembolic stroke.

It was determined that carriers of the CHD risk allele of the following four SNPs had increased risk of noncardioembolic stroke (the name of the gene or chromosome that contains each SNP is indicated in parentheses): rs3900940 (MYH15), rs20455 (KIF6), rs1010 (VAMP8), and rs10757274 (chromosome 9p21) (characteristics of these SNPs are presented in Table 16). The odds ratios (OR) for the associations of these SNPs with noncardioembolic stroke were as follows: 1.20 (90% confidence interval 0.95-1.50) for rs10757274 on chromosome 9p21, 1.24 (1.01-1.5) for rs20455 in KIF6, 1.31 (1.07-1.60) for rs3900940 in MYH15, and 1.21 (0.99-1.49) for rs1010 in VAMP8.

Subjects and Methods
Study Population

The stroke cases in VSR are consecutive Caucasian patients admitted to stroke units in Vienna within 72 hours of onset of acute ischemic stroke between October 1998 and June 2001. All patients underwent cranial CT or MRI and were documented according to a standardized protocol including stroke severity, risk factors, and medical history[7]. Only patients with noncardioembolic stroke were included as cases in this study. Controls were unrelated Caucasian participants in a health care program in Vienna, 45 years old or older, free of arterial vascular disease, and reported no arterial vascular diseases in first degree relatives[8]. Genotypes were determined as described previously[9]. This study complied with the Declaration of Helsinki and was approved by the Ethics Committee of Medical University Vienna. All subjects gave written informed consent.

Statistics

Differences in traditional risk factors between cases and controls were assessed by the Wilcoxon rank sum test (continuous variables) or by the chi-square test (discrete variables). Odds ratios estimated from logistic regression models were adjusted for traditional risk factors including age (at the index stroke event for cases, at enrollment for controls), sex, current smoker (versus not), diabetes mellitus (defined by a physician's diagnosis or the use of either insulin or oral hypoglycemic medications), hypertension (defined by systolic blood pressure >140 mmHg, diastolic blood pressure >90 mmHg, a physician's diagnosis of hypertension, or the use of anti-hypertensive medications), dyslipidemia (defined by a total cholesterol ≥240 mg/dL (6.2 mmol/L), LDL-C ≥160 mg/dL (4.1 mmol/L), HDL-C <40 mg/dL (1.0 mmol/L), or the use of lipid lowering medications), and body mass index (BMI). Since the purpose of this study was to determine if the same alleles found to be associated with increased risk of CHD in previous studies would be associated with increased risk of noncardioembolic stroke in VSR, one-sided p values and 90% confidence intervals (because there was 95% confidence that the true risk estimates were greater than the lower bounds of the 90% confidence intervals) were used. All other p values are two-sided. Effect sizes for carriers of the CHD risk alleles, compared with noncarriers, detectable with 90% power were calculated using QUANTO[10] assuming a one-sided test and an alpha of 0.05. To account for multiple hypothesis testing, the false discovery rate q values were estimated by the method of Benjamini and Hochberg[11] using the p values for CHD risk allele carrier status from the age and sex adjusted models. The q value of a given SNP represents the expected proportion of false positives among the set of SNPs with equal or lower q values.

Structure software was used to estimate both the number of subpopulations (due to ancestry) in this study and the degree of ancestry admixture for each individual subject[12] based on genotypes of 130 SNPs whose minor allele frequencies ranged from 0.95% to 49.8%. The probable degree of admixture was included as a covariate in logistic regression models to adjust risk estimates for potential confounding due to population structure. Models that assumed one, two, three, or four subpopulations were tested, and replicate runs of the Structure program were performed for each model with a burn-in of 20,000 repetitions followed by 10,000 repetitions using the admixture model with independent allele frequencies and default values for other parameters.

Results

The clinical characteristics of the cases and controls are presented in Table 15. It was determined whether carriers of the alleles of SNPs that had previously been associated with increased risk of CHD[2,3] were also associated with increased risk of noncardioembolic stroke. The genotype distribution of these SNPs did not deviate from Hardy Weinberg equilibrium (p>0.17). To account for multiple testing, false discovery rate q values were estimated for the SNPs. Four of the SNPs were found to be associated with noncardioembolic stroke with false discovery rate q values at or below 0.15. For these four SNPs, carriers of the CHD risk allele, compared with noncarriers, had increased risk of noncardioembolic stroke after adjusting for age and sex: the odds ratios were 1.20 (90% confidence interval (CI) 0.95-1.50) for the C9p21 SNP, 1.24 (CI 1.01-1.52) for the KIF6 SNP, 1.31 (CI 1.07-1.60) for the MYH15 SNP, and 1.21 (CI 0.99-1.49) for the VAMP8 SNP (Model 1, Table 17). On examination of the homozygous and heterozygous carriers separately, it was found that for the C9p21 SNP, the homozygous carriers (OR=1.59) in particular had increased risk (OR of heterozygous carriers=1.05). These odds ratios decreased somewhat after adjustment for additional risk factors (smoking, hypertension, diabetes, dyslipidemia, and BMI) with the exception of the odds ratio for the VAMP8 SNP which increased (Model 2, Table 17). Removal of all cases with a history of myocardial infarction (n=40) from the analysis did not appreciably change the fully adjusted odds ratios for the C9p21 homozygotes (1.45, CI 1.05-1.99), MYH15 carriers (1.24, CI 0.99-1.55), and VAMP8 carriers (1.28, CI 1.01-1.61). However, removal of cases with a history of myocardial infarction reduced the odds ratio for KIF6 carriers to 1.15 (CI 0.91-1.45).

Population structure was investigated in this study using a Bayesian clustering approach[12] to evaluate models that assumed one, two, three, or four distinct subpopulations. A model assuming two subpopulations was found to result in the highest estimated log likelihood. Using the two subpopulation model, the degree of ancestry admixture was estimated for individual subjects. The fully adjusted odds ratios of the SNPs shown in Table 17 were not appreciably changed (the largest change was a decrease of 0.01 in the odds ratio for C9p21 homozygotes) when further adjusted for the ancestry of the subjects.

Discussion

It was determined that four SNPs were associated with noncardioembolic stroke after adjusting for age and sex when controlling the false discovery rate at 0.15. For these four SNPs, carriers of the CHD risk allele (G of rs10757274 on C9p21, Arg of Trp719Arg (rs20455) in KIF6, Ala of Thr1125Ala (rs3900940) in MYH15, and C of rs1010 in VAMP8) also had increased risk of noncardioembolic stroke.

MYH15 encodes myosin heavy polypeptide 15, a motor protein of the class-II sarcomeric myosin heavy chain family. The Thr1125Ala SNP is located in the coiled-coil rod domain of the MYH15 protein, and the Thr1125 residue has been shown to be phosphorylated[13,14]. Since the Ala1125 residue could not be phosphorylated, this substitution could affect the function of the MYH15 protein.

VAMP8 encodes vesicle associated membrane protein 8 which functions in platelet degranulation pathways[15]. The rs1010 SNP is located in the 3' untranslated region of VAMP8 in a potential microRNA binding site[16].

Thus, this Example demonstrates that carriers of the CHD risk allele of SNPs rs20455 in KIF6, rs3900940 in MYH15, rs1010 in VAMP8, and rs10757274 on chromosome 9p21 had increased risk of noncardioembolic stroke in VSR.

REFERENCES (CORRESPONDING TO EXAMPLE THREE)

1. Rosamond W, Flegal K, Furie K, Go A, Greenlund K, Haase N, Hailpern S M, Ho M, Howard V, Kissela B, Kittner S, Lloyd-Jones D, McDermott M, Meigs J, Moy C, Nichol G, O'Donnell C, Roger V, Sorlie P, Steinberger J, Thom T, Wilson M, Hong Y: Heart disease and stroke statistics—2008 update: a report from the American Heart Association Statistics Committee and Stroke Statistics Subcommittee. Circulation 2008; 117:e25-146.
2. Bare L A, Morrison A C, Rowland C M, Shiffman D, Luke M M, Iakoubova O A, Kane J P, Malloy M J, Ellis S G, Pankow J S, Willerson J T, Devlin J J, Boerwinkle E: Five common gene variants identify elevated genetic risk for coronary heart disease. Genet Med 2007; 9:682-689.
3. McPherson R, Pertsemlidis A, Kavaslar N, Stewart A, Roberts R, Cox D R, Hinds D A, Pennacchio L A, Tybjaerg-Hansen A, Folsom A R, Boerwinkle E, Hobbs H H, Cohen J C: A common allele on chromosome 9 associated with coronary heart disease. Science 2007; 316:1488-1491.
4. Morrison A C, Bare L A, Luke M M, Pankow J S, Mosley T H, Devlin J J, Willerson J T, Boerwinkle E: Single nucleotide polymorphisms associated with coronary heart disease predict incident ischemic stroke in the Atherosclerosis Risk in Communities (ARIC) study. Cerebrovascular Disease 2008; 26:420-424.
5. Zee R Y, Ridker P M: Two common gene variants on chromosome 9 and risk of atherothrombosis. Stroke 2007; 38:e111.
6. Luke M M, O'Meara E S, Rowland C M, Shiffman D, Bare L A, Arellano A R, Longstreth W T, Jr., Lumley T, Rice K, Tracy R P, Devlin J J, Psaty B M: Gene Variants Associated With Ischemic Stroke. The Cardiovascular Health Study. Stroke 2008.
7. Lang W: The Vienna Stroke Registry—objectives and methodology. The Vienna Stroke Study Group. Wien Klin Wochenschr 2001; 113:141-147.
8. Lalouschek W, Lang W, Mullner M: Current strategies of secondary prevention after a cerebrovascular event: the Vienna stroke registry. Stroke 2001; 32:2860-2866.
9. Shiffman D, Ellis S G, Rowland C M, Malloy M J, Luke M M, Iakoubova O A, Pullinger C R, Cassano J, Aouizerat B E, Fenwick R G, Reitz R E, Catanese J J, Leong D U, Zellner C, Sninsky J J, Topol E J, Devlin J J, Kane J P: Identification of four gene variants associated with myocardial infarction. Am J Hum Genet 2005; 77:596-605.
10. QUANTO: Release 1.1 A computer program for power and sample size calculations for genetic epidemiology studies. Gauderman WJMJ. 2006.
11. Benjamini Y, Hochberg Y: Controlling the false discovery rate: A new and powerful approach to multiple testing. Journal of the Royal Statistical Society 1995; Serials B:1289-1300.
12. Pritchard J K, Stephens M, Donnelly P: Inference of population structure using multilocus genotype data. Genetics 2000; 155:945-959.
13. Gnad F, Ren S, Cox J, Olsen J V, Macek B, Oroshi M, Mann M: PHOSIDA (phosphorylation site database): management, structural and evolutionary investigation, and prediction of phosphosites. Genome Biol 2007; 8:R250.
14. Olsen J V, Blagoev B, Gnad F, Macek B, Kumar C, Mortensen P, Mann M: Global, in vivo, and site-specific phosphorylation dynamics in signaling networks. Cell 2006; 127:635-648.
15. Polgar J, Chung S H, Reed G L: Vesicle-associated membrane protein 3 (VAMP-3) and VAMP-8 are present in human platelets and are required for granule secretion. Blood 2002; 100:1081-1083.
16. Shiffman D, Rowland C M, Louie J Z, Luke M M, Bare L A, Bolonick J I, Young B A, Catanese J J, Stiggins C F, Pullinger C R, Topol E J, Malloy M J, Kane J P, Ellis S G, Devlin J J: Gene variants of VAMP8 and HNRPUL1 are associated with early-onset myocardial infarction. Arterioscler Thromb Vasc Biol 2006; 26:1613-1618.
17. Helgadottir et al.: The same sequence variant on 9p21 associates with myocardial infarction, abdominal aortic aneurysm and intracranial aneurysm. Nat Genet 2008; 40:217-224.

Supplemental Analysis of SNPs in the Vienna Stroke Registry

In a further analysis, the genotype of 19 SNPs (which were previously found to be associated with incident CHD in white or black participants of the ARIC study) were determined in the cases and controls of the Vienna Stroke Registry ("VSR", approximately 764 ischemic stroke cases which included 562 atherothrombotic stroke cases, and 815 controls who were 45 or older from the same region).

As shown in Table 18, the risk alleles (which were associated with CHD in ARIC) for certain of these 19 SNPs were found to be associated (2-sided p-value of <0.2) with ischemic stroke (labeled "ischemic" in the "outcome" column of Table 18), atherothrombotic stroke (labeled "athero" in the "outcome" column of Table 18), and/or early-onset stroke (labeled "early-onset" in the "outcome" column of Table 18) in VSR before and/or after adjustment for traditional risk factors such as age, sex, body mass index, smoking, diabetes, impaired fasting glucose, hypertension, LDL-cholesterol, and HDL-cholesterol (results after adjustment are labeled "yes" and results before adjustment are labeled "no" in the "adjust?" column of Table 18) (the p-values shown in Table 18 are two-sided p-values; thus, the one-sided p-values for these SNPs are half of these two-sided p-values).

Early-onset stroke is ischemic stroke that occurs early in life. As used herein, early-onset stroke is defined as those stroke events that happened before the median stroke age of the ischemic cases. The controls for these early-onset cases are those controls who were at ages above the median age of all controls in the study (i.e., young cases versus old controls was the study design).

Example Four: SNPs Associated with Stroke in the UCSF/CCF Study

The allele frequencies of 25,878 putative functional SNPs were determined in atherothrombotic stroke cases and healthy controls of the Vienna Stroke Registry ("VSR", about 562 cases and 815 controls, Study ID V0031), and the allele frequencies of about 3,300 of these 25,878 SNPs were found to be associated with atherothrombotic (noncardioembolic) stroke (2-sided p value of less than or equal to 0.05). These 3,300 SNPs were then further tested in a stroke study of cases with a history of stroke and controls with no history of stroke or myocardial infarction from the UCSF and the CCF sample sets (Study ID GS41). The allele frequencies of 292 of these 3,300 SNPs were again associated with stroke risk (1-sided p<0.05) in the UCSF/CCF stroke study (approximately 570 cases and 1604 controls), and the risk alleles were the same in VSR and in UCSF/CCF studies. These stroke associations were then confirmed by individually genotyping the 292 SNPs in VSR subjects, and 101 of these SNPs were again found to be associated with stroke risk (p<0.05 in allelic, additive, dominant, or recessive mode). These 101 SNPs were then genotyped in the UCSF/CCF stroke study and it was determined that 61 of these SNPs were still associated with stroke in the UCSF/CCF study (1-sided p<0.05 or 2-sided p<0.1) and have the same risk allele as in the VSR study.

These 61 SNPs and the stroke association data in both the UCSF/CCF and the VSR studies are provided in Table 19. These SNPs were further analyzed in additional sample sets, as discussed below in Examples Five, Six, and Seven.

Example Five: SNPs Associated with Stroke in the German West Study

The identification of 61 SNPs that are associated with stroke in both of two case-control studies (Vienna Stroke Registry and the UCSF/CCF Stroke Study) is described in Example Four above. Here, Example Five describes the analysis of these 61 SNPs, plus 17 additional SNPs, in the German West Study (which may be interchangeably referred to herein as the "Muenster" Stroke Study).

The German West Study, which is a stroke case-control study, included 1,300 ischemic stroke cases and 1,000 healthy controls. The ischemic stroke cases were further classified by TOAST criteria into several stroke subtypes, allowing analyses of the association of genotypes of the tested SNPs with the following endpoints: 1) ischemic stroke (outcome: "ischemic_stk" in Tables 20-21), 2) non-cardioembolic stroke (outcome: "nonce_stk" in Tables 20-21; ischemic stroke that were not cardioembolic in origin), 3) cardioembolic stroke (outcome: "CE_stk" in Tables 20-21), 4) atherothrombotic stroke (outcome: "athero_stk" in Tables 20-21), 5) Lacunar stroke (outcome: "lacunar_stk" in Tables 20-21), 6) no heart disease stroke (outcome: "nohd_stk" in Tables 20-21; ischemic stroke cases excluding those with a history of heart disease), 7) recurrent stroke (outcome: "recurrent_stk" in Tables 20-21; stroke cases that also had a prior history of stroke), and 8) early onset stroke (outcome: "EO_stk" in Tables 20-21; cases that are younger than the median age of all cases, and controls that were older than the median age of all controls).

Potential population stratification was also adjusted for (in addition to traditional risk factors) in assessing the risk estimates of the SNPs. The risk allele of each of the SNPs tested in this study was pre-specified to be the same as in antecedent studies, and a 2-sided p-value of less than 0.1 (equivalent to 1-sided p-values less than 0.05) or a 2-sided p-value less than 0.2 (equivalent to 1-sided p-values less than 0.1) were used as cutoffs for statistical significance.

SNPs that showed significant association with stroke risk in the German West Study are provided in Tables 20-21. Table 20 provides SNPs associated with stroke that have the same risk allele and 2-sided p-values that are less than 0.1 (equivalent to 1-sided p-values that are less than 0.05), and Table 21 provides SNPs associated with stroke that have the same risk allele and 2-sided p-values that are between 0.1 and 0.2 (equivalent to 1-sided p-values that are between 0.05 and 0.1).

Supplemental Analysis of SNPs in the German West Study

Overview and Results

Also in the German West Study, SNPs were identified that are associated with noncardioembolic stroke in three large study populations (the German West Study, as well as in the Vienna and UCSF/CCF Studies described above). A case-control study design was used: the Vienna Study, the UCSF/CCF Study, and the German West Study (728 noncardioembolic stroke cases, 1,041 controls). It was determined whether the alleles of those SNPs that were associated with increased risk in both the Vienna and UCSF/CCF studies were also associated with increased risk in the German West Study (thus, 1-sided tests of significance were used). Logistic regression analysis adjusting for age, sex, hypertension, and diabetes was performed.

Four SNPs were determined to be associated with non-cardioembolic stroke (p<0.05) in the German West Study (before correcting for multiple testing—46 SNPs and 3 genetic models), as well as also being associated with noncardioembolic stroke in the UCSF/CCF and Vienna studies described above. These four SNPs (and the genes which they are in or near) are as follows: rs544115 in NEU3, rs1264352 near DDR1, rs10948059 in GNMT, and rs362277 in HD. An increased risk for noncardioembolic stroke was observed for carriers of the following genotypes, compared with noncarriers, for each of these four SNPs (with carrier frequency in controls, odds ratio, and 90% confidence interval indicated): CT or CC carriers of rs544115 (96.0% of controls, OR 2.39, CI 1.31-4.36), CG or CC carriers of rs1264352 (23.9% of controls, OR 1.38, CI 1.08-1.76), CT or CC carriers of rs10948059 (77% of controls, OR 1.38, CI 1.06-1.79), and CC carriers of rs362277 (80.0% of controls, OR 1.39, CI 1.05-1.84). After correcting for multiple testing, this set of 4 SNPs had a false discovery rate (FDR) of 0.67.

Subjects and Methods
Study Subjects

Subjects in all three studies (the German West Study, as well as the Vienna and UCSF/CCF Studies) were unrelated men and women of European decent and have given written informed consent. In the Vienna Study, the noncardioembolic stroke cases (defined as ischemic stroke cases that are not of cardioembolic origin, and included large vessel and small vessel stroke) were drawn from the Vienna Stroke Registry (VSR). Stroke cases in VSR were consecutive Caucasian patients admitted to stroke units in Vienna within 72 hours of onset of acute ischemic stroke between October 1998 and June 2001. All patients underwent cranial CT or MRI and were documented according to a standardized protocol including stroke severity, risk factors, and medical history. Controls were unrelated Caucasian participants in a health care program in Vienna, 45 years old or older, free of arterial vascular disease, and reported no arterial vascular diseases in first degree relatives. This study complied with the Declaration of Helsinki and was approved by the Ethics Committee of Medical University Vienna.

The UCSF/CCF study included 416 cases and 977 controls drawn from Genomic Resource at University of California San Francisco (UCSF) as well as 154 cases and 627 controls drawn from the Genebank of Cleveland Clinic Foundation (CCF). Cases in the UCSF/CCF study did not have stroke subtype information. To enrich for noncardioembolic stroke cases, patients with a history of stroke were excluded who also had a history of heart rhythm or heart valve diseases that could have lead to cardioembolic stroke. Cases from UCSF had a history of stroke and no history of abnormal heart rhythm, heart valve disease or surgery. Controls from UCSF did not have a history of stroke, atherectomy, or CHD (including coronary stenosis, myocardial infarction, or coronary revascularization procedures). Cases and controls from CCF were patients who have had coronary angiography. Cases had a history of stroke and no history of atrial fibrillation, heart valve disease, or surgery. Controls did not have a history of stroke or CHD (including myocardial infarction, coronary stenosis greater than 50%, peripheral vascular disease, or revascularization procedures).

The German West Study included 728 noncardioembolic cases (ischemic strokes that were not of cardioembolic origin) from Westphalia Stroke Registry and 1,041 controls from the same region of Germany recruited by the Dortmund Health Study for the noncardioembolic stroke analysis. For the cardioembolic stroke analysis, 462 cardioembolic stroke cases (ischemic strokes of cardioembolic origin), also enrolled in the Westphalia Stroke Registry, were compared with the same 1401 controls from the Dortmund Health Study.

Statistics

Differences in traditional risk factors between cases and controls were assessed by the Wilcoxon rank sum test (continuous variables) or by the chi-square test (discrete variables). Odds ratios for the Vienna Study or the UCSF/CCF Study were not adjusted, and odds ratios for the German West Study were estimated from logistic regression models and adjusted for traditional risk factors including age (at the index stroke event for cases, at enrollment for controls), sex, diabetes mellitus (defined by a physician's diagnosis or the use of either insulin or oral hypoglycemic medications), hypertension (defined by systolic blood pressure >140 mmHg, diastolic blood pressure >90 mmHg, a physician's diagnosis of hypertension, or the use of antihypertensive medications). To account for multiple hypothesis testing, the false discovery rate (FDR) q values were estimated by the method of Benjamini and Hochberg (*Journal of the Royal Statistical Society* 1995; Serials B:1289-1300) using the p-values for risk genotype carrier status from the model adjusted for age, sex, hypertension, and diabetes.

Example Six: SNPs Associated with Stroke or Statin Response in CARE or PROSPER Studies The identification of 61 SNPs that are associated with stroke in both of two case-control studies (Vienna Stroke Registry and the UCSF/CCF Stroke Study) is described in Example Four above. Example Five above describes the analysis of these 61 SNPs plus 17 additional SNPs in the German West Study. Here, Example Six describes the analysis of SNPs with stroke risk and stroke statin response (SSR) in two pravastatin trials: CARE ("Cholesterol and Recurrent Events" study, which is comprised of individuals who have previously had an MI) and PROSPER ("Prospective Study of Pravastatin in the Elderly at Risk" study, which is comprised of elderly individuals with or without a history of cardiovascular disease (CVD)).

In CARE, SNPs were analyzed for association with stroke risk or SSR. SNPs that were significantly associated with stroke risk or SSR in CARE (which were also associated with stroke risk in the German West Study described above in Example Five) are provided in Table 22 (stroke risk) and Table 23 (SSR). Additional SNPs that were significantly associated with stroke risk or SSR in CARE are provided in Table 24 (stroke risk) and Table 25 (SSR). Further SNPs that were significantly associated with stroke risk or SSR in CARE are provided in Table 26 (stroke risk) and Table 27 (SSR).

Table 26 shows that, for example, individuals in CARE who were G/G homozygotes at the CALM1 SNP (rs3814843/hCV11474611) had an increased risk for stroke (HR=7.54 with a 2-sided p-value of 0.0441 for genotypic mode and adjusted for statin use; HR=7.43 with a 2-sided p-value of 0.0455 for recessive mode and adjusted for statin use; HR=6.64 with a 2-sided p-value of 0.0606 for genotypic mode and unadjusted; and HR=6.67 with a 2-sided p-value of 0.0599 for recessive mode and unadjusted).

Results of the analysis of the MYH15 SNP (rs3900940/hcv7425232) for association with stroke risk in CARE are provided in Table 28. Table 28 shows that, for example, individuals in CARE who were C/C homozygotes at the MYH15 SNP (rs3900940/hcv7425232) had an increased risk for stroke (HR=1.403 with a 2-sided p-value of 0.153 when adjusted for statin use; HR=1.51 with a 2-sided p-value of 0.086 when adjusted for traditional risk factors, BMI, and statin use; and HR=1.49 with a 2-sided p-value of 0.094 when adjusted for CHD, traditional risk factors, BMI, and statin use). All the p-values (including $P_{int}$ values) provided in Tables 22-28 are two-sided p-values.

In PROSPER, SNPs were analyzed for association with stroke risk or SSR, in the whole study cohort (strata: "ALL"), or in the subgroup with a history of CVD (strata: "hist") or without a CVD history (strata: "no hist"). SNPs were considered significantly associated with stroke risk if they met the p-value cutoffs and had the same risk allele as in antecedent studies (e.g., as described herein in Examples Four, Five, and Six), and these SNPs that are significantly associated with stroke risk are provided in Tables 29-30. Specifically, Table 29 lists SNPs associated with stroke risk that have P_all<0.2 (which is the p-value based on the entire study cohort), and Table 30 lists SNPs associated with stroke risk that have P_placebo<0.2 (which is the p-value based on just the placebo arm of the trial). For SSR, the results of the analyses of pravastatin-treated versus placebo-treated individuals are provided in Table 31 (which lists SNPs having $P_{int}$<0.1) and Table 32 (which lists SNPs having $P_{int}$<0.2). All the p-values (including $P_{int}$ values) provided in Tables 29-32 are two-sided p-values (two-sided p-value cutoffs of 0.1 and 0.2 are equivalent to one-sided p-value cutoffs of 0.05 and 0.1, respectively).

Table 30 shows that, for example, individuals in PROSPER who were A/G heterozygotes at the chromosome 9p21 SNP (rs1075727/hCV26505812) had an increased risk for stroke (HR=1.464 with a 2-sided p-value of 0.035 based on the placebo group; see the first row for rs10757274/hCV26505812 in Table 30).

Table 30 also shows that, for example, individuals in PROSPER who were T/T homozygotes at the chromosome 4q25 SNP (rs2200733/hCV16158671) had an increased risk for stroke (HR=3.711 with a 2-sided p-value of 0.025 based on the placebo group).

Also in the CARE and PROSPER trials, the chromosome 9p21 SNP rs10757274 (hCV26505812) was analyzed further for association with SSR, including unadjusted and adjusted analysis. Adjusted analysis in CARE (Table 37) was adjusted for age, gender, smoking status, hypertension, diabetes, body mass index (BMI), and LDL and HDL levels, and adjusted analysis in PROSPER (Table 38) was adjusted for country, gender, age, LDL, HDL, smoking status (current vs. past or never), history of hypertension, and diabetes. Table 37 provides results in CARE, and Table 38 provides results in PROSPER (whether each analysis is unadjusted or adjusted is indicated in the "adjust" column in Table 37, or by "unadj" and "adj" column labels in Tables 38). All the p-values (including $P_{int}$ values) provided in Tables 37-38 are two-sided p-values.

In CARE, among the three genotypes of SNP rs1075727 (homozygous carriers of each of the two alternative alleles plus heterozygous carriers), the heterozygous carriers of SNP rs10757274 (49% genotype frequency) had the greatest reduction in the number of stroke events (HR=0.61) upon pravastatin treatment after adjusting for traditional risk factors (2-sided p-value=0.034, and the genotype by treatment interaction had a 2-sided p-interaction value ("pval_intx" or $P_{int}$)=0.44; see the $13^{th}$ row under the column headings in Table 37). In PROSPER, heterozygous carriers of the G allele (risk allele) at SNP rs1075727 in the placebo arm had an increased stroke risk (for example, see the first row for rs10757274/hCV26505812 in Table 30), as indicated above. Furthermore, in PROSPER, after stratifying by rs10757274 genotype, heterozygous carriers of this SNP (51% of the population) also had the greatest reduction in the number of stroke events (unadjusted HR=0.777) in the pravastatin-treated versus the placebo-treated arms of the trial (2 sided p-value=0.066; see the 3rd row under the column headings in Table 38), whether unadjusted or adjusted for traditional risk factors.

Example Seven: SNPs Associated with Stroke in the Cardiovascular Health Study (CHS)

The identification of 61 SNPs that are associated with stroke in both of two case-control studies (Vienna Stroke Registry and the UCSF/CCF Stroke Study) is described in Example Four above. Example Five above describes the analysis of these 61 SNPs plus 17 additional SNPs in the German West Study. Here, Example Seven describes the analysis of SNPs previously found to be associated with stroke (e.g., in Examples Four, Five, and/or Six above) for association with incident stroke events in the Cardiovascular Health Study (CHS), which is a population-based study of elderly white or black participants in the United States. Association was analyzed for three related stroke end points: stroke (all subtypes) (endpoint: "stroke" in Tables 33-36), ischemic stroke (excludes hemorrhagic stroke) (endpoint: "ischem" in Tables 33-36), and atherothrombotic stroke (excludes hemorrhagic stroke and cardioembolic stroke) (endpoint: "athero" in Tables 33-36).

The results in the CHS Study are provided in Tables 33-36. Specifically, SNPs that are associated with stroke risk in white or black individuals with 2-sided p-values less than 0.1 (equivalent to 1-sided p-values less than 0.05) are provided in Table 33 (white individuals) and Table 34 (black individuals), and SNPs that are associated with stroke in white or black individuals with 2-sided p-values between 0.1 and 0.2 (equivalent to 1-sided p-values between 0.05 and 0.1) are provided in Table 35 (white individuals) and Table 36 (black individuals).

Example Eight: Additional LD SNPs Associated with Stroke

Another investigation was conducted to identify SNPs in linkage disequilibrium (LD) with certain "interrogated SNPs" which have been found to be associated with stroke, as described herein and shown in the tables. The interrogated SNPs are shown in column 1 (which indicates the hCV identification numbers of each interrogated SNP) and column 2 (which indicates the public rs identification numbers of each interrogated SNP) of Table 4. The methodology is described earlier in the instant application. To summarize briefly, the power threshold (T) was set at an appropriate level, such as 51%, for detecting disease association using LD markers. This power threshold is based on equation (31) above, which incorporates allele frequency data from previous disease association studies, the predicted error rate for not detecting truly disease-associated markers, and a significance level of 0.05. Using this power calculation and the sample size, a threshold level of LD, or $r^2$ value, was derived for each interrogated SNP ($r_T^2$, equations (32) and (33) above). The threshold value $r_T^2$ is the minimum value of linkage disequilibrium between the interrogated SNP and its LD SNPs possible such that the non-interrogated SNP still retains a power greater or equal to T for detecting disease association.

Based on the above methodology, LD SNPs were found for the interrogated SNPs. Several exemplary LD SNPs for the interrogated SNPs are listed in Table 4; each LD SNP is associated with its respective interrogated SNP. Also shown are the public SNP IDs (rs numbers) for the interrogated and LD SNPs, when available, and the threshold $r^2$ value and the power used to determine this, and the $r^2$ value of linkage disequilibrium between the interrogated SNP and its corresponding LD SNP. As an example in Table 4, the interrogated, stroke-associated SNP rs11580249 (hCV11548152) was calculated to be in LD with rs12137135 (hCV30715059) at an $r^2$ value of 0.4781, based on a 51% power calculation, thus establishing the latter SNP as a marker associated with stroke as well.

In general, the threshold $r_T^2$ value can be set such that one of ordinary skill in the art would consider that any two SNPs having an $r^2$ value greater than or equal to the threshold $r^2$ value would be in sufficient LD with each other such that either SNP is useful for the same utilities, such as determining an individual's risk for stroke. For example, in various embodiments, the threshold $r_T^2$ value used to classify SNPs as being in sufficient LD with an interrogated SNP (such that these LD SNPs can be used for the same utilities as the interrogated SNP, for example, such as determining stroke risk) can be set at, for example, 0.7, 0.75, 0.8, 0.85, 0.9, 0.95, 0.96, 0.97, 0.98, 0.99, 1, etc. (or any other $r^2$ value in-between these values). Threshold $r_T^2$ values may be utilized with or without considering power or other calculations.

All publications and patents cited in this specification are herein incorporated by reference in their entirety. Various modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 3

| Marker | Alleles | Primer 1 (Allele-specific Primer) | Primer 2 (Allele-specific Primer) | Common Primer |
|---|---|---|---|---|
| | | CD0000220RD | | |
| hCV1022614 | C/T | CTGCAGCCTCTCCTACG (SEQ ID NO: 1567) | CCTGCAGCCTCTCCTACA (SEQ ID NO: 1568) | GATTCCCCATCGGTCATAA (SEQ ID NO: 1569) |
| hCV1053082 | C/T | TTGCAGAGAAGCGTTCC (SEQ ID NO: 1570) | CTTTGCAGAGAAGCGTTCT (SEQ ID NO: 1571) | CTGAGCTTTGTGAAGAGAAACTGA (SEQ ID NO: 1572) |
| hCV1116757 | C/T | GACAAACTGAGGGACAACG (SEQ ID NO: 1573) | GACAAACTGAGGGACAACA (SEQ ID NO: 1574) | CCTCTGACAGACGCTTCTTGA (SEQ ID NO: 1575) |
| hCV1116793 | C/T | GGAAGGTCATCCTGGG (SEQ ID NO: 1576) | GGAAGGTCATCCTGGA (SEQ ID NO: 1577) | CGAAGAGTTTCTGTGTGGTACAG (SEQ ID NO: 1578) |
| hCV1354788 | C/T | TGAGACGGGTGGTAACC (SEQ ID NO: 1579) | TTGAGACGGGTGGTAACT (SEQ ID NO: 1580) | CAGCTTTGAAGGGCATCCATATGA (SEQ ID NO: 1581) |
| hCV11425801 | C/T | TCCCACACCACCTGC (SEQ ID NO: 1582) | CTCCCACACCACCTGT (SEQ ID NO: 1583) | GCCACCACATGTCTCTCAATAC (SEQ ID NO: 1584) |
| hCV11425842 | C/T | CCGTCCGCACTTAAAG (SEQ ID NO: 1585) | CCGTCCGCACTTAAAA (SEQ ID NO: 1586) | CCTGCAGTGGACAGAGACTC (SEQ ID NO: 1587) |
| hCV11450563 | G/T | TAAAGAATGCATAAATTAGTGTGG (SEQ ID NO: 1588) | TTAAAGAATGCATAAATTAGTGTGT (SEQ ID NO: 1589) | GATCCTAATTGGATTTGAAGACTTA (SEQ ID NO: 1590) |
| hCV11474611 | G/T | ATCGCCCATGTGCTG (SEQ ID NO: 1591) | CATCGCCCATGTGCTT (SEQ ID NO: 1592) | TCAAACCAGGAACCCTATCT (SEQ ID NO: 1593) |
| hCV11548152 | G/T | CTGTAAACGCTGGTCTGG (SEQ ID NO: 1594) | ACTGTAAACGCTGGTCTGT (SEQ ID NO: 1595) | CCTTGTCCCTGATTGCTTCTTCA (SEQ ID NO: 1596) |
| hCV11738775 | C/T | CCCCGCTTCAACACG (SEQ ID NO: 1597) | TCCCCGCTTCAACACA (SEQ ID NO: 1598) | AACTTCATTCGGCCACTTGCTACAA (SEQ ID NO: 1599) |
| hCV11758801 | C/G | AGTACCTCTTGGTCTCTCG (SEQ ID NO: 1600) | AGTACCTCTTGGTCTCTCC (SEQ ID NO: 1601) | GCATGTGTGTTTCTGATTGTAC (SEQ ID NO: 1602) |
| hCV1861255 | A/G | AAAGGCCGAGCTGATA (SEQ ID NO: 1603) | AGGGCCGAGCTGATG (SEQ ID NO: 1604) | GGGAGGTTTGGAGAGAGAGTAT (SEQ ID NO: 1605) |
| hCV12071939 | G/T | GACCGTGGTCCCTTG (SEQ ID NO: 1606) | TGACCGTGGTCCCTTT (SEQ ID NO: 1607) | CGCCCGGAGACAGAA (SEQ ID NO: 1608) |
| hCV1209800 | G/T | TAGCAACTGCTATCAATGACAG (SEQ ID NO: 1609) | TAGCAACTGCTATCAATGACAT (SEQ ID NO: 1610) | AGTGAAGGAGTTAACTGAGTGTGTA (SEQ ID NO: 1611) |
| hCV1262973 | A/G | TGGGTCCCAAGCTCAT (SEQ ID NO: 1612) | TGGGTCCCAAGCTCAC (SEQ ID NO: 1613) | GGCTCGCCGACACTG (SEQ ID NO: 1614) |
| hCV1305848 | A/G | ACATTTATACCATTTCCCGAGT (SEQ ID NO: 1615) | ACATTTATACCATTTCCCGAGC (SEQ ID NO: 1616) | GCCTAACAACAGTACCTACTCCATAGG (SEQ ID NO: 1617) |
| hCV1348610 | A/G | CATTTGTCCTAAAAGTACCTCTCT (SEQ ID NO: 1618) | CATTTGTCCTAAAAGTACCTCTCC (SEQ ID NO: 1619) | CAAGGCTAAGCATGCTGAACACA (SEQ ID NO: 1620) |
| hCV1408483 | C/T | TGCTAAGGCCTGTGAAC (SEQ ID NO: 1621) | TTGCTAAGGCCTGTGAAT (SEQ ID NO: 1622) | TCTGTTTTCGCTCTGGAGTCTT (SEQ ID NO: 1623) |
| hCV1452085 | A/C | ACACCCTGACACCTCTTTTACT (SEQ ID NO: 1624) | ACCCTGACACCTCTTTTACG (SEQ ID NO: 1625) | CGTTCCAGTCCATATTCACAT (SEQ ID NO: 1626) |
| hCV1463226 | C/T | ATTTCTCCCTCACATGATAC (SEQ ID NO: 1627) | ATTTCTCCCTCACATGATAT (SEQ ID NO: 1628) | TCAAAGAATGAAGAGTGAAGACA (SEQ ID NO: 1629) |
| hCV15752716 | C/T | ACGCTGCTGTTCCG (SEQ ID NO: 1630) | ACGCTGCTGTTCCA (SEQ ID NO: 1631) | CAGACAGACAACAATTCAGAAGAA (SEQ ID NO: 1632) |

TABLE 3-continued

CD000220RD

| Marker | Alleles | Primer 1 (Allele-specific Primer) | Primer 2 (Allele-specific Primer) | Common Primer |
|---|---|---|---|---|
| hCV15770510 | G/T | TGAAGACTGATTGTTGTACTTGC (SEQ ID NO: 1633) | CTGAAGACTGATTGTTGTACTTGA (SEQ ID NO: 1634) | TGGTGGAGAGGGTTGTAGAA (SEQ ID NO: 1635) |
| hCV15851766 | A/G | GAGTTTCGCCATCCACT (SEQ ID NO: 1636) | GTTTTCGCCATCCACC (SEQ ID NO: 1637) | GAATCTGCTTCATTTGAATCTCT (SEQ ID NO: 1638) |
| hCV15854171 | C/T | TTGGTGTTTCCTTGTGACAC (SEQ ID NO: 1639) | TTGGTGTTTCCTTGTGACAT (SEQ ID NO: 1640) | CCTAGTGTTTGCAATCTCATTTATC (SEQ ID NO: 1641) |
| hCV15857769 | C/T | CACTCCTAAGTGAGCAGC (SEQ ID NO: 1642) | ATCACTCCTAAGTGAGCAGT (SEQ ID NO: 1643) | CTGCTTCAGTGTTATCTCAGTCTT (SEQ ID NO: 1644) |
| hCV15879601 | C/T | CCACCAGGATGTAACAGTCC (SEQ ID NO: 1645) | CCCCACCAGGATGTAACAGTCT (SEQ ID NO: 1646) | TGTGGATGCAGCAGTGAC (SEQ ID NO: 1647) |
| hCV16093418 | A/G | CAAGAGTTCACAGCTGAAGA (SEQ ID NO: 1648) | AAGAGTTCACAGCTGAAGG (SEQ ID NO: 1649) | CCTGCTGGAGAGACAGAGTG (SEQ ID NO: 1650) |
| hCV16134786 | A/G | GGCAGGGGTGAGATTGA (SEQ ID NO: 1651) | GGCAGGGGTGAGATTGG (SEQ ID NO: 1652) | GTCGTGAGGTCAGATGCTATGAG (SEQ ID NO: 1653) |
| hCV16158671 | C/T | CTTAAATATTACCTGTTCTAATTTTCTCTG (SEQ ID NO: 1654) | CCTTAAATATTACCTGTTCTAATTTTCTCTA (SEQ ID NO: 1655) | GAAATGCTGTGGGAACATAAACTAACTAGG (SEQ ID NO: 1656) |
| hCV16164743 | NC | GAGCAATAGTAAGTATACACAATGAAATAA (SEQ ID NO: 1657) | GAGCAATAGTAAGTATACACAATGAAATAC (SEQ ID NO: 1658) | GATCACGGGCCTCTAGATTGATTACA (SEQ ID NO: 1659) |
| hCV1619596 | A/G | GAGGAGCCCGTTGCA (SEQ ID NO: 1660) | AGGGAGCCCGTTGCG (SEQ ID NO: 1661) | TCACCATGCACAAGGACA (SEQ ID NO: 1662) |
| hCV1624173 | A/G | TGGACAACAGCACCTTAT (SEQ ID NO: 1663) | TGGACAACAGCACCTTAC (SEQ ID NO: 1664) | TTCCAGAGGTTCCTTCAATC (SEQ ID NO: 1665) |
| hCV16336 | C/T | CCCCTCAAGCACTCTGAC (SEQ ID NO: 1666) | CCCCTCAAGCACTCTGAT (SEQ ID NO: 1667) | TCTGCCCCTCGTCTTTTCT (SEQ ID NO: 1668) |
| hCV1690777 | A/G | GGCTTTACAGAAGGAAATGCT (SEQ ID NO: 1669) | GCTTTACAGAAGGAAATGCC (SEQ ID NO: 1670) | GCATGCGCTGAATTTATATAG (SEQ ID NO: 1671) |
| hCV1723718 | A/G | CAGCCGTTTCTTCATATAATCCA (SEQ ID NO: 1672) | AGCCGTTTCTTCATATAATCCG (SEQ ID NO: 1673) | CTTGCTAATTCATTCTGTGACCTCAAT (SEQ ID NO: 1674) |
| hCV1746715 | A/G | GCGCCTTTCTGTGTAGTT (SEQ ID NO: 1675) | GCGCCTTTCTGTGTAGTC (SEQ ID NO: 1676) | CACAACAGTTGTTAAGTTGTTAGCAAACC (SEQ ID NO: 1677) |
| hCV1754669 | A/G | TTCAGGCCATCTTGCAAAT (SEQ ID NO: 1678) | TCAGGCCATCTTGCAAAC (SEQ ID NO: 1679) | CTCATGGCCCGATGCATTTTCAGTTA (SEQ ID NO: 1680) |
| hCV1846459 | C/T | CAGGCTCGTCTTGAACTC (SEQ ID NO: 1681) | CAGGCTCGTCTTGAACTT (SEQ ID NO: 1682) | CAAGAGTGGGAACTGCAGGTTT (SEQ ID NO: 1683) |
| hCV1958451 | G/T | GTGGGAGTCTTATGTTTGTAGATG (SEQ ID NO: 1684) | GTGGGAGTCTTATGTTTGTAGATT (SEQ ID NO: 1685) | GCTTGACAATGCGCAGTTGT (SEQ ID NO: 1686) |
| hCV2091644 | C/T | TTCTGGGGCATACAACG (SEQ ID NO: 1687) | CTTCTGGGGCATACAACA (SEQ ID NO: 1688) | AGGGACAACCCTCCATAAA (SEQ ID NO: 1689) |
| hCV2121658 | A/G | AGTGGAGATTAGCACCAGA (SEQ ID NO: 1690) | GTGGAGATTAGCACCAGG (SEQ ID NO: 1691) | GTACATTTTGGATTGGGAGGAGATAT (SEQ ID NO: 1692) |
| hCV2169762 | G/T | CGAGTCGGTCTGCGC (SEQ ID NO: 1693) | CGAGTCGGTCTGCTGA (SEQ ID NO: 1694) | TGCCTACCTCATTCCATCTG (SEQ ID NO: 1695) |

TABLE 3-continued

CD00022ORD

| Marker | Alleles | Primer 1 (Allele-specific Primer) | Primer 2 (Allele-specific Primer) | Common Primer |
|---|---|---|---|---|
| hCV2192261 | C/T | CCTACCTTGAATTCACCTATCTG (SEQ ID NO: 1696) | CCTACCTTGAATTCACCTATCTA (SEQ ID NO: 1697) | CATTTCCAAATCAGAAACATGA (SEQ ID NO: 1698) |
| hCV22275299 | C/G | GCAACTTGTTGAATGCCAG (SEQ ID NO: 1699) | GCAACTTGTTGAATGCCAC (SEQ ID NO: 1700) | GTGCTGTCACACCCAAGAAGTAC (SEQ ID NO: 1701) |
| hCV2358247 | A/G | GGTTGGGCGTAAGGGTT (SEQ ID NO: 1702) | GGTTGGGCGTAAGGGTC (SEQ ID NO: 1703) | CCCTAGCTTGCATAAATCATAC (SEQ ID NO: 1704) |
| hCV2390937 | A/C | GTGGAAATGCAAGCTCTTCA (SEQ ID NO: 1705) | TGGAAATGCAAGCTCTTCC (SEQ ID NO: 1706) | CCAGATGCTTTGGTAAAGGATTAA (SEQ ID NO: 1707) |
| hCV2442143 | C/T | ATTTAAGCATCATAGCATACCAC (SEQ ID NO: 1708) | ATTTAAGCATCATAGCATACCAT (SEQ ID NO: 1709) | TGGTACACCATAAATCTTGACTTAC (SEQ ID NO: 1710) |
| hCV25473186 | C/T | ATCTTCACAGTGTTCCACATC (SEQ ID NO: 1711) | ATCTTCACAGTGTTCCACATT (SEQ ID NO: 1712) | TTTCTGACTTCCAGGTTCTTT (SEQ ID NO: 1713) |
| hCV25596936 | C/T | GGCAGGCGAAGAGTCAC (SEQ ID NO: 1714) | GGCAGGCGAAGAGTCAT (SEQ ID NO: 1715) | GGGTCAATCCACAGTCTAGATG (SEQ ID NO: 1716) |
| hCV25609987 | A/G | TGAGCAGGTAGCCTGTATTT (SEQ ID NO: 1717) | TGAGCAGGTAGCCTGTATTC (SEQ ID NO: 1718) | TGCTGCCTTGGTTGTGA (SEQ ID NO: 1719) |
| hCV25615822 | A/G | CGGATCTTCTCCAGCG (SEQ ID NO: 1720) | CCGGATCTTCTCCAGCA (SEQ ID NO: 1721) | TGAAGCCACATCCTTCTTTAT (SEQ ID NO: 1722) |
| hCV25623804 | A/G | TTTCAAGCTGTCTCCTACCAT (SEQ ID NO: 1723) | TTTCAAGCTGTCTCCTACCAC (SEQ ID NO: 1724) | GGAGAGAAGGGAAGGACTAAAG (SEQ ID NO: 1725) |
| hCV25637605 | A/G | GCGGCTCTGCACAT (SEQ ID NO: 1726) | GCGGCTCTGCACAC (SEQ ID NO: 1727) | GCGGGTGGCTCCTTTAA (SEQ ID NO: 1728) |
| hCV25651109 | C/G | GGTCCTGCTTGATGCG (SEQ ID NO: 1729) | AGTTCCTGCTTGATGCC (SEQ ID NO: 1730) | CGACCATGGACATTCACAT (SEQ ID NO: 1731) |
| hCV25742059 | A/G | CTGCCTCTTCTGCATTAGA (SEQ ID NO: 1732) | TGCCTCTTCTGCATTAGG (SEQ ID NO: 1733) | CCTTCACTGCCTGTTCCT (SEQ ID NO: 1734) |
| hCV25924894 | A/G | GGGAAGTTCTTTCTTGTATATTCAA (SEQ ID NO: 1735) | GGGAAGTTCTTTCTTGTATATTCAG (SEQ ID NO: 1736) | TGCTGTCTTTGCCTCACTAAT (SEQ ID NO: 1737) |
| hCV25925481 | A/G | AATCAGCATTTTTGTCAAAGA (SEQ ID NO: 1738) | ATCAGCATTTTGTCAAAGG (SEQ ID NO: 1739) | GGCTTGTGACCTCATTGTT (SEQ ID NO: 1740) |
| hCV25951678 | A/G | AATGCAGCTGCTCAAAGA (SEQ ID NO: 1741) | ATGCAGCTGCTCAAAGG (SEQ ID NO: 1742) | GTTCCCGGGCTCACA (SEQ ID NO: 1743) |
| hCV25952089 | A/C | CCCTGCCTCTGTCTGACTA (SEQ ID NO: 1744) | CCCTGCCTCTGTCTGACTC (SEQ ID NO: 1745) | AAGACAAGCCCAGGTTCA (SEQ ID NO: 1746) |
| hCV25983294 | GTA | CCATCATTTACTCCTACCGC (SEQ ID NO: 1747) | CCCATCATTTACTCCTACCGT (SEQ ID NO: 1748) | GCCGAGCGGTCTGAG (SEQ ID NO: 1749) |
| hCV2637554 | C/T | ACATCCCAATAAAAGAGCAGG (SEQ ID NO: 1750) | AAACATCCCAATAAAAGAGCAGA (SEQ ID NO: 1751) | ACTTTGTTTCTTTCAGTATTATGGCAGTGG (SEQ ID NO: 1752) |
| hCV26478797 | A/G | GAAATCCTCCCACTGATGA (SEQ ID NO: 1753) | AAATCCTCCCACTGATGG (SEQ ID NO: 1754) | GCCAGATAGAATGACTTATTGTAGA (SEQ ID NO: 1755) |
| hCV26505812 | A/G | GTCAAATCTAAGCTGAGTGTTGA (SEQ ID NO: 1756) | TCAAATCTAAGCTGAGTGTTGG (SEQ ID NO: 1757) | GCTTTCCCAGATGCACTGCTATTGT (SEQ ID NO: 1758) |
| hCV26682080 | A/G | TCTCGGGTAGACCACACT (SEQ ID NO: 1759) | CTCGGGTAGACCACACC (SEQ ID NO: 1760) | GGCCCAGAGAGGTGAAGTTACT (SEQ ID NO: 1761) |

TABLE 3-continued

CD0000220RD

| Marker | Alleles | Primer 1 (Allele-specific Primer) | Primer 2 (Allele-specific Primer) | Common Primer |
|---|---|---|---|---|
| hCV26881276 | A/G | GAGTTGCTCACAAAGGCA (SEQ ID NO: 1762) | AGTTGCTCACAAAGGCG (SEQ ID NO: 1763) | GCAGCCATGTGAATAGACATAC (SEQ ID NO: 1764) |
| hCV27077072 | C/T | ATCCTGGTATGGCCCCC (SEQ ID NO: 1765) | CATCCTGGTATGGCCCT (SEQ ID NO: 1766) | GTCACACAAGCCAAGAAGAATTAGA (SEQ ID NO: 1767) |
| hCV27041051 | C/T | GCAGCCAGTTTCTCCC (SEQ ID NO: 1768) | TGCAGCCAGTTTCTCCT (SEQ ID NO: 1769) | CATGAAATGCTTCCAGGTATT (SEQ ID NO: 1770) |
| hCV27473671 | C/T | CTGACCTCCTGAATAATCCATC (SEQ ID NO: 1771) | TCTGACCTCCTGAATAATCCATT (SEQ ID NO: 1772) | CAGGGCTTCCCTAGCAGATAG (SEQ ID NO: 1773) |
| hCV27494483 | C/T | AACAGCCATTCCTTGTCC (SEQ ID NO: 1774) | GAACAGCCATTCCTTGTCT (SEQ ID NO: 1775) | CCCAAGCAGATGAAATGAGTAC (SEQ ID NO: 1776) |
| hCV27504565 | C/G | GCTCCCAACACTGGACAG (SEQ ID NO: 1777) | GCTCCCAACACTGGACAC (SEQ ID NO: 1778) | GGTGGCAGAGCTCTCCT (SEQ ID NO: 1779) |
| hCV27511436 | C/T | GGCCCCATACATTACAAC (SEQ ID NO: 1780) | GGCCCCCATACATTACAAT (SEQ ID NO: 1781) | TGGAGGAAAGTTCTGGACAGTTA (SEQ ID NO: 1782) |
| hCV27691503 | A/G | GGATTCGAGCCGACATCT (SEQ ID NO: 1783) | GATTCGAGCCGACATCC (SEQ ID NO: 1784) | TTGAGGATTAGCCTAGAACCACACA (SEQ ID NO: 1785) |
| hCV27830265 | A/G | CGACCCATGAGAGAATCAGA (SEQ ID NO: 1786) | CGACCCATGAGAGAATCAGG (SEQ ID NO: 1787) | GCAGGTCCAGCCAGTGAA (SEQ ID NO: 1788) |
| hCV27892569 | C/T | ATGTGAAATTGCATGCACTTAG (SEQ ID NO: 1789) | GTATGTGAAATTGCATGCACTTAA (SEQ ID NO: 1790) | TGTGTGTACAACACCTATACATGTGT (SEQ ID NO: 1791) |
| hCV28036404 | A/T | CATGAGACTCAACTTCTTAGGAAA (SEQ ID NO: 1792) | CATGAGACTCAACTTCTTAGGAAT (SEQ ID NO: 1793) | GCACCAGCCAAGTTTACTTTATAG (SEQ ID NO: 1794) |
| hCV2851380 | C/G | CTTGCTACCAATTCCATTTTCC (SEQ ID NO: 1795) | CTTGCTACCAATTCCATTTTCG (SEQ ID NO: 1796) | GGATCTCAGGGCCAAGTCTT (SEQ ID NO: 1797) |
| hCV2862873 | C/T | TCAACAAATGTATTGATCAGCAAAC (SEQ ID NO: 1798) | CTCAACAAATGTATTGATCAGCAAAT (SEQ ID NO: 1799) | CAGAGCAGGAGGAGTGGGATTCAT (SEQ ID NO: 1800) |
| hCV2930693 | A/C | GAAGAAGTACAACCCACAT (SEQ ID NO: 1801) | GAAGAAGTACAACCCACAG (SEQ ID NO: 1802) | GACACATGTAAGTTCCACTCATATG (SEQ ID NO: 1803) |
| hCV29401764 | C/T | AAGGTGAGCTTGCCAATC (SEQ ID NO: 1804) | AAGGTGAGCTTGCCAATT (SEQ ID NO: 1805) | CATGCGAGGAAGACACATAT (SEQ ID NO: 1806) |
| hCV29480044 | C/T | GGTGGGCCTTTTGAAATAAAC (SEQ ID NO: 1807) | TGGTGGGCCTTTTGAAATAAAT (SEQ ID NO: 1808) | CTTGAAGTGAAGGCACCTGTCAT (SEQ ID NO: 1809) |
| hCV29537898 | C/T | ACCCAGCTGTCCCTC (SEQ ID NO: 1810) | TACCACAGCTGTCCCTT (SEQ ID NO: 1811) | GCCTCCCAGTGGGAATCT (SEQ ID NO: 1812) |
| hCV29539757 | A/C | TCCAGTTAGGGATAAAGAAAGGA (SEQ ID NO: 1813) | CCAGTTAGGGATAAAGAAAGGC (SEQ ID NO: 1814) | CCAGGCTGATCTCGAACTTCT (SEQ ID NO: 1815) |
| hCV29566897 | C/T | GAAGATAGATTCTGCCAAATCATTC (SEQ ID NO: 1816) | GAAGATAGATTCTGCCAAATCATTT (SEQ ID NO: 1817) | GGTAAACTCCTGTTGCCTCAGTA (SEQ ID NO: 1818) |
| hCV2959482 | A/G | ACACCTGCGGTTAGATTGA (SEQ ID NO: 1819) | CACCTGCGGTTAGATTGG (SEQ ID NO: 1820) | CGAAGCTTCACAGATGACATC (SEQ ID NO: 1821) |
| hCV29881864 | C/G | CTTTCTTGACATCAGTGCTTC (SEQ ID NO: 1822) | CTTTCTTGACATCAGTGCTTG (SEQ ID NO: 1823) | CAAAGTTCCTCCTTTTCCTTGACTCTG (SEQ ID NO: 1824) |
| hCV302629 | A/G | AGCTGCTGCTTGCTAAATAT (SEQ ID NO: 1825) | AGCTGCTGCTTGCTAAATAC (SEQ ID NO: 1826) | CCTTGGAAAGGTCATGCTACTCATCT (SEQ ID NO: 1827) |

TABLE 3-continued

CD000220RD

| Marker | Alleles | Primer 1 (Allele-specific Primer) | Primer 2 (Allele-specific Primer) | Common Primer |
|---|---|---|---|---|
| hCV30308202 | C/G | TGGCAGGAGATGGATGTAC (SEQ ID NO: 1828) | TGGCAGGAGATGGATGTAG (SEQ ID NO: 1829) | CCAGTTACTTGACTTTGGCGTTTCT (SEQ ID NO: 1830) |
| hCV30454150 | C/T | TCTAGCAGATTTGTATCAGAACC (SEQ ID NO: 1831) | TAATCTAGCAGATTTGTATCAGAACT (SEQ ID NO: 1832) | GCGACCCTCTCTGGTTAAACA (SEQ ID NO: 1833) |
| hCV3054550 | C/T | TCCTGTCTCTGTCCCTTTC (SEQ ID NO: 1834) | ATCCTGTCTCTGTCCCTTTT (SEQ ID NO: 1835) | CGGAGTGCCCTCTTGTCT (SEQ ID NO: 1836) |
| hCV3054799 | A/G | TGACTCCCAGCATGAAT (SEQ ID NO: 1837) | TGACTCCCAGCATGAAC (SEQ ID NO: 1838) | TGGCTTATCAAGAGACATGAGA (SEQ ID NO: 1839) |
| hCV3082219 | A/G | AGAGATAGTGAAGCTTTGACA (SEQ ID NO: 1840) | GAGATAGTGAAGCTTTGACG (SEQ ID NO: 1841) | CCTGCAGCACACTTTGTAATCTAC (SEQ ID NO: 1842) |
| hCV31137507 | C/G | CCTGGGCAACAAAGTCAC (SEQ ID NO: 1843) | CCTGGGCAACAAAGTCAG (SEQ ID NO: 1844) | CAAGAATATTGGCCTGCTTCAAACTAG (SEQ ID NO: 1845) |
| hCV31227848 | C/T | CCTTGGGTAGTCCCC (SEQ ID NO: 1846) | TCCTTGGGTAGTCCCT (SEQ ID NO: 1847) | GCTGGAGTCCCACTGAGA (SEQ ID NO: 1848) |
| hCV31573621 | C/T | TGTAATTGGCCCAGAACAC (SEQ ID NO: 1849) | ATGTAATTGGCCCAGAACAT (SEQ ID NO: 1850) | CCCTTCCAGGCTTCTCTCTGAT (SEQ ID NO: 1851) |
| hCV31705214 | A/T | GTTGTGAAGAAGGATTTGTAGT (SEQ ID NO: 1852) | GTTGTGAAGAAGGATTTGTAGA (SEQ ID NO: 1853) | GCTGGAAGTTGACACTTGTTGAA (SEQ ID NO: 1854) |
| hCV3216712 | A/T | TGTGCCTTCCACATCTCA (SEQ ID NO: 1855) | TGTGCCTTCCACATCTCT (SEQ ID NO: 1856) | CAGGCTTTGGTCTGGGTTAAA (SEQ ID NO: 1857) |
| hCV3216551 | A/G | GCATACATCACATTTTCTTTACCT (SEQ ID NO: 1858) | GCATACATCACATTTTCTTTACCC (SEQ ID NO: 1859) | GTTCATTGCAGCATTTCCCAATAC (SEQ ID NO: 1860) |
| hCV323071 | A/G | AAACCAGGATATCAGAACACATTTTA (SEQ ID NO: 1861) | ACCAGGATATCAGAACACATTTTG (SEQ ID NO: 1862) | GGTCTTAGGAATATCTGACATCTT (SEQ ID NO: 1863) |
| hCV435733 | C/G | CAACTACTCGGGAGACAG (SEQ ID NO: 1864) | CAACTACTCGGGAGACAC (SEQ ID NO: 1865) | CCCTCTCAGCCCTCTCCTCCATAAAG (SEQ ID NO: 1866) |
| hCV454333 | C/T | GTATGGGCTTGAGGAAATCAT (SEQ ID NO: 1867) | GTATGGGCTTGAGGAAATCAT (SEQ ID NO: 1868) | TGCACAGATGGCTTCTGTATGT (SEQ ID NO: 1869) |
| hCV540056 | C/T | AACTACTTCTGGATGGTCAGC (SEQ ID NO: 1870) | AAACTACTTCTGGATGGTCAGT (SEQ ID NO: 1871) | GGGTCCTGCAAGTAGACACTAAG (SEQ ID NO: 1872) |
| hCV7425232 | C/T | TCAAAATTATTTCTTGCTACAGG (SEQ ID NO: 1873) | GTCAAAATTATTTCTTGCTACAGA (SEQ ID NO: 1874) | TCCCTTCCAGCCTCTCATTC (SEQ ID NO: 1875) |
| hCV7917138 | A/G | CAGTAGCAATGGTAAAGATTTGAAT (SEQ ID NO: 1876) | CAGTAGCAATGGTAAAGATTTGAAC (SEQ ID NO: 1877) | TTCCACTGTATAGACTCTCCTGTACAGAT (SEQ ID NO: 1878) |
| hCV8147903 | A/G | GGCTCTCGTGAGCA (SEQ ID NO: 1879) | GGCTCTCGTGAGCG (SEQ ID NO: 1880) | GAAGGGCACAGTGCCTTTAG (SEQ ID NO: 1881) |
| hCV8754449 | C/T | GCAGCTGAGGATTAGCAC (SEQ ID NO: 1882) | GCAGCTGAGGATTAGCAT (SEQ ID NO: 1883) | CAGAGCAAGACCCTGTCTCTAA (SEQ ID NO: 1884) |
| hCV8757333 | C/T | CGTCAGCTCCTTTGACAC (SEQ ID NO: 1885) | CGTCAGCTCCTTTGACAT (SEQ ID NO: 1886) | CCCCAGAGGGTCCAAATTCT (SEQ ID NO: 1887) |
| hCV8820007 | A/T | CTTGATAGCCTGAACCAATAA (SEQ ID NO: 1888) | CTTGATAGCCTGAACCAATAT (SEQ ID NO: 1889) | CGTGAATAGGGTCCAGAGTCTA (SEQ ID NO: 1890) |
| hCV942032 | G/G | TTTGACATGGGCAAGC (SEQ ID NO: 1891) | CTTTGGACATGGGCAAGG (SEQ ID NO: 1892) | CCCTGCATGGAAAGTAAGAAAGT (SEQ ID NO: 1893) |

TABLE 3-continued

| | | CD00022ORD | | |
|---|---|---|---|---|
| Marker | Alleles | Primer 1 (Allele-specific Primer) | Primer 2 (Allele-specific Primer) | Common Primer |
| hCV9296529 | A/G | CTCATCCTTAATATTGTTTACTTGTGAT (SEQ ID NO: 1894) | CTCATCCTTAATATTGTTTACTTGTGAC (SEQ ID NO: 1895) | CAAGACAGCCGCCTACAAGA (SEQ ID NO: 1896) |
| hCV9324316 | C/T | GCAGGGGTTTCTCACC (SEQ ID NO: 1897) | TGCAGGGGTTTCTCACT (SEQ ID NO: 1898) | CCCTCCGGCTCAATGTCA (SEQ ID NO: 1899) |
| hCV9326822 | C/T | CTCGGGACCAGTCCAG (SEQ ID NO: 1900) | CTCGGGACCAGTCCAA (SEQ ID NO: 1901) | CCGACAGCCGAGGAGA (SEQ ID NO: 1902) |
| hCV945276 | G/T | CGCCACAAACACATACCTG (SEQ ID NO: 1903) | CGCCACAAACACATACCTT (SEQ ID NO: 1904) | CCGCTGCTTGGAACAG (SEQ ID NO: 1905) |
| hCV9473891 | C/T | AGACTTTGATGCCAACGAG (SEQ ID NO: 1906) | CAGACTTTGATGCCAACGAA (SEQ ID NO: 1907) | CCAAGCACATTTATTGAGCACTCAA (SEQ ID NO: 1908) |
| hDV70959216 | G/T | CAAACAGTGATGCAAATCAATTTC (SEQ ID NO: 1909) | ACAAACAGTGATGCAAATCAATTTA (SEQ ID NO: 1910) | GAAGGGGACGAAGAAGCTAGAA (SEQ ID NO: 1911) |
| hDV77718013 | C/T | GGGACCCTATAGGAGCTTC (SEQ ID NO: 1912) | GGGACCCTATAGGAGCTTT (SEQ ID NO: 1913) | TCATTCTTGGGGAGAGGCTATTC (SEQ ID NO: 1914) |

TABLE 4

| Interrogated SNP | Interrogated rs | LD SNP | LD SNP rs | Power | Threshold $r^2$ | $r^2$ |
|---|---|---|---|---|---|---|
| hCV11548152 | rs11580249 | hCV30715059 | rs12137135 | 0.51 | 0.477953358 | 0.4781 |
| hCV11548152 | rs11580249 | hCV31574252 | rs12128312 | 0.51 | 0.477953358 | 0.6764 |
| hCV11738775 | rs6754561 | hCV27153776 | rs10164837 | 0.51 | 0.66106443 | 0.8444 |
| hCV11738775 | rs6754561 | hCV3232568 | rs3795880 | 0.51 | 0.66106443 | 0.8552 |
| hCV11758801 | rs11841997 | hCV30023295 | rs9591381 | 0.51 | 0.58648249 | 1 |
| hCV1408483 | rs17070848 | hCV1408479 | rs12961976 | 0.51 | 0.685992147 | 0.8832 |
| hCV1408483 | rs17070848 | hCV1408480 | rs11663275 | 0.51 | 0.685992147 | 0.8379 |
| hCV1408483 | rs17070848 | hCV1408481 | rs11152374 | 0.51 | 0.685992147 | 0.8946 |
| hCV1408483 | rs17070848 | hCV1408515 | rs12967026 | 0.51 | 0.685992147 | 0.7306 |
| hCV1408483 | rs17070848 | hCV29202466 | rs7234941 | 0.51 | 0.685992147 | 0.8379 |
| hCV1408483 | rs17070848 | hCV31494763 | rs7242542 | 0.51 | 0.685992147 | 0.9429 |
| hCV1408483 | rs17070848 | hCV31494861 | rs12970840 | 0.51 | 0.685992147 | 0.8379 |
| hCV15857769 | rs2924914 | hCV1379455 | rs2942805 | 0.51 | 0.948384617 | 1 |
| hCV15857769 | rs2924914 | hCV1379456 | rs2978341 | 0.51 | 0.948384617 | 1 |
| hCV15857769 | rs2924914 | hCV15857755 | rs2924920 | 0.51 | 0.948384617 | 0.9584 |
| hCV15857769 | rs2924914 | hCV15857780 | rs2924912 | 0.51 | 0.948384617 | 0.9584 |
| hCV15857769 | rs2924914 | hCV15878591 | rs2978339 | 0.51 | 0.948384617 | 0.9594 |
| hCV15857769 | rs2924914 | hCV15878604 | rs2978352 | 0.51 | 0.948384617 | 0.9594 |
| hCV15857769 | rs2924914 | hCV16167752 | rs2930285 | 0.51 | 0.948384617 | 1 |
| hCV15857769 | rs2924914 | hCV27184738 | rs2942808 | 0.51 | 0.948384617 | 1 |
| hCV15857769 | rs2924914 | hCV29765690 | rs9644266 | 0.51 | 0.948384617 | 0.9582 |
| hCV15879601 | rs2275769 | hCV11396361 | rs9370261 | 0.51 | 0.394289193 | 0.6541 |
| hCV15879601 | rs2275769 | hCV15879602 | rs2275770 | 0.51 | 0.394289193 | 1 |
| hCV15879601 | rs2275769 | hCV16113165 | rs2792634 | 0.51 | 0.394289193 | 1 |
| hCV15879601 | rs2275769 | hCV2140762 | rs2792638 | 0.51 | 0.394289193 | 1 |
| hCV15879601 | rs2275769 | hCV2140766 | rs1340667 | 0.51 | 0.394289193 | 1 |
| hCV15879601 | rs2275769 | hCV2140769 | rs1150875 | 0.51 | 0.394289193 | 1 |
| hCV15879601 | rs2275769 | hCV2140770 | rs2792635 | 0.51 | 0.394289193 | 1 |
| hCV15879601 | rs2275769 | hCV2140772 | rs11963558 | 0.51 | 0.394289193 | 1 |
| hCV15879601 | rs2275769 | hCV25929027 | rs6934690 | 0.51 | 0.394289193 | 1 |
| hCV15879601 | rs2275769 | hCV25930618 | rs10484648 | 0.51 | 0.394289193 | 1 |
| hCV15879601 | rs2275769 | hCV26548331 | rs2145761 | 0.51 | 0.394289193 | 1 |
| hCV15879601 | rs2275769 | hCV26548343 | rs2754795 | 0.51 | 0.394289193 | 1 |
| hCV15879601 | rs2275769 | hCV26548347 | rs2754798 | 0.51 | 0.394289193 | 1 |
| hCV15879601 | rs2275769 | hCV29161504 | rs6914051 | 0.51 | 0.394289193 | 0.5561 |
| hCV15879601 | rs2275769 | hCV29161551 | rs6924913 | 0.51 | 0.394289193 | 1 |
| hCV15879601 | rs2275769 | hCV29649198 | rs9885975 | 0.51 | 0.394289193 | 1 |
| hCV15879601 | rs2275769 | hCV29649199 | rs9474772 | 0.51 | 0.394289193 | 1 |
| hCV15879601 | rs2275769 | hCV29667033 | rs9474754 | 0.51 | 0.394289193 | 1 |
| hCV15879601 | rs2275769 | hCV29703373 | rs9474766 | 0.51 | 0.394289193 | 1 |
| hCV15879601 | rs2275769 | hCV29703374 | rs9283919 | 0.51 | 0.394289193 | 1 |
| hCV15879601 | rs2275769 | hCV29721486 | rs9370254 | 0.51 | 0.394289193 | 0.5549 |
| hCV15879601 | rs2275769 | hCV29721492 | rs9474762 | 0.51 | 0.394289193 | 1 |
| hCV15879601 | rs2275769 | hCV29811423 | rs10484647 | 0.51 | 0.394289193 | 1 |
| hCV15879601 | rs2275769 | hCV29902056 | rs9464034 | 0.51 | 0.394289193 | 1 |
| hCV15879601 | rs2275769 | hCV30082095 | rs9357788 | 0.51 | 0.394289193 | 0.5896 |
| hCV15879601 | rs2275769 | hCV30136287 | rs9367551 | 0.51 | 0.394289193 | 0.5567 |
| hCV15879601 | rs2275769 | hCV30154225 | rs10155669 | 0.51 | 0.394289193 | 1 |
| hCV15879601 | rs2275769 | hCV30190199 | rs9474748 | 0.51 | 0.394289193 | 0.7432 |
| hCV15879601 | rs2275769 | hCV30225881 | rs9370259 | 0.51 | 0.394289193 | 0.5567 |
| hCV15879601 | rs2275769 | hCV30225882 | rs9283918 | 0.51 | 0.394289193 | 0.5567 |
| hCV15879601 | rs2275769 | hCV30298175 | rs9382281 | 0.51 | 0.394289193 | 0.5567 |
| hCV15879601 | rs2275769 | hCV30298180 | rs10080252 | 0.51 | 0.394289193 | 1 |
| hCV15879601 | rs2275769 | hCV30370722 | rs9942457 | 0.51 | 0.394289193 | 1 |
| hCV15879601 | rs2275769 | hCV30370723 | rs9474771 | 0.51 | 0.394289193 | 1 |
| hCV15879601 | rs2275769 | hCV30388486 | rs9382285 | 0.51 | 0.394289193 | 0.6552 |
| hCV15879601 | rs2275769 | hCV30424487 | rs9296737 | 0.51 | 0.394289193 | 0.5553 |
| hCV15879601 | rs2275769 | hCV30514288 | rs10484649 | 0.51 | 0.394289193 | 1 |
| hCV15879601 | rs2275769 | hCV30586618 | rs4329099 | 0.51 | 0.394289193 | 1 |
| hCV15879601 | rs2275769 | hCV31341134 | rs10948793 | 0.51 | 0.394289193 | 0.5567 |
| hCV15879601 | rs2275769 | hCV31341182 | rs11969948 | 0.51 | 0.394289193 | 1 |
| hCV15879601 | rs2275769 | hCV31341185 | rs9474746 | 0.51 | 0.394289193 | 1 |
| hCV15879601 | rs2275769 | hCV31341188 | rs6905950 | 0.51 | 0.394289193 | 1 |
| hCV15879601 | rs2275769 | hCV31341214 | rs9474774 | 0.51 | 0.394289193 | 1 |
| hCV15879601 | rs2275769 | hCV3248104 | rs1340664 | 0.51 | 0.394289193 | 1 |
| hCV15879601 | rs2275769 | hCV3248105 | rs7751241 | 0.51 | 0.394289193 | 1 |
| hCV15879601 | rs2275769 | hCV7807314 | rs9382274 | 0.51 | 0.394289193 | 0.5564 |
| hCV15879601 | rs2275769 | hCV7807316 | rs9357783 | 0.51 | 0.394289193 | 0.5567 |
| hCV15879601 | rs2275769 | hCV7807392 | rs9349691 | 0.51 | 0.394289193 | 0.5567 |
| hCV15879601 | rs2275769 | hCV7807393 | rs9349692 | 0.51 | 0.394289193 | 0.6541 |
| hCV15879601 | rs2275769 | hCV7807402 | rs1325821 | 0.51 | 0.394289193 | 0.5567 |
| hCV15879601 | rs2275769 | hCV7807421 | rs9395899 | 0.51 | 0.394289193 | 0.7931 |
| hCV15879601 | rs2275769 | hCV7807440 | rs12662586 | 0.51 | 0.394289193 | 0.7931 |
| hCV15879601 | rs2275769 | hCV8767722 | rs1342831 | 0.51 | 0.394289193 | 1 |
| hCV15879601 | rs2275769 | hCV8768817 | rs1325833 | 0.51 | 0.394289193 | 0.5567 |
| hCV15879601 | rs2275769 | hCV8768819 | rs991199 | 0.51 | 0.394289193 | 0.5564 |
| hCV15879601 | rs2275769 | hCV8768954 | rs1150884 | 0.51 | 0.394289193 | 1 |
| hCV15879601 | rs2275769 | hCV8768992 | rs1299293 | 0.51 | 0.394289193 | 1 |

TABLE 4-continued

| Interrogated SNP | Interrogated rs | LD SNP | LD SNP rs | Power | Threshold r² | r² |
|---|---|---|---|---|---|---|
| hCV15879601 | rs2275769 | hCV8769017 | rs1150874 | 0.51 | 0.394289193 | 1 |
| hCV15879601 | rs2275769 | hCV8769025 | rs1340665 | 0.51 | 0.394289193 | 1 |
| hCV15879601 | rs2275769 | hDV70700190 | rs16869492 | 0.51 | 0.394289193 | 1 |
| hCV15879601 | rs2275769 | hDV70710884 | rs16884761 | 0.51 | 0.394289193 | 1 |
| hCV15879601 | rs2275769 | hDV70711006 | rs16884943 | 0.51 | 0.394289193 | 1 |
| hCV15879601 | rs2275769 | hDV70711009 | rs16884946 | 0.51 | 0.394289193 | 1 |
| hCV15879601 | rs2275769 | hDV70711130 | rs16885091 | 0.51 | 0.394289193 | 1 |
| hCV15879601 | rs2275769 | hDV71001425 | rs17755375 | 0.51 | 0.394289193 | 1 |
| hCV15879601 | rs2275769 | hDV77036921 | rs4715443 | 0.51 | 0.394289193 | 0.7436 |
| hCV16134786 | rs2857595 | hCV15896673 | rs2596430 | 0.51 | 0.570810789 | 0.6215 |
| hCV16134786 | rs2857595 | hCV26778946 | rs2734583 | 0.51 | 0.570810789 | 0.6706 |
| hCV16134786 | rs2857595 | hCV27300892 | rs2922994 | 0.51 | 0.570810789 | 0.6198 |
| hCV16134786 | rs2857595 | hCV27300895 | rs2156874 | 0.51 | 0.570810789 | 0.6215 |
| hCV16134786 | rs2857595 | hCV27301030 | rs2844531 | 0.51 | 0.570810789 | 0.5926 |
| hCV16134786 | rs2857595 | hCV27301032 | rs2596565 | 0.51 | 0.570810789 | 0.6215 |
| hCV16134786 | rs2857595 | hCV27452303 | rs3094005 | 0.51 | 0.570810789 | 0.6706 |
| hCV16134786 | rs2857595 | hCV27455402 | rs3099844 | 0.51 | 0.570810789 | 0.6706 |
| hCV16134786 | rs2857595 | hCV27462380 | rs3130614 | 0.51 | 0.570810789 | 0.6592 |
| hCV16134786 | rs2857595 | hCV27463679 | rs3132472 | 0.51 | 0.570810789 | 0.6706 |
| hCV16134786 | rs2857595 | hCV30109416 | rs4143332 | 0.51 | 0.570810789 | 0.6084 |
| hCV16134786 | rs2857595 | hCV30127488 | rs3132473 | 0.51 | 0.570810789 | 0.7159 |
| hCV16134786 | rs2857595 | hCV30319025 | rs3093988 | 0.51 | 0.570810789 | 0.95 |
| hCV16134786 | rs2857595 | hCV30589567 | rs3093975 | 0.51 | 0.570810789 | 0.9498 |
| hCV16134786 | rs2857595 | hCV50000055 | rs1800629 | 0.51 | 0.570810789 | 0.8562 |
| hCV16134786 | rs2857595 | hDV75435585 | rs3134792 | 0.51 | 0.570810789 | 0.6582 |
| hCV16336 | rs362277 | hCV1084102 | rs363141 | 0.51 | 0.668699498 | 0.83 |
| hCV16336 | rs362277 | hCV1084108 | rs363100 | 0.51 | 0.668699498 | 0.8413 |
| hCV16336 | rs362277 | hCV1084110 | rs363101 | 0.51 | 0.668699498 | 0.8413 |
| hCV16336 | rs362277 | hCV1084117 | rs363106 | 0.51 | 0.668699498 | 0.8413 |
| hCV16336 | rs362277 | hCV11764409 | rs6834455 | 0.51 | 0.668699498 | 0.8413 |
| hCV16336 | rs362277 | hCV11764411 | rs6843895 | 0.51 | 0.668699498 | 0.8413 |
| hCV16336 | rs362277 | hCV2229297 | rs362303 | 0.51 | 0.668699498 | 0.6732 |
| hCV16336 | rs362277 | hCV2229306 | rs362310 | 0.51 | 0.668699498 | 0.8413 |
| hCV16336 | rs362277 | hCV2231776 | rs363091 | 0.51 | 0.668699498 | 0.8413 |
| hCV16336 | rs362277 | hCV2231787 | rs363124 | 0.51 | 0.668699498 | 0.8176 |
| hCV16336 | rs362277 | hCV2231788 | rs363125 | 0.51 | 0.668699498 | 0.8413 |
| hCV16336 | rs362277 | hCV2231789 | rs363093 | 0.51 | 0.668699498 | 0.8413 |
| hCV16336 | rs362277 | hCV2231797 | rs363095 | 0.51 | 0.668699498 | 0.8023 |
| hCV16336 | rs362277 | hCV2231805 | rs363097 | 0.51 | 0.668699498 | 0.8413 |
| hCV16336 | rs362277 | hCV2231808 | rs363098 | 0.51 | 0.668699498 | 0.8413 |
| hCV16336 | rs362277 | hCV2231925 | rs362274 | 0.51 | 0.668699498 | 0.8911 |
| hCV16336 | rs362277 | hCV2231935 | rs362276 | 0.51 | 0.668699498 | 0.8413 |
| hCV16336 | rs362277 | hCV2231937 | rs362323 | 0.51 | 0.668699498 | 0.8486 |
| hCV16336 | rs362277 | hCV2231938 | rs362325 | 0.51 | 0.668699498 | 1 |
| hCV16336 | rs362277 | hCV2231953 | rs362338 | 0.51 | 0.668699498 | 0.8413 |
| hCV16336 | rs362277 | hCV2484952 | rs363094 | 0.51 | 0.668699498 | 0.8413 |
| hCV16336 | rs362277 | hCV29284939 | rs6839081 | 0.51 | 0.668699498 | 0.8413 |
| hCV16336 | rs362277 | hCV29284940 | rs6446725 | 0.51 | 0.668699498 | 0.8413 |
| hCV16336 | rs362277 | hCV29284943 | rs6839274 | 0.51 | 0.668699498 | 0.8413 |
| hCV16336 | rs362277 | hCV29726333 | rs10021254 | 0.51 | 0.668699498 | 0.8413 |
| hCV16336 | rs362277 | hCV29816351 | rs10155264 | 0.51 | 0.668699498 | 0.8413 |
| hCV16336 | rs362277 | hCV30627341 | rs10488840 | 0.51 | 0.668699498 | 0.7513 |
| hCV16336 | rs362277 | hCV31758114 | rs7688390 | 0.51 | 0.668699498 | 0.8413 |
| hCV16336 | rs362277 | hCV3266236 | rs7654034 | 0.51 | 0.668699498 | 0.8413 |
| hCV16336 | rs362277 | hCV3266250 | rs7665816 | 0.51 | 0.668699498 | 0.8413 |
| hCV16336 | rs362277 | hDV70681393 | rs16844026 | 0.51 | 0.668699498 | 0.8413 |
| hCV16336 | rs362277 | hDV70681394 | rs16844028 | 0.51 | 0.668699498 | 0.8413 |
| hCV16336 | rs362277 | hDV71057631 | rs7683309 | 0.51 | 0.668699498 | 0.8294 |
| hCV1958451 | rs2985822 | hCV11288054 | rs3008858 | 0.51 | 0.59989501 | 1 |
| hCV1958451 | rs2985822 | hCV11288055 | rs1886686 | 0.51 | 0.59989501 | 1 |
| hCV1958451 | rs2985822 | hCV11728590 | rs2065002 | 0.51 | 0.59989501 | 0.6298 |
| hCV1958451 | rs2985822 | hCV11731325 | rs1925411 | 0.51 | 0.59989501 | 1 |
| hCV1958451 | rs2985822 | hCV118052 | rs6673462 | 0.51 | 0.59989501 | 0.9559 |
| hCV1958451 | rs2985822 | hCV11863077 | rs12137403 | 0.51 | 0.59989501 | 1 |
| hCV1958451 | rs2985822 | hCV11864627 | rs4620509 | 0.51 | 0.59989501 | 1 |
| hCV1958451 | rs2985822 | hCV11864638 | rs4486425 | 0.51 | 0.59989501 | 0.6247 |
| hCV1958451 | rs2985822 | hCV12102654 | rs1925413 | 0.51 | 0.59989501 | 1 |
| hCV1958451 | rs2985822 | hCV1464018 | rs2985826 | 0.51 | 0.59989501 | 1 |
| hCV1958451 | rs2985822 | hCV1464019 | rs2985825 | 0.51 | 0.59989501 | 1 |
| hCV1958451 | rs2985822 | hCV15755638 | rs3008853 | 0.51 | 0.59989501 | 1 |
| hCV1958451 | rs2985822 | hCV15755654 | rs3008871 | 0.51 | 0.59989501 | 1 |
| hCV1958451 | rs2985822 | hCV16119992 | rs2815349 | 0.51 | 0.59989501 | 0.6298 |
| hCV1958451 | rs2985822 | hCV16120003 | rs2815359 | 0.51 | 0.59989501 | 1 |
| hCV1958451 | rs2985822 | hCV16120009 | rs2815361 | 0.51 | 0.59989501 | 1 |
| hCV1958451 | rs2985822 | hCV16120017 | rs2815370 | 0.51 | 0.59989501 | 1 |
| hCV1958451 | rs2985822 | hCV16120018 | rs2815371 | 0.51 | 0.59989501 | 1 |
| hCV1958451 | rs2985822 | hCV16186149 | rs2985797 | 0.51 | 0.59989501 | 1 |
| hCV1958451 | rs2985822 | hCV16186183 | rs2182143 | 0.51 | 0.59989501 | 1 |

TABLE 4-continued

| Interrogated SNP | Interrogated rs | LD SNP | LD SNP rs | Power | Threshold $r^2$ | $r^2$ |
| --- | --- | --- | --- | --- | --- | --- |
| hCV1958451 | rs2985822 | hCV16186204 | rs2985821 | 0.51 | 0.59989501 | 1 |
| hCV1958451 | rs2985822 | hCV16186205 | rs2985824 | 0.51 | 0.59989501 | 1 |
| hCV1958451 | rs2985822 | hCV16286251 | rs2755256 | 0.51 | 0.59989501 | 1 |
| hCV1958451 | rs2985822 | hCV1958424 | rs1925408 | 0.51 | 0.59989501 | 1 |
| hCV1958451 | rs2985822 | hCV1958425 | rs1925409 | 0.51 | 0.59989501 | 0.6298 |
| hCV1958451 | rs2985822 | hCV1958426 | rs1925410 | 0.51 | 0.59989501 | 0.6141 |
| hCV1958451 | rs2985822 | hCV1958427 | rs1118392 | 0.51 | 0.59989501 | 0.6632 |
| hCV1958451 | rs2985822 | hCV1958436 | rs3008854 | 0.51 | 0.59989501 | 1 |
| hCV1958451 | rs2985822 | hCV1958439 | rs4655658 | 0.51 | 0.59989501 | 1 |
| hCV1958451 | rs2985822 | hCV1958440 | rs3736905 | 0.51 | 0.59989501 | 0.6247 |
| hCV1958451 | rs2985822 | hCV1958441 | rs3929738 | 0.51 | 0.59989501 | 0.6298 |
| hCV1958451 | rs2985822 | hCV1958444 | rs2985818 | 0.51 | 0.59989501 | 1 |
| hCV1958451 | rs2985822 | hCV1958449 | rs1570838 | 0.51 | 0.59989501 | 0.6298 |
| hCV1958451 | rs2985822 | hCV1958456 | rs10789219 | 0.51 | 0.59989501 | 0.6298 |
| hCV1958451 | rs2985822 | hCV1958457 | rs2025608 | 0.51 | 0.59989501 | 1 |
| hCV1958451 | rs2985822 | hCV2142099 | rs2065000 | 0.51 | 0.59989501 | 1 |
| hCV1958451 | rs2985822 | hCV2142100 | rs2755253 | 0.51 | 0.59989501 | 0.9196 |
| hCV1958451 | rs2985822 | hCV2142101 | rs2755254 | 0.51 | 0.59989501 | 0.6247 |
| hCV1958451 | rs2985822 | hCV2142106 | rs2755271 | 0.51 | 0.59989501 | 0.6182 |
| hCV1958451 | rs2985822 | hCV2142112 | rs2815351 | 0.51 | 0.59989501 | 1 |
| hCV1958451 | rs2985822 | hCV2142114 | rs2755242 | 0.51 | 0.59989501 | 0.6379 |
| hCV1958451 | rs2985822 | hCV2142122 | rs2755244 | 0.51 | 0.59989501 | 1 |
| hCV1958451 | rs2985822 | hCV2142125 | rs2065001 | 0.51 | 0.59989501 | 1 |
| hCV1958451 | rs2985822 | hCV2142126 | rs2755245 | 0.51 | 0.59989501 | 1 |
| hCV1958451 | rs2985822 | hCV2142127 | rs2755246 | 0.51 | 0.59989501 | 1 |
| hCV1958451 | rs2985822 | hCV2142133 | rs2815360 | 0.51 | 0.59989501 | 0.6273 |
| hCV1958451 | rs2985822 | hCV2142134 | rs2755250 | 0.51 | 0.59989501 | 1 |
| hCV1958451 | rs2985822 | hCV2142135 | rs2755251 | 0.51 | 0.59989501 | 0.6298 |
| hCV1958451 | rs2985822 | hCV2142137 | rs2815363 | 0.51 | 0.59989501 | 0.6467 |
| hCV1958451 | rs2985822 | hCV2142138 | rs1535365 | 0.51 | 0.59989501 | 0.6298 |
| hCV1958451 | rs2985822 | hCV2142160 | rs2815380 | 0.51 | 0.59989501 | 0.7025 |
| hCV1958451 | rs2985822 | hCV2142162 | rs1024229 | 0.51 | 0.59989501 | 0.7254 |
| hCV1958451 | rs2985822 | hCV2142163 | rs1024230 | 0.51 | 0.59989501 | 0.7254 |
| hCV1958451 | rs2985822 | hCV2142165 | rs2208577 | 0.51 | 0.59989501 | 0.6618 |
| hCV1958451 | rs2985822 | hCV26465724 | rs12044278 | 0.51 | 0.59989501 | 1 |
| hCV1958451 | rs2985822 | hCV26465735 | rs12131222 | 0.51 | 0.59989501 | 1 |
| hCV1958451 | rs2985822 | hCV27868373 | rs4582760 | 0.51 | 0.59989501 | 0.6141 |
| hCV1958451 | rs2985822 | hCV27996044 | rs4655662 | 0.51 | 0.59989501 | 0.6298 |
| hCV1958451 | rs2985822 | hCV287782 | rs11208979 | 0.51 | 0.59989501 | 1 |
| hCV1958451 | rs2985822 | hCV30441499 | rs4655663 | 0.51 | 0.59989501 | 1 |
| hCV1958451 | rs2985822 | hCV3144208 | rs912797 | 0.51 | 0.59989501 | 1 |
| hCV1958451 | rs2985822 | hCV3144211 | rs2985794 | 0.51 | 0.59989501 | 1 |
| hCV1958451 | rs2985822 | hCV3144213 | rs3008873 | 0.51 | 0.59989501 | 1 |
| hCV1958451 | rs2985822 | hCV3144214 | rs2985795 | 0.51 | 0.59989501 | 1 |
| hCV1958451 | rs2985822 | hCV79872 | rs12132532 | 0.51 | 0.59989501 | 1 |
| hCV1958451 | rs2985822 | hCV92092 | rs12041926 | 0.51 | 0.59989501 | 1 |
| hCV1958451 | rs2985822 | hCV9510886 | rs1137656 | 0.51 | 0.59989501 | 1 |
| hCV1958451 | rs2985822 | hDV70961073 | rs17497828 | 0.51 | 0.59989501 | 1 |
| hCV2121658 | rs1187332 | hCV1050736 | rs726433 | 0.51 | 0.493100715 | 0.8585 |
| hCV2121658 | rs1187332 | hCV1050741 | rs1001904 | 0.51 | 0.493100715 | 0.7897 |
| hCV2121658 | rs1187332 | hCV1050742 | rs1001905 | 0.51 | 0.493100715 | 0.7897 |
| hCV2121658 | rs1187332 | hCV11868553 | rs2378669 | 0.51 | 0.493100715 | 0.914 |
| hCV2121658 | rs1187332 | hCV11930968 | rs1837305 | 0.51 | 0.493100715 | 0.7769 |
| hCV2121658 | rs1187332 | hCV16035227 | rs2579375 | 0.51 | 0.493100715 | 0.7769 |
| hCV2121658 | rs1187332 | hCV16094752 | rs2378670 | 0.51 | 0.493100715 | 1 |
| hCV2121658 | rs1187332 | hCV16094754 | rs2799484 | 0.51 | 0.493100715 | 1 |
| hCV2121658 | rs1187332 | hCV2121649 | rs17087514 | 0.51 | 0.493100715 | 1 |
| hCV2121658 | rs1187332 | hCV2121666 | rs1187326 | 0.51 | 0.493100715 | 0.5394 |
| hCV2121658 | rs1187332 | hCV26567602 | rs17087497 | 0.51 | 0.493100715 | 1 |
| hCV2121658 | rs1187332 | hCV26567643 | rs1187370 | 0.51 | 0.493100715 | 0.5824 |
| hCV2121658 | rs1187332 | hCV29169653 | rs7468983 | 0.51 | 0.493100715 | 0.8585 |
| hCV2121658 | rs1187332 | hCV29169655 | rs7045967 | 0.51 | 0.493100715 | 1 |
| hCV2121658 | rs1187332 | hCV3237574 | rs1211443 | 0.51 | 0.493100715 | 1 |
| hCV2121658 | rs1187332 | hCV3237587 | rs1187333 | 0.51 | 0.493100715 | 1 |
| hCV2121658 | rs1187332 | hCV3237592 | rs1147193 | 0.51 | 0.493100715 | 0.5562 |
| hCV2121658 | rs1187332 | hCV7423840 | rs1443441 | 0.51 | 0.493100715 | 0.5299 |
| hCV2121658 | rs1187332 | hCV7423871 | rs1209068 | 0.51 | 0.493100715 | 0.5284 |
| hCV2121658 | rs1187332 | hCV7424026 | rs1307279 | 0.51 | 0.493100715 | 0.5562 |
| hCV2121658 | rs1187332 | hCV7424033 | rs1659412 | 0.51 | 0.493100715 | 0.7897 |
| hCV2121658 | rs1187332 | hCV7424042 | rs1147198 | 0.51 | 0.493100715 | 0.5562 |
| hCV2121658 | rs1187332 | hCV7424057 | rs1147195 | 0.51 | 0.493100715 | 0.7897 |
| hCV2121658 | rs1187332 | hCV7424077 | rs1201364 | 0.51 | 0.493100715 | 0.7897 |
| hCV2121658 | rs1187332 | hCV7424082 | rs1659415 | 0.51 | 0.493100715 | 1 |
| hCV2121658 | rs1187332 | hCV7424093 | rs1147190 | 0.51 | 0.493100715 | 1 |
| hCV2121658 | rs1187332 | hCV7424099 | rs1332894 | 0.51 | 0.493100715 | 1 |
| hCV2121658 | rs1187332 | hCV7424100 | rs1332893 | 0.51 | 0.493100715 | 0.8585 |
| hCV2121658 | rs1187332 | hDV70859017 | rs17087470 | 0.51 | 0.493100715 | 0.8585 |
| hCV2121658 | rs1187332 | hDV70859019 | rs17087472 | 0.51 | 0.493100715 | 0.8585 |

TABLE 4-continued

| Interrogated SNP | Interrogated rs | LD SNP | LD SNP rs | Power | Threshold $r^2$ | $r^2$ |
| --- | --- | --- | --- | --- | --- | --- |
| hCV2121658 | rs1187332 | hDV70859037 | rs17087496 | 0.51 | 0.493100715 | 1 |
| hCV2358247 | rs415989 | hCV26338105 | rs1013561 | 0.51 | 0.799037114 | 1 |
| hCV2358247 | rs415989 | hCV29881294 | rs6073814 | 0.51 | 0.799037114 | 0.826 |
| hCV2358247 | rs415989 | hCV30007459 | rs10485460 | 0.51 | 0.799037114 | 1 |
| hCV2358247 | rs415989 | hCV7499352 | rs1516579 | 0.51 | 0.799037114 | 1 |
| hCV2358247 | rs415989 | hDV70786842 | rs16990761 | 0.51 | 0.799037114 | 1 |
| hCV2358247 | rs415989 | hDV72026194 | rs800683 | 0.51 | 0.799037114 | 1 |
| hCV2390937 | rs739719 | hCV2390936 | rs739718 | 0.51 | 0.633865259 | 1 |
| hCV25473186 | rs2880415 | hCV11313256 | rs1947069 | 0.51 | 0.877072532 | 1 |
| hCV25473186 | rs2880415 | hCV11313258 | rs1947067 | 0.51 | 0.877072532 | 1 |
| hCV25473186 | rs2880415 | hCV16209365 | rs2342652 | 0.51 | 0.877072532 | 1 |
| hCV25473186 | rs2880415 | hCV26159412 | rs2342653 | 0.51 | 0.877072532 | 1 |
| hCV25473186 | rs2880415 | hCV29013151 | rs7688639 | 0.51 | 0.877072532 | 1 |
| hCV25473186 | rs2880415 | hCV29987400 | rs4234915 | 0.51 | 0.877072532 | 1 |
| hCV25473186 | rs2880415 | hCV30852132 | rs7673498 | 0.51 | 0.877072532 | 1 |
| hCV25473186 | rs2880415 | hCV7427258 | rs1047214 | 0.51 | 0.877072532 | 1 |
| hCV25473186 | rs2880415 | hCV7428282 | rs1444792 | 0.51 | 0.877072532 | 1 |
| hCV25473186 | rs2880415 | hCV7428284 | rs1444799 | 0.51 | 0.877072532 | 1 |
| hCV25596936 | rs6967117 | hCV25596967 | rs7800549 | 0.51 | 0.9709961 | 1 |
| hCV25596936 | rs6967117 | hCV485060 | rs1804527 | 0.51 | 0.9709961 | 1 |
| hCV25983294 | rs3739709 | hCV1316797 | rs1043128 | 0.51 | 0.483483129 | 0.9447 |
| hCV25983294 | rs3739709 | hCV1316809 | rs12555590 | 0.51 | 0.483483129 | 0.8857 |
| hCV25983294 | rs3739709 | hCV27503139 | rs3936868 | 0.51 | 0.483483129 | 0.7051 |
| hCV25983294 | rs3739709 | hCV27883057 | rs4978964 | 0.51 | 0.483483129 | 0.5049 |
| hCV25983294 | rs3739709 | hCV31956059 | rs10980596 | 0.51 | 0.483483129 | 0.5434 |
| hCV25983294 | rs3739709 | hCV31956067 | rs10980602 | 0.51 | 0.483483129 | 0.6012 |
| hCV25983294 | rs3739709 | hCV31956070 | rs10980605 | 0.51 | 0.483483129 | 0.6847 |
| hCV25983294 | rs3739709 | hCV31956071 | rs10980607 | 0.51 | 0.483483129 | 0.898 |
| hCV25983294 | rs3739709 | hCV31956076 | rs10817101 | 0.51 | 0.483483129 | 0.6835 |
| hCV25983294 | rs3739709 | hCV31959065 | rs10980575 | 0.51 | 0.483483129 | 0.7051 |
| hCV25983294 | rs3739709 | hCV613577 | rs551517 | 0.51 | 0.483483129 | 0.6445 |
| hCV25983294 | rs3739709 | hCV8780367 | rs1061548 | 0.51 | 0.483483129 | 1 |
| hCV2637554 | rs3205421 | hCV11704313 | rs2041149 | 0.51 | 0.586104829 | 0.706 |
| hCV2637554 | rs3205421 | hCV11704321 | rs1811338 | 0.51 | 0.586104829 | 0.6624 |
| hCV2637554 | rs3205421 | hCV2411030 | rs741645 | 0.51 | 0.586104829 | 1 |
| hCV2637554 | rs3205421 | hCV2637556 | rs2041150 | 0.51 | 0.586104829 | 0.5966 |
| hCV2637554 | rs3205421 | hCV2637560 | rs9669539 | 0.51 | 0.586104829 | 1 |
| hCV2637554 | rs3205421 | hCV2637565 | rs10860779 | 0.51 | 0.586104829 | 1 |
| hCV2637554 | rs3205421 | hCV2637574 | rs730013 | 0.51 | 0.586104829 | 0.6624 |
| hCV2637554 | rs3205421 | hCV2637576 | rs3817305 | 0.51 | 0.586104829 | 1 |
| hCV2637554 | rs3205421 | hCV2637583 | rs4764813 | 0.51 | 0.586104829 | 1 |
| hCV2637554 | rs3205421 | hCV2637585 | rs10492085 | 0.51 | 0.586104829 | 0.6624 |
| hCV2637554 | rs3205421 | hCV27278316 | rs10778146 | 0.51 | 0.586104829 | 0.6395 |
| hCV2637554 | rs3205421 | hCV27480555 | rs3764973 | 0.51 | 0.586104829 | 0.7373 |
| hCV2637554 | rs3205421 | hCV2905213 | rs11832844 | 0.51 | 0.586104829 | 0.7378 |
| hCV2637554 | rs3205421 | hCV29407507 | rs7957655 | 0.51 | 0.586104829 | 0.6624 |
| hCV2637554 | rs3205421 | hCV29407514 | rs7960795 | 0.51 | 0.586104829 | 0.7391 |
| hCV2637554 | rs3205421 | hCV29407573 | rs7965541 | 0.51 | 0.586104829 | 0.7373 |
| hCV2637554 | rs3205421 | hCV32176762 | rs7135472 | 0.51 | 0.586104829 | 0.7602 |
| hCV2637554 | rs3205421 | hCV32176795 | rs4764814 | 0.51 | 0.586104829 | 0.6624 |
| hCV2637554 | rs3205421 | hCV8698769 | rs919214 | 0.51 | 0.586104829 | 0.6391 |
| hCV26478797 | rs2015018 | hCV2553995 | rs10057898 | 0.51 | 0.783014529 | 0.8829 |
| hCV26478797 | rs2015018 | hCV2554001 | rs6861345 | 0.51 | 0.783014529 | 0.8487 |
| hCV26478797 | rs2015018 | hCV2554006 | rs1557759 | 0.51 | 0.783014529 | 0.8487 |
| hCV26478797 | rs2015018 | hCV2557450 | rs42250 | 0.51 | 0.783014529 | 1 |
| hCV26478797 | rs2015018 | hCV29134287 | rs6878107 | 0.51 | 0.783014529 | 0.7886 |
| hCV26478797 | rs2015018 | hCV30441646 | rs6883532 | 0.51 | 0.783014529 | 0.8098 |
| hCV27473671 | rs3750465 | hCV11265714 | rs12686736 | 0.51 | 0.86047945 | 1 |
| hCV27473671 | rs3750465 | hCV15849807 | rs2900481 | 0.51 | 0.86047945 | 0.962 |
| hCV27473671 | rs3750465 | hCV15961264 | rs2271878 | 0.51 | 0.86047945 | 0.962 |
| hCV27473671 | rs3750465 | hCV1751510 | rs11789624 | 0.51 | 0.86047945 | 0.9259 |
| hCV27473671 | rs3750465 | hCV1751522 | rs11792861 | 0.51 | 0.86047945 | 0.9259 |
| hCV27473671 | rs3750465 | hCV1751524 | rs10512391 | 0.51 | 0.86047945 | 0.962 |
| hCV27473671 | rs3750465 | hCV1751537 | rs11788825 | 0.51 | 0.86047945 | 0.962 |
| hCV27473671 | rs3750465 | hCV1751538 | rs11794648 | 0.51 | 0.86047945 | 0.9259 |
| hCV27473671 | rs3750465 | hCV1751568 | rs11788904 | 0.51 | 0.86047945 | 0.9207 |
| hCV27473671 | rs3750465 | hCV1751573 | rs7870597 | 0.51 | 0.86047945 | 0.962 |
| hCV27473671 | rs3750465 | hCV25805845 | rs3750451 | 0.51 | 0.86047945 | 0.962 |
| hCV27473671 | rs3750465 | hCV27507261 | rs3829084 | 0.51 | 0.86047945 | 0.9259 |
| hCV27473671 | rs3750465 | hCV27511474 | rs3750454 | 0.51 | 0.86047945 | 0.922 |
| hCV27473671 | rs3750465 | hCV29343287 | rs7855282 | 0.51 | 0.86047945 | 0.962 |
| hCV27473671 | rs3750465 | hCV29343294 | rs7470160 | 0.51 | 0.86047945 | 0.962 |
| hCV27473671 | rs3750465 | hCV8779898 | rs1333344 | 0.51 | 0.86047945 | 0.962 |
| hCV27473671 | rs3750465 | hDV70967853 | rs17552292 | 0.51 | 0.86047945 | 1 |
| hCV27473671 | rs3750465 | hDV70979148 | rs17628095 | 0.51 | 0.86047945 | 1 |
| hCV27473671 | rs3750465 | hDV70997039 | rs17729523 | 0.51 | 0.86047945 | 0.9617 |
| hCV27473671 | rs3750465 | hDV74776655 | rs1044905 | 0.51 | 0.86047945 | 0.962 |
| hCV27494483 | rs3748743 | hCV12084456 | rs1935829 | 0.51 | 0.567281167 | 0.5874 |

TABLE 4-continued

| Interrogated SNP | Interrogated rs | LD SNP | LD SNP rs | Power | Threshold r² | r² |
|---|---|---|---|---|---|---|
| hCV27494483 | rs3748743 | hCV12085551 | rs1994830 | 0.51 | 0.567281167 | 1 |
| hCV27494483 | rs3748743 | hCV12085641 | rs699753 | 0.51 | 0.567281167 | 0.881 |
| hCV27494483 | rs3748743 | hCV12085820 | rs815124 | 0.51 | 0.567281167 | 0.881 |
| hCV27494483 | rs3748743 | hCV15752023 | rs2995522 | 0.51 | 0.567281167 | 1 |
| hCV27494483 | rs3748743 | hCV16027831 | rs2488452 | 0.51 | 0.567281167 | 1 |
| hCV27494483 | rs3748743 | hCV16052590 | rs1689088 | 0.51 | 0.567281167 | 0.881 |
| hCV27494483 | rs3748743 | hCV16250228 | rs2486081 | 0.51 | 0.567281167 | 1 |
| hCV27494483 | rs3748743 | hCV16250229 | rs2486080 | 0.51 | 0.567281167 | 0.881 |
| hCV27494483 | rs3748743 | hCV25763709 | rs2488429 | 0.51 | 0.567281167 | 1 |
| hCV27494483 | rs3748743 | hCV26680298 | rs4839049 | 0.51 | 0.567281167 | 0.7078 |
| hCV27494483 | rs3748743 | hCV26680430 | rs2488433 | 0.51 | 0.567281167 | 0.881 |
| hCV27494483 | rs3748743 | hCV26680450 | rs2488449 | 0.51 | 0.567281167 | 1 |
| hCV27494483 | rs3748743 | hCV26681176 | rs11810230 | 0.51 | 0.567281167 | 1 |
| hCV27494483 | rs3748743 | hCV29197202 | rs1775518 | 0.51 | 0.567281167 | 1 |
| hCV27494483 | rs3748743 | hCV29723037 | rs1775698 | 0.51 | 0.567281167 | 0.7927 |
| hCV27494483 | rs3748743 | hCV31476567 | rs10923675 | 0.51 | 0.567281167 | 0.6429 |
| hCV27494483 | rs3748743 | hCV31476715 | rs10923964 | 0.51 | 0.567281167 | 0.6807 |
| hCV27494483 | rs3748743 | hCV31477547 | rs10923969 | 0.51 | 0.567281167 | 1 |
| hCV27494483 | rs3748743 | hCV31477571 | rs10923965 | 0.51 | 0.567281167 | 1 |
| hCV27494483 | rs3748743 | hCV8690513 | rs1342718 | 0.51 | 0.567281167 | 1 |
| hCV27494483 | rs3748743 | hCV8690516 | rs1418656 | 0.51 | 0.567281167 | 0.8808 |
| hCV27494483 | rs3748743 | hCV8690521 | rs1767265 | 0.51 | 0.567281167 | 0.881 |
| hCV27494483 | rs3748743 | hCV8691661 | rs815105 | 0.51 | 0.567281167 | 0.881 |
| hCV27494483 | rs3748743 | hCV8691672 | rs815107 | 0.51 | 0.567281167 | 0.881 |
| hCV27494483 | rs3748743 | hCV8691697 | rs815118 | 0.51 | 0.567281167 | 0.881 |
| hCV27494483 | rs3748743 | hCV8691711 | rs1281540 | 0.51 | 0.567281167 | 0.881 |
| hCV27494483 | rs3748743 | hCV8692279 | rs1466812 | 0.51 | 0.567281167 | 0.8673 |
| hCV27494483 | rs3748743 | hCV8692280 | rs815102 | 0.51 | 0.567281167 | 0.6071 |
| hCV27494483 | rs3748743 | hCV8692287 | rs864175 | 0.51 | 0.567281167 | 0.7078 |
| hCV27494483 | rs3748743 | hCV8692304 | rs1767259 | 0.51 | 0.567281167 | 1 |
| hCV27494483 | rs3748743 | hCV8692310 | rs1775519 | 0.51 | 0.567281167 | 0.7078 |
| hCV27494483 | rs3748743 | hCV8692311 | rs1767258 | 0.51 | 0.567281167 | 0.7078 |
| hCV27494483 | rs3748743 | hCV8701061 | rs1689087 | 0.51 | 0.567281167 | 0.7498 |
| hCV27494483 | rs3748743 | hCV8701081 | rs1775702 | 0.51 | 0.567281167 | 0.881 |
| hCV27494483 | rs3748743 | hCV8701111 | rs1281693 | 0.51 | 0.567281167 | 0.642 |
| hCV27494483 | rs3748743 | hCV8701127 | rs1798109 | 0.51 | 0.567281167 | 0.881 |
| hCV27494483 | rs3748743 | hCV8701139 | rs1798110 | 0.51 | 0.567281167 | 0.881 |
| hCV27494483 | rs3748743 | hCV8701140 | rs699768 | 0.51 | 0.567281167 | 0.881 |
| hCV27494483 | rs3748743 | hCV8701141 | rs1689096 | 0.51 | 0.567281167 | 0.8808 |
| hCV27494483 | rs3748743 | hCV8701148 | rs699766 | 0.51 | 0.567281167 | 0.7917 |
| hCV27494483 | rs3748743 | hCV8701153 | rs699765 | 0.51 | 0.567281167 | 0.8668 |
| hCV27494483 | rs3748743 | hCV8701160 | rs699761 | 0.51 | 0.567281167 | 0.881 |
| hCV27494483 | rs3748743 | hCV8701179 | rs699755 | 0.51 | 0.567281167 | 0.881 |
| hCV27494483 | rs3748743 | hCV8701181 | rs699754 | 0.51 | 0.567281167 | 1 |
| hCV27494483 | rs3748743 | hCV8701183 | rs699752 | 0.51 | 0.567281167 | 0.881 |
| hCV27494483 | rs3748743 | hCV8701197 | rs699748 | 0.51 | 0.567281167 | 0.881 |
| hCV27494483 | rs3748743 | hCV8701213 | rs1342719 | 0.51 | 0.567281167 | 0.881 |
| hCV27494483 | rs3748743 | hDV70820092 | rs17034936 | 0.51 | 0.567281167 | 0.867 |
| hCV27494483 | rs3748743 | hDV70820421 | rs17035363 | 0.51 | 0.567281167 | 0.6589 |
| hCV27504565 | rs3219489 | hCV148812 | rs2153608 | 0.51 | 0.960429702 | 1 |
| hCV27504565 | rs3219489 | hCV16138635 | rs2153609 | 0.51 | 0.960429702 | 1 |
| hCV27504565 | rs3219489 | hCV16154820 | rs2185549 | 0.51 | 0.960429702 | 1 |
| hCV27504565 | rs3219489 | hCV16188158 | rs2298018 | 0.51 | 0.960429702 | 1 |
| hCV27504565 | rs3219489 | hCV27913398 | rs4660853 | 0.51 | 0.960429702 | 1 |
| hCV27504565 | rs3219489 | hCV27967653 | rs4660854 | 0.51 | 0.960429702 | 1 |
| hCV27504565 | rs3219489 | hCV27968738 | rs4660849 | 0.51 | 0.960429702 | 1 |
| hCV27504565 | rs3219489 | hCV27989232 | rs4660852 | 0.51 | 0.960429702 | 1 |
| hCV27504565 | rs3219489 | hCV29054909 | rs4520450 | 0.51 | 0.960429702 | 1 |
| hCV27504565 | rs3219489 | hCV29482894 | rs9326141 | 0.51 | 0.960429702 | 1 |
| hCV27504565 | rs3219489 | hCV29609344 | rs9429160 | 0.51 | 0.960429702 | 1 |
| hCV27504565 | rs3219489 | hCV29681797 | rs9429072 | 0.51 | 0.960429702 | 1 |
| hCV27504565 | rs3219489 | hCV29736116 | rs3219472 | 0.51 | 0.960429702 | 1 |
| hCV27504565 | rs3219489 | hCV30258653 | rs9429076 | 0.51 | 0.960429702 | 1 |
| hCV27504565 | rs3219489 | hCV30456994 | rs9429158 | 0.51 | 0.960429702 | 1 |
| hCV27504565 | rs3219489 | hCV30874754 | rs11211101 | 0.51 | 0.960429702 | 1 |
| hCV27504565 | rs3219489 | hCV32304101 | rs4660851 | 0.51 | 0.960429702 | 1 |
| hCV27504565 | rs3219489 | hCV469305 | rs7543428 | 0.51 | 0.960429702 | 1 |
| hCV27504565 | rs3219489 | hCV519782 | rs2492840 | 0.51 | 0.960429702 | 1 |
| hCV27511436 | rs3750145 | hCV106815 | rs11771236 | 0.51 | 0.469307594 | 0.555 |
| hCV27511436 | rs3750145 | hCV188768 | rs10953041 | 0.51 | 0.469307594 | 0.653 |
| hCV27511436 | rs3750145 | hCV27170501 | rs12533378 | 0.51 | 0.469307594 | 0.7892 |
| hCV27511436 | rs3750145 | hCV2835970 | rs12540728 | 0.51 | 0.469307594 | 0.764 |
| hCV27511436 | rs3750145 | hCV2835987 | rs10953044 | 0.51 | 0.469307594 | 0.8598 |
| hCV27511436 | rs3750145 | hCV29373899 | rs7781027 | 0.51 | 0.469307594 | 0.686 |
| hCV27511436 | rs3750145 | hCV32068681 | rs11761729 | 0.51 | 0.469307594 | 0.8598 |
| hCV27511436 | rs3750145 | hCV8315224 | rs1052015 | 0.51 | 0.469307594 | 0.8598 |
| hCV27511436 | rs3750145 | hDV72086373 | rs34899057 | 0.51 | 0.469307594 | 0.8598 |
| hCV2769503 | rs4787956 | hCV2769507 | rs3024685 | 0.51 | 0.516261595 | 0.7057 |

TABLE 4-continued

| Interrogated SNP | Interrogated rs | LD SNP | LD SNP rs | Power | Threshold r² | r² |
|---|---|---|---|---|---|---|
| hCV2769503 | rs4787956 | hCV8903080 | rs1029489 | 0.51 | 0.516261595 | 0.7456 |
| hCV2769503 | rs4787956 | hCV8903085 | rs8832 | 0.51 | 0.516261595 | 0.5477 |
| hCV2769503 | rs4787956 | hCV8903086 | rs1049631 | 0.51 | 0.516261595 | 0.5278 |
| hCV2769503 | rs4787956 | hDV70776992 | rs16976728 | 0.51 | 0.516261595 | 0.7051 |
| hCV27892569 | rs4903741 | hCV27198279 | rs4903749 | 0.51 | 0.955713817 | 1 |
| hCV27892569 | rs4903741 | hDV71062438 | rs8006711 | 0.51 | 0.955713817 | 1 |
| hCV2851380 | rs12445805 | hCV11667261 | rs12446178 | 0.51 | 0.45310779 | 1 |
| hCV2851380 | rs12445805 | hCV11667266 | rs12448204 | 0.51 | 0.45310779 | 1 |
| hCV2851380 | rs12445805 | hCV1565864 | rs12447158 | 0.51 | 0.45310779 | 0.6364 |
| hCV2851380 | rs12445805 | hCV26981883 | rs12447735 | 0.51 | 0.45310779 | 1 |
| hCV2851380 | rs12445805 | hCV2851355 | rs12446298 | 0.51 | 0.45310779 | 1 |
| hCV2851380 | rs12445805 | hCV2851356 | rs12449083 | 0.51 | 0.45310779 | 0.8182 |
| hCV2851380 | rs12445805 | hCV2851359 | rs12446840 | 0.51 | 0.45310779 | 1 |
| hCV2851380 | rs12445805 | hCV2851368 | rs12447812 | 0.51 | 0.45310779 | 1 |
| hCV2851380 | rs12445805 | hCV29564089 | rs9924583 | 0.51 | 0.45310779 | 0.5385 |
| hCV2851380 | rs12445805 | hCV31815677 | rs12446340 | 0.51 | 0.45310779 | 1 |
| hCV2851380 | rs12445805 | hCV31815680 | rs12448935 | 0.51 | 0.45310779 | 1 |
| hCV2851380 | rs12445805 | hCV31815681 | rs12448739 | 0.51 | 0.45310779 | 1 |
| hCV2851380 | rs12445805 | hCV31815709 | rs12927043 | 0.51 | 0.45310779 | 0.5898 |
| hCV29537898 | rs6073804 | hCV2358247 | rs415989 | 0.51 | 0.552444046 | 0.7016 |
| hCV29537898 | rs6073804 | hCV26338105 | rs1013561 | 0.51 | 0.552444046 | 0.7016 |
| hCV29537898 | rs6073804 | hCV26534413 | rs544055 | 0.51 | 0.552444046 | 0.6811 |
| hCV29537898 | rs6073804 | hCV27947632 | rs4812932 | 0.51 | 0.552444046 | 1 |
| hCV29537898 | rs6073804 | hCV27947633 | rs4812930 | 0.51 | 0.552444046 | 1 |
| hCV29537898 | rs6073804 | hCV27947636 | rs4812923 | 0.51 | 0.552444046 | 1 |
| hCV29537898 | rs6073804 | hCV29610044 | rs6073808 | 0.51 | 0.552444046 | 1 |
| hCV29537898 | rs6073804 | hCV29827054 | rs6073795 | 0.51 | 0.552444046 | 1 |
| hCV29537898 | rs6073804 | hCV29881294 | rs6073814 | 0.51 | 0.552444046 | 0.8494 |
| hCV29537898 | rs6073804 | hCV29899344 | rs4812922 | 0.51 | 0.552444046 | 1 |
| hCV29537898 | rs6073804 | hCV29935270 | rs6073796 | 0.51 | 0.552444046 | 1 |
| hCV29537898 | rs6073804 | hCV30007459 | rs10485460 | 0.51 | 0.552444046 | 0.7016 |
| hCV29537898 | rs6073804 | hCV30133494 | rs6073819 | 0.51 | 0.552444046 | 1 |
| hCV29537898 | rs6073804 | hCV30169599 | rs6073794 | 0.51 | 0.552444046 | 1 |
| hCV29537898 | rs6073804 | hCV30187505 | rs6065834 | 0.51 | 0.552444046 | 0.6134 |
| hCV29537898 | rs6073804 | hCV30241248 | rs6073789 | 0.51 | 0.552444046 | 1 |
| hCV29537898 | rs6073804 | hCV30259333 | rs10485458 | 0.51 | 0.552444046 | 1 |
| hCV29537898 | rs6073804 | hCV30259338 | rs6073797 | 0.51 | 0.552444046 | 1 |
| hCV29537898 | rs6073804 | hCV30277376 | rs6073810 | 0.51 | 0.552444046 | 1 |
| hCV29537898 | rs6073804 | hCV30349417 | rs6032347 | 0.51 | 0.552444046 | 0.6134 |
| hCV29537898 | rs6073804 | hCV30511464 | rs6073791 | 0.51 | 0.552444046 | 1 |
| hCV29537898 | rs6073804 | hCV30529696 | rs6073813 | 0.51 | 0.552444046 | 1 |
| hCV29537898 | rs6073804 | hCV30601833 | rs6073793 | 0.51 | 0.552444046 | 1 |
| hCV29537898 | rs6073804 | hCV30601834 | rs6073792 | 0.51 | 0.552444046 | 1 |
| hCV29537898 | rs6073804 | hCV7499352 | rs1516579 | 0.51 | 0.552444046 | 0.7016 |
| hCV29537898 | rs6073804 | hDV70786611 | rs16990423 | 0.51 | 0.552444046 | 1 |
| hCV29537898 | rs6073804 | hDV70786630 | rs16990452 | 0.51 | 0.552444046 | 1 |
| hCV29537898 | rs6073804 | hDV70786842 | rs16990761 | 0.51 | 0.552444046 | 0.7016 |
| hCV29537898 | rs6073804 | hDV72026194 | rs800683 | 0.51 | 0.552444046 | 0.6545 |
| hCV29539757 | rs10110659 | hCV16018696 | rs2116465 | 0.51 | 0.486011754 | 0.5448 |
| hCV29539757 | rs10110659 | hCV1894171 | rs2469505 | 0.51 | 0.486011754 | 0.5448 |
| hCV29539757 | rs10110659 | hCV1894196 | rs9642905 | 0.51 | 0.486011754 | 0.5894 |
| hCV29539757 | rs10110659 | hCV29774726 | rs10108362 | 0.51 | 0.486011754 | 0.8046 |
| hCV29539757 | rs10110659 | hCV29991301 | rs10111409 | 0.51 | 0.486011754 | 0.5523 |
| hCV29539757 | rs10110659 | hCV30513298 | rs9297840 | 0.51 | 0.486011754 | 0.8063 |
| hCV29539757 | rs10110659 | hCV31233524 | rs10956635 | 0.51 | 0.486011754 | 0.6776 |
| hCV29539757 | rs10110659 | hCV3218376 | rs959003 | 0.51 | 0.486011754 | 0.5698 |
| hCV29539757 | rs10110659 | hDV70983393 | rs17652451 | 0.51 | 0.486011754 | 1 |
| hCV302629 | rs9284183 | hCV11491432 | rs7992229 | 0.51 | 0.476125719 | 0.827 |
| hCV302629 | rs9284183 | hCV11697373 | rs7332672 | 0.51 | 0.476125719 | 0.5308 |
| hCV302629 | rs9284183 | hCV16091979 | rs2182885 | 0.51 | 0.476125719 | 0.4929 |
| hCV302629 | rs9284183 | hCV1619929 | rs9300542 | 0.51 | 0.476125719 | 0.901 |
| hCV302629 | rs9284183 | hCV1619953 | rs9517704 | 0.51 | 0.476125719 | 0.9036 |
| hCV302629 | rs9284183 | hCV1619954 | rs912130 | 0.51 | 0.476125719 | 0.9514 |
| hCV302629 | rs9284183 | hCV1619955 | rs912131 | 0.51 | 0.476125719 | 0.9036 |
| hCV302629 | rs9284183 | hCV1619962 | rs1923895 | 0.51 | 0.476125719 | 0.9512 |
| hCV302629 | rs9284183 | hCV2028227 | rs9517637 | 0.51 | 0.476125719 | 0.4953 |
| hCV302629 | rs9284183 | hCV2028228 | rs9517638 | 0.51 | 0.476125719 | 0.9512 |
| hCV302629 | rs9284183 | hCV2028233 | rs9517642 | 0.51 | 0.476125719 | 0.8581 |
| hCV302629 | rs9284183 | hCV2028235 | rs9517644 | 0.51 | 0.476125719 | 0.9514 |
| hCV302629 | rs9284183 | hCV2028239 | rs11069357 | 0.51 | 0.476125719 | 0.9473 |
| hCV302629 | rs9284183 | hCV2028241 | rs2296860 | 0.51 | 0.476125719 | 0.9514 |
| hCV302629 | rs9284183 | hCV2028245 | rs7995524 | 0.51 | 0.476125719 | 0.9496 |
| hCV302629 | rs9284183 | hCV26560448 | rs7983491 | 0.51 | 0.476125719 | 0.9514 |
| hCV302629 | rs9284183 | hCV26560464 | rs7335403 | 0.51 | 0.476125719 | 0.8573 |
| hCV302629 | rs9284183 | hCV2699349 | rs7999348 | 0.51 | 0.476125719 | 0.9041 |
| hCV302629 | rs9284183 | hCV28038226 | rs4772201 | 0.51 | 0.476125719 | 0.5153 |
| hCV302629 | rs9284183 | hCV29166806 | rs7999077 | 0.51 | 0.476125719 | 0.4956 |
| hCV302629 | rs9284183 | hCV2950553 | rs7322572 | 0.51 | 0.476125719 | 0.533 |

TABLE 4-continued

| Interrogated SNP | Interrogated rs | LD SNP | LD SNP rs | Power | Threshold $r^2$ | $r^2$ |
|---|---|---|---|---|---|---|
| hCV302629 | rs9284183 | hCV3042329 | rs4511390 | 0.51 | 0.476125719 | 0.9457 |
| hCV302629 | rs9284183 | hCV3042331 | rs2181502 | 0.51 | 0.476125719 | 0.9514 |
| hCV302629 | rs9284183 | hCV3042333 | rs9517686 | 0.51 | 0.476125719 | 1 |
| hCV302629 | rs9284183 | hCV3042336 | rs7339230 | 0.51 | 0.476125719 | 0.9514 |
| hCV302629 | rs9284183 | hCV3042337 | rs7338726 | 0.51 | 0.476125719 | 0.9514 |
| hCV302629 | rs9284183 | hCV3042339 | rs1887704 | 0.51 | 0.476125719 | 0.7119 |
| hCV302629 | rs9284183 | hCV31358927 | rs9554573 | 0.51 | 0.476125719 | 0.9514 |
| hCV302629 | rs9284183 | hCV31358982 | rs11842736 | 0.51 | 0.476125719 | 0.9465 |
| hCV302629 | rs9284183 | hCV3193760 | rs9585021 | 0.51 | 0.476125719 | 0.9514 |
| hCV302629 | rs9284183 | hCV3193775 | rs7338177 | 0.51 | 0.476125719 | 0.5308 |
| hCV302629 | rs9284183 | hCV3193777 | rs7139964 | 0.51 | 0.476125719 | 0.9514 |
| hCV302629 | rs9284183 | hCV3193779 | rs731955 | 0.51 | 0.476125719 | 0.5137 |
| hCV302629 | rs9284183 | hCV3193781 | rs984477 | 0.51 | 0.476125719 | 0.509 |
| hCV302629 | rs9284183 | hCV3193783 | rs9513584 | 0.51 | 0.476125719 | 0.8558 |
| hCV302629 | rs9284183 | hCV3193794 | rs2296911 | 0.51 | 0.476125719 | 0.9514 |
| hCV302629 | rs9284183 | hCV3193798 | rs6491493 | 0.51 | 0.476125719 | 0.9514 |
| hCV302629 | rs9284183 | hCV8698973 | rs927989 | 0.51 | 0.476125719 | 0.8886 |
| hCV302629 | rs9284183 | hDV70984009 | rs17655647 | 0.51 | 0.476125719 | 0.9512 |
| hCV30308202 | rs9482985 | hCV11200332 | rs9492268 | 0.51 | 0.712481366 | 0.7376 |
| hCV30308202 | rs9482985 | hCV11200405 | rs6569582 | 0.51 | 0.712481366 | 1 |
| hCV30308202 | rs9482985 | hCV11692112 | rs1979404 | 0.51 | 0.712481366 | 1 |
| hCV30308202 | rs9482985 | hCV15796613 | rs2448013 | 0.51 | 0.712481366 | 1 |
| hCV30308202 | rs9482985 | hCV15886692 | rs2494937 | 0.51 | 0.712481366 | 1 |
| hCV30308202 | rs9482985 | hCV15967216 | rs2279165 | 0.51 | 0.712481366 | 0.955 |
| hCV30308202 | rs9482985 | hCV16163318 | rs2219787 | 0.51 | 0.712481366 | 1 |
| hCV30308202 | rs9482985 | hCV1889342 | rs899350 | 0.51 | 0.712481366 | 1 |
| hCV30308202 | rs9482985 | hCV1889343 | rs1478800 | 0.51 | 0.712481366 | 0.7698 |
| hCV30308202 | rs9482985 | hCV1889344 | rs9492240 | 0.51 | 0.712481366 | 1 |
| hCV30308202 | rs9482985 | hCV1889345 | rs1382515 | 0.51 | 0.712481366 | 1 |
| hCV30308202 | rs9482985 | hCV1889346 | rs2448012 | 0.51 | 0.712481366 | 1 |
| hCV30308202 | rs9482985 | hCV1889347 | rs7751112 | 0.51 | 0.712481366 | 1 |
| hCV30308202 | rs9482985 | hCV1889348 | rs17056825 | 0.51 | 0.712481366 | 0.8924 |
| hCV30308202 | rs9482985 | hCV1889349 | rs9492243 | 0.51 | 0.712481366 | 1 |
| hCV30308202 | rs9482985 | hCV1889355 | rs11751534 | 0.51 | 0.712481366 | 1 |
| hCV30308202 | rs9482985 | hCV1889357 | rs11756052 | 0.51 | 0.712481366 | 0.955 |
| hCV30308202 | rs9482985 | hCV1889358 | rs11758207 | 0.51 | 0.712481366 | 1 |
| hCV30308202 | rs9482985 | hCV1889359 | rs9492248 | 0.51 | 0.712481366 | 0.9525 |
| hCV30308202 | rs9482985 | hCV1889367 | rs2876021 | 0.51 | 0.712481366 | 1 |
| hCV30308202 | rs9482985 | hCV1889371 | rs6925197 | 0.51 | 0.712481366 | 1 |
| hCV30308202 | rs9482985 | hCV1889378 | rs9492271 | 0.51 | 0.712481366 | 0.7467 |
| hCV30308202 | rs9482985 | hCV1889383 | rs265334 | 0.51 | 0.712481366 | 0.7778 |
| hCV30308202 | rs9482985 | hCV1889389 | rs265332 | 0.51 | 0.712481366 | 0.7776 |
| hCV30308202 | rs9482985 | hCV1889390 | rs265380 | 0.51 | 0.712481366 | 0.7778 |
| hCV30308202 | rs9482985 | hCV26000215 | rs17056847 | 0.51 | 0.712481366 | 0.7765 |
| hCV30308202 | rs9482985 | hCV27442718 | rs7744609 | 0.51 | 0.712481366 | 1 |
| hCV30308202 | rs9482985 | hCV27442721 | rs10499150 | 0.51 | 0.712481366 | 1 |
| hCV30308202 | rs9482985 | hCV27480203 | rs3778132 | 0.51 | 0.712481366 | 0.7698 |
| hCV30308202 | rs9482985 | hCV27480208 | rs3778137 | 0.51 | 0.712481366 | 0.7391 |
| hCV30308202 | rs9482985 | hCV27480211 | rs3778141 | 0.51 | 0.712481366 | 0.955 |
| hCV30308202 | rs9482985 | hCV27499807 | rs3778134 | 0.51 | 0.712481366 | 1 |
| hCV30308202 | rs9482985 | hCV27499808 | rs3778135 | 0.51 | 0.712481366 | 1 |
| hCV30308202 | rs9482985 | hCV29433849 | rs6569585 | 0.51 | 0.712481366 | 0.955 |
| hCV30308202 | rs9482985 | hCV29433859 | rs7756786 | 0.51 | 0.712481366 | 1 |
| hCV30308202 | rs9482985 | hCV29433860 | rs7738316 | 0.51 | 0.712481366 | 1 |
| hCV30308202 | rs9482985 | hCV29496377 | rs6569583 | 0.51 | 0.712481366 | 1 |
| hCV30308202 | rs9482985 | hCV29532686 | rs9492262 | 0.51 | 0.712481366 | 0.7698 |
| hCV30308202 | rs9482985 | hCV30020211 | rs9492237 | 0.51 | 0.712481366 | 1 |
| hCV30308202 | rs9482985 | hCV30056140 | rs7748051 | 0.51 | 0.712481366 | 1 |
| hCV30308202 | rs9482985 | hCV30092368 | rs9492241 | 0.51 | 0.712481366 | 1 |
| hCV30308202 | rs9482985 | hCV30092369 | rs6941264 | 0.51 | 0.712481366 | 1 |
| hCV30308202 | rs9482985 | hCV30110237 | rs9492245 | 0.51 | 0.712481366 | 0.955 |
| hCV30308202 | rs9482985 | hCV30128317 | rs9492253 | 0.51 | 0.712481366 | 1 |
| hCV30308202 | rs9482985 | hCV30182412 | rs9482989 | 0.51 | 0.712481366 | 0.9548 |
| hCV30308202 | rs9482985 | hCV30200320 | rs6569584 | 0.51 | 0.712481366 | 0.955 |
| hCV30308202 | rs9482985 | hCV30308200 | rs9492263 | 0.51 | 0.712481366 | 1 |
| hCV30308202 | rs9482985 | hCV30308204 | rs9492238 | 0.51 | 0.712481366 | 0.9537 |
| hCV30308202 | rs9482985 | hCV30398657 | rs9492247 | 0.51 | 0.712481366 | 0.955 |
| hCV30308202 | rs9482985 | hCV30452477 | rs9492265 | 0.51 | 0.712481366 | 1 |
| hCV30308202 | rs9482985 | hCV30470292 | rs9492234 | 0.51 | 0.712481366 | 1 |
| hCV30308202 | rs9482985 | hCV30506242 | rs9492264 | 0.51 | 0.712481366 | 1 |
| hCV30308202 | rs9482985 | hCV30560754 | rs9492254 | 0.51 | 0.712481366 | 1 |
| hCV30308202 | rs9482985 | hCV30632610 | rs7762236 | 0.51 | 0.712481366 | 1 |
| hCV30308202 | rs9482985 | hCV32245443 | rs12210504 | 0.51 | 0.712481366 | 0.7521 |
| hCV30308202 | rs9482985 | hCV32245454 | rs6569586 | 0.51 | 0.712481366 | 1 |
| hCV30308202 | rs9482985 | hCV32245465 | rs12179603 | 0.51 | 0.712481366 | 1 |
| hCV30308202 | rs9482985 | hCV8922745 | rs1478804 | 0.51 | 0.712481366 | 1 |
| hCV30308202 | rs9482985 | hCV8922746 | rs1478803 | 0.51 | 0.712481366 | 1 |
| hCV30308202 | rs9482985 | hCV8922755 | rs1478802 | 0.51 | 0.712481366 | 1 |

TABLE 4-continued

| Interrogated SNP | Interrogated rs | LD SNP | LD SNP rs | Power | Threshold r² | r² |
|---|---|---|---|---|---|---|
| hCV30308202 | rs9482985 | hCV8922768 | rs1478798 | 0.51 | 0.712481366 | 1 |
| hCV30308202 | rs9482985 | hCV8922785 | rs1478793 | 0.51 | 0.712481366 | 1 |
| hCV30308202 | rs9482985 | hCV8922791 | rs1478792 | 0.51 | 0.712481366 | 0.955 |
| hCV30308202 | rs9482985 | hCV8922793 | rs1478808 | 0.51 | 0.712481366 | 0.9509 |
| hCV30308202 | rs9482985 | hCV923718 | rs727183 | 0.51 | 0.712481366 | 1 |
| hCV30308202 | rs9482985 | hCV923730 | rs265361 | 0.51 | 0.712481366 | 0.8035 |
| hCV30308202 | rs9482985 | hCV923731 | rs265360 | 0.51 | 0.712481366 | 0.7371 |
| hCV30308202 | rs9482985 | hCV923753 | rs265382 | 0.51 | 0.712481366 | 0.7778 |
| hCV30308202 | rs9482985 | hCV923754 | rs265381 | 0.51 | 0.712481366 | 0.7778 |
| hCV30308202 | rs9482985 | hCV923758 | rs265388 | 0.51 | 0.712481366 | 0.7778 |
| hCV30308202 | rs9482985 | hCV923759 | rs265387 | 0.51 | 0.712481366 | 0.7778 |
| hCV30308202 | rs9482985 | hCV923761 | rs265385 | 0.51 | 0.712481366 | 0.7778 |
| hCV30308202 | rs9482985 | hCV923762 | rs265384 | 0.51 | 0.712481366 | 0.7778 |
| hCV30308202 | rs9482985 | hDV70836483 | rs17056909 | 0.51 | 0.712481366 | 1 |
| hCV30308202 | rs9482985 | hDV71969667 | rs7767990 | 0.51 | 0.712481366 | 0.955 |
| hCV3054550 | rs1559599 | hCV11208814 | rs4896640 | 0.51 | 0.580062034 | 0.8025 |
| hCV3054550 | rs1559599 | hCV11208823 | rs9403478 | 0.51 | 0.580062034 | 0.83 |
| hCV3054550 | rs1559599 | hCV1649763 | rs11155286 | 0.51 | 0.580062034 | 0.6394 |
| hCV3054550 | rs1559599 | hCV1649764 | rs11155287 | 0.51 | 0.580062034 | 0.6113 |
| hCV3054550 | rs1559599 | hCV1649774 | rs11754096 | 0.51 | 0.580062034 | 0.8482 |
| hCV3054550 | rs1559599 | hCV1649776 | rs4896633 | 0.51 | 0.580062034 | 0.8482 |
| hCV3054550 | rs1559599 | hCV1649777 | rs11752523 | 0.51 | 0.580062034 | 0.8482 |
| hCV3054550 | rs1559599 | hCV1649778 | rs11753048 | 0.51 | 0.580062034 | 0.8482 |
| hCV3054550 | rs1559599 | hCV1649779 | rs11755477 | 0.51 | 0.580062034 | 0.8476 |
| hCV3054550 | rs1559599 | hCV1649780 | rs4896636 | 0.51 | 0.580062034 | 0.8463 |
| hCV3054550 | rs1559599 | hCV1649781 | rs4896637 | 0.51 | 0.580062034 | 0.8482 |
| hCV3054550 | rs1559599 | hCV1649782 | rs9496565 | 0.51 | 0.580062034 | 0.8025 |
| hCV3054550 | rs1559599 | hCV1649784 | rs11753012 | 0.51 | 0.580062034 | 0.8481 |
| hCV3054550 | rs1559599 | hCV1649785 | rs967633 | 0.51 | 0.580062034 | 0.8482 |
| hCV3054550 | rs1559599 | hCV1649786 | rs9376741 | 0.51 | 0.580062034 | 0.8463 |
| hCV3054550 | rs1559599 | hCV1649787 | rs11754065 | 0.51 | 0.580062034 | 0.8482 |
| hCV3054550 | rs1559599 | hCV27888181 | rs4896650 | 0.51 | 0.580062034 | 1 |
| hCV3054550 | rs1559599 | hCV27888182 | rs4896635 | 0.51 | 0.580062034 | 0.8476 |
| hCV3054550 | rs1559599 | hCV27888183 | rs4896634 | 0.51 | 0.580062034 | 0.8476 |
| hCV3054550 | rs1559599 | hCV27888184 | rs4895606 | 0.51 | 0.580062034 | 0.8482 |
| hCV3054550 | rs1559599 | hCV27937623 | rs4895607 | 0.51 | 0.580062034 | 0.8476 |
| hCV3054550 | rs1559599 | hCV28024244 | rs4896653 | 0.51 | 0.580062034 | 0.6324 |
| hCV3054550 | rs1559599 | hCV2867272 | rs11758932 | 0.51 | 0.580062034 | 1 |
| hCV3054550 | rs1559599 | hCV29604750 | rs9390074 | 0.51 | 0.580062034 | 0.8482 |
| hCV3054550 | rs1559599 | hCV29930123 | rs9496561 | 0.51 | 0.580062034 | 0.8482 |
| hCV3054550 | rs1559599 | hCV29947932 | rs9496594 | 0.51 | 0.580062034 | 0.9498 |
| hCV3054550 | rs1559599 | hCV30146228 | rs9403485 | 0.51 | 0.580062034 | 0.9438 |
| hCV3054550 | rs1559599 | hCV30217924 | rs9399434 | 0.51 | 0.580062034 | 0.6673 |
| hCV3054550 | rs1559599 | hCV30272167 | rs9390075 | 0.51 | 0.580062034 | 0.8476 |
| hCV3054550 | rs1559599 | hCV30344162 | rs9390076 | 0.51 | 0.580062034 | 0.8482 |
| hCV3054550 | rs1559599 | hCV30398541 | rs9285499 | 0.51 | 0.580062034 | 0.6394 |
| hCV3054550 | rs1559599 | hCV30524360 | rs9403486 | 0.51 | 0.580062034 | 0.9498 |
| hCV3054550 | rs1559599 | hCV3054531 | rs6937858 | 0.51 | 0.580062034 | 0.894 |
| hCV3054550 | rs1559599 | hCV3054542 | rs9399439 | 0.51 | 0.580062034 | 1 |
| hCV3054550 | rs1559599 | hCV3054556 | rs11751030 | 0.51 | 0.580062034 | 1 |
| hCV3054550 | rs1559599 | hCV32241095 | rs11757293 | 0.51 | 0.580062034 | 1 |
| hCV3054550 | rs1559599 | hCV32241106 | rs11753058 | 0.51 | 0.580062034 | 0.8737 |
| hCV3054550 | rs1559599 | hCV32404557 | rs4896632 | 0.51 | 0.580062034 | 0.8482 |
| hCV3054550 | rs1559599 | hCV7576514 | rs9908 | 0.51 | 0.580062034 | 0.95 |
| hCV3054550 | rs1559599 | hCV9783869 | rs4896639 | 0.51 | 0.580062034 | 0.8476 |
| hCV3082219 | rs1884833 | hCV1781515 | rs13218371 | 0.51 | 0.822864328 | 1 |
| hCV3082219 | rs1884833 | hCV1802750 | rs13213246 | 0.51 | 0.822864328 | 0.9393 |
| hCV3082219 | rs1884833 | hCV1802756 | rs13216434 | 0.51 | 0.822864328 | 1 |
| hCV3082219 | rs1884833 | hCV3082214 | rs17208849 | 0.51 | 0.822864328 | 1 |
| hCV3082219 | rs1884833 | hCV3082227 | rs2180621 | 0.51 | 0.822864328 | 1 |
| hCV31137507 | rs7660668 | hCV11746020 | rs1979605 | 0.51 | 0.891437139 | 1 |
| hCV31137507 | rs7660668 | hCV11746021 | rs1979604 | 0.51 | 0.891437139 | 1 |
| hCV31137507 | rs7660668 | hCV15809632 | rs2101476 | 0.51 | 0.891437139 | 1 |
| hCV31137507 | rs7660668 | hCV16072560 | rs2130040 | 0.51 | 0.891437139 | 1 |
| hCV31137507 | rs7660668 | hCV26406027 | rs4336288 | 0.51 | 0.891437139 | 1 |
| hCV31137507 | rs7660668 | hCV27941642 | rs4865012 | 0.51 | 0.891437139 | 1 |
| hCV31137507 | rs7660668 | hCV29101714 | rs6851971 | 0.51 | 0.891437139 | 1 |
| hCV31137507 | rs7660668 | hCV29101718 | rs7665846 | 0.51 | 0.891437139 | 1 |
| hCV31137507 | rs7660668 | hCV29882171 | rs9993599 | 0.51 | 0.891437139 | 1 |
| hCV31137507 | rs7660668 | hCV30440588 | rs6554291 | 0.51 | 0.891437139 | 1 |
| hCV31137507 | rs7660668 | hCV30494157 | rs10012559 | 0.51 | 0.891437139 | 1 |
| hCV31137507 | rs7660668 | hCV31137533 | rs6853506 | 0.51 | 0.891437139 | 1 |
| hCV31137507 | rs7660668 | hCV31137546 | rs11732481 | 0.51 | 0.891437139 | 0.9502 |
| hCV31137507 | rs7660668 | hCV31137548 | rs6554290 | 0.51 | 0.891437139 | 0.9594 |
| hCV31137507 | rs7660668 | hCV31137562 | rs6830728 | 0.51 | 0.891437139 | 1 |
| hCV31137507 | rs7660668 | hCV31137564 | rs6842960 | 0.51 | 0.891437139 | 0.9183 |
| hCV31137507 | rs7660668 | hCV769774 | rs550144 | 0.51 | 0.891437139 | 1 |
| hCV31137507 | rs7660668 | hCV8746676 | rs880358 | 0.51 | 0.891437139 | 1 |

TABLE 4-continued

| Interrogated SNP | Interrogated rs | LD SNP | LD SNP rs | Power | Threshold r² | r² |
|---|---|---|---|---|---|---|
| hCV31137507 | rs7660668 | hCV8746701 | rs6802 | 0.51 | 0.891437139 | 1 |
| hCV31137507 | rs7660668 | hCV8746719 | rs1801260 | 0.51 | 0.891437139 | 1 |
| hCV31137507 | rs7660668 | hCV8746730 | rs11240 | 0.51 | 0.891437139 | 1 |
| hCV31137507 | rs7660668 | hCV8746755 | rs1021307 | 0.51 | 0.891437139 | 1 |
| hCV31137507 | rs7660668 | hCV8746756 | rs1021306 | 0.51 | 0.891437139 | 1 |
| hCV31137507 | rs7660668 | hCV8746776 | rs972446 | 0.51 | 0.891437139 | 1 |
| hCV31137507 | rs7660668 | hDV70995909 | rs17722979 | 0.51 | 0.891437139 | 1 |
| hCV31137507 | rs7660668 | hDV71005355 | rs17776975 | 0.51 | 0.891437139 | 1 |
| hCV31137507 | rs7660668 | hDV71953492 | rs7698022 | 0.51 | 0.891437139 | 1 |
| hCV31137507 | rs7660668 | hDV75174888 | rs17721497 | 0.51 | 0.891437139 | 1 |
| hCV31137507 | rs7660668 | hDV75209995 | rs2070062 | 0.51 | 0.891437139 | 1 |
| hCV31227848 | rs11809423 | hCV11874240 | rs12731266 | 0.51 | 0.290800579 | 0.2996 |
| hCV31227848 | rs11809423 | hCV15842490 | rs2181276 | 0.51 | 0.290800579 | 0.355 |
| hCV31227848 | rs11809423 | hCV1654102 | rs12740722 | 0.51 | 0.290800579 | 0.2996 |
| hCV31227848 | rs11809423 | hCV3056582 | rs12757352 | 0.51 | 0.290800579 | 0.2996 |
| hCV31227848 | rs11809423 | hDV70662612 | rs17363472 | 0.51 | 0.290800579 | 0.2988 |
| hCV31227848 | rs11809423 | hDV71039510 | rs6600383 | 0.51 | 0.290800579 | 0.2996 |
| hCV31705214 | rs12804599 | hCV107313 | rs10833000 | 0.51 | 0.618581044 | 0.8531 |
| hCV31705214 | rs12804599 | hCV11594063 | rs11024880 | 0.51 | 0.618581044 | 0.7562 |
| hCV31705214 | rs12804599 | hCV1950266 | rs11024863 | 0.51 | 0.618581044 | 1 |
| hCV31705214 | rs12804599 | hCV1950274 | rs10833015 | 0.51 | 0.618581044 | 1 |
| hCV31705214 | rs12804599 | hCV1950287 | rs12787111 | 0.51 | 0.618581044 | 1 |
| hCV31705214 | rs12804599 | hCV29267415 | rs7948997 | 0.51 | 0.618581044 | 0.8406 |
| hCV31705214 | rs12804599 | hCV31705227 | rs11024850 | 0.51 | 0.618581044 | 1 |
| hCV31705214 | rs12804599 | hCV31705248 | rs7931749 | 0.51 | 0.618581044 | 0.8479 |
| hCV31705214 | rs12804599 | hDV74880995 | rs10832987 | 0.51 | 0.618581044 | 0.6552 |
| hCV31705214 | rs12804599 | hDV74888902 | rs11024797 | 0.51 | 0.618581044 | 0.8369 |
| hCV31705214 | rs12804599 | hDV75065597 | rs12275926 | 0.51 | 0.618581044 | 0.8191 |
| hCV32160712 | rs11079160 | hCV11616144 | rs11656978 | 0.51 | 0.436836227 | 0.6753 |
| hCV32160712 | rs11079160 | hCV1388786 | rs11079157 | 0.51 | 0.436836227 | 0.6444 |
| hCV32160712 | rs11079160 | hCV1388790 | rs955734 | 0.51 | 0.436836227 | 0.5822 |
| hCV32160712 | rs11079160 | hCV1388795 | rs11651545 | 0.51 | 0.436836227 | 0.7495 |
| hCV32160712 | rs11079160 | hCV1388815 | rs12453442 | 0.51 | 0.436836227 | 0.7267 |
| hCV32160712 | rs11079160 | hCV1388823 | rs9895713 | 0.51 | 0.436836227 | 0.8877 |
| hCV32160712 | rs11079160 | hCV1388832 | rs12453544 | 0.51 | 0.436836227 | 0.8868 |
| hCV32160712 | rs11079160 | hCV27267033 | rs11079158 | 0.51 | 0.436836227 | 0.5822 |
| hCV32160712 | rs11079160 | hCV29495159 | rs9903045 | 0.51 | 0.436836227 | 1 |
| hCV32160712 | rs11079160 | hCV30379482 | rs9895210 | 0.51 | 0.436836227 | 0.8507 |
| hCV32160712 | rs11079160 | hCV32160720 | rs11656169 | 0.51 | 0.436836227 | 0.5822 |
| hCV32160712 | rs11079160 | hCV32160723 | rs11654125 | 0.51 | 0.436836227 | 0.6208 |
| hCV32160712 | rs11079160 | hCV7595955 | rs1465353 | 0.51 | 0.436836227 | 0.7565 |
| hCV32160712 | rs11079160 | hCV7595964 | rs2010671 | 0.51 | 0.436836227 | 1 |
| hCV32160712 | rs11079160 | hCV8675361 | rs7223639 | 0.51 | 0.436836227 | 0.5555 |
| hCV32160712 | rs11079160 | hDV70999843 | rs17746075 | 0.51 | 0.436836227 | 0.942 |
| hCV32160712 | rs11079160 | hDV70999855 | rs17746146 | 0.51 | 0.436836227 | 1 |
| hCV32160712 | rs11079160 | hDV71012207 | rs17818816 | 0.51 | 0.436836227 | 1 |
| hCV454333 | rs10916581 | hCV31711080 | rs10916583 | 0.51 | 0.908108083 | 1 |
| hCV540056 | rs346802 | hCV31556699 | rs12165049 | 0.51 | 0.491985177 | 1 |
| hCV540056 | rs346802 | hCV540057 | rs346801 | 0.51 | 0.491985177 | 1 |
| hCV540056 | rs346802 | hCV540061 | rs346816 | 0.51 | 0.491985177 | 1 |
| hCV540056 | rs346802 | hCV540062 | rs346817 | 0.51 | 0.491985177 | 1 |
| hCV540056 | rs346802 | hCV540063 | rs453116 | 0.51 | 0.491985177 | 1 |
| hCV540056 | rs346802 | hCV540071 | rs443112 | 0.51 | 0.491985177 | 1 |
| hCV540056 | rs346802 | hCV540074 | rs369654 | 0.51 | 0.491985177 | 0.8251 |
| hCV540056 | rs346802 | hCV7446926 | rs495055 | 0.51 | 0.491985177 | 0.6606 |
| hCV7917138 | rs9822460 | hCV11538341 | rs9848015 | 0.51 | 0.404318811 | 0.4871 |
| hCV7917138 | rs9822460 | hCV11538354 | rs11708509 | 0.51 | 0.404318811 | 0.9027 |
| hCV7917138 | rs9822460 | hCV11556848 | rs4857380 | 0.51 | 0.404318811 | 0.9027 |
| hCV7917138 | rs9822460 | hCV130955 | rs9862953 | 0.51 | 0.404318811 | 0.5658 |
| hCV7917138 | rs9822460 | hCV159392 | rs1497530 | 0.51 | 0.404318811 | 1 |
| hCV7917138 | rs9822460 | hCV246831 | rs7640341 | 0.51 | 0.404318811 | 0.6769 |
| hCV7917138 | rs9822460 | hCV246832 | rs7640257 | 0.51 | 0.404318811 | 0.6769 |
| hCV7917138 | rs9822460 | hCV26005059 | rs13093620 | 0.51 | 0.404318811 | 0.6769 |
| hCV7917138 | rs9822460 | hCV26008835 | rs9821488 | 0.51 | 0.404318811 | 0.4212 |
| hCV7917138 | rs9822460 | hCV26158969 | rs4630981 | 0.51 | 0.404318811 | 1 |
| hCV7917138 | rs9822460 | hCV26158970 | rs7616504 | 0.51 | 0.404318811 | 0.4212 |
| hCV7917138 | rs9822460 | hCV26922520 | rs9869161 | 0.51 | 0.404318811 | 0.5455 |
| hCV7917138 | rs9822460 | hCV26922587 | rs13069360 | 0.51 | 0.404318811 | 0.9026 |
| hCV7917138 | rs9822460 | hCV26922590 | rs7646920 | 0.51 | 0.404318811 | 0.6769 |
| hCV7917138 | rs9822460 | hCV29281482 | rs6439825 | 0.51 | 0.404318811 | 0.6202 |
| hCV7917138 | rs9822460 | hCV29644396 | rs9877169 | 0.51 | 0.404318811 | 0.4212 |
| hCV7917138 | rs9822460 | hCV30212818 | rs9826529 | 0.51 | 0.404318811 | 0.6346 |
| hCV7917138 | rs9822460 | hCV30320887 | rs9289589 | 0.51 | 0.404318811 | 0.6346 |
| hCV7917138 | rs9822460 | hCV362321 | rs9847827 | 0.51 | 0.404318811 | 0.4777 |
| hCV7917138 | rs9822460 | hCV362323 | rs13068323 | 0.51 | 0.404318811 | 0.5932 |
| hCV7917138 | rs9822460 | hCV362326 | rs9289587 | 0.51 | 0.404318811 | 0.9027 |
| hCV7917138 | rs9822460 | hCV362328 | rs6799469 | 0.51 | 0.404318811 | 0.9027 |
| hCV7917138 | rs9822460 | hCV362329 | rs9844815 | 0.51 | 0.404318811 | 0.9027 |

TABLE 4-continued

| Interrogated SNP | Interrogated rs | LD SNP | LD SNP rs | Power | Threshold $r^2$ | $r^2$ |
|---|---|---|---|---|---|---|
| hCV7917138 | rs9822460 | hCV362331 | rs13086478 | 0.51 | 0.404318811 | 0.6305 |
| hCV7917138 | rs9822460 | hCV362335 | rs6439823 | 0.51 | 0.404318811 | 0.6769 |
| hCV7917138 | rs9822460 | hCV362337 | rs7630351 | 0.51 | 0.404318811 | 0.6769 |
| hCV7917138 | rs9822460 | hCV50572 | rs11721164 | 0.51 | 0.404318811 | 0.5526 |
| hCV7917138 | rs9822460 | hCV50573 | rs10433345 | 0.51 | 0.404318811 | 0.5526 |
| hCV7917138 | rs9822460 | hCV7917329 | rs904143 | 0.51 | 0.404318811 | 0.6276 |
| hCV7917138 | rs9822460 | hDV77184830 | rs6796827 | 0.51 | 0.404318811 | 0.6769 |
| hCV7917138 | rs9822460 | hDV77231044 | rs7638805 | 0.51 | 0.404318811 | 0.6769 |
| hCV8147903 | rs680014 | hCV11785233 | rs2460397 | 0.51 | 0.400661237 | 1 |
| hCV8147903 | rs680014 | hCV11788458 | rs2460386 | 0.51 | 0.400661237 | 1 |
| hCV8147903 | rs680014 | hCV11788468 | rs553352 | 0.51 | 0.400661237 | 1 |
| hCV8147903 | rs680014 | hCV11788533 | rs4799084 | 0.51 | 0.400661237 | 0.6566 |
| hCV8147903 | rs680014 | hCV12091565 | rs629084 | 0.51 | 0.400661237 | 0.5434 |
| hCV8147903 | rs680014 | hCV1731571 | rs580675 | 0.51 | 0.400661237 | 1 |
| hCV8147903 | rs680014 | hCV26871521 | rs12605631 | 0.51 | 0.400661237 | 1 |
| hCV8147903 | rs680014 | hCV2744994 | rs2510276 | 0.51 | 0.400661237 | 1 |
| hCV8147903 | rs680014 | hCV2745000 | rs2680752 | 0.51 | 0.400661237 | 1 |
| hCV8147903 | rs680014 | hCV2745001 | rs1788659 | 0.51 | 0.400661237 | 1 |
| hCV8147903 | rs680014 | hCV27516223 | rs3786238 | 0.51 | 0.400661237 | 0.7292 |
| hCV8147903 | rs680014 | hCV27877725 | rs4799077 | 0.51 | 0.400661237 | 0.8788 |
| hCV8147903 | rs680014 | hCV29779584 | rs4799081 | 0.51 | 0.400661237 | 0.9183 |
| hCV8147903 | rs680014 | hCV3068685 | rs3859321 | 0.51 | 0.400661237 | 0.7991 |
| hCV8147903 | rs680014 | hCV3068718 | rs673590 | 0.51 | 0.400661237 | 1 |
| hCV8147903 | rs680014 | hCV3068726 | rs685665 | 0.51 | 0.400661237 | 1 |
| hCV8147903 | rs680014 | hCV3068731 | rs522723 | 0.51 | 0.400661237 | 0.9587 |
| hCV8147903 | rs680014 | hCV3068735 | rs517479 | 0.51 | 0.400661237 | 1 |
| hCV8147903 | rs680014 | hCV3068736 | rs485400 | 0.51 | 0.400661237 | 1 |
| hCV8147903 | rs680014 | hCV3068738 | rs503615 | 0.51 | 0.400661237 | 1 |
| hCV8147903 | rs680014 | hCV3068739 | rs603957 | 0.51 | 0.400661237 | 1 |
| hCV8147903 | rs680014 | hCV3068757 | rs3826573 | 0.51 | 0.400661237 | 0.4225 |
| hCV8147903 | rs680014 | hCV3068760 | rs585571 | 0.51 | 0.400661237 | 0.8509 |
| hCV8147903 | rs680014 | hCV805999 | rs649763 | 0.51 | 0.400661237 | 1 |
| hCV8147903 | rs680014 | hCV806002 | rs681631 | 0.51 | 0.400661237 | 1 |
| hCV8147903 | rs680014 | hCV806008 | rs655609 | 0.51 | 0.400661237 | 0.8402 |
| hCV8147903 | rs680014 | hCV806012 | rs671424 | 0.51 | 0.400661237 | 0.4335 |
| hCV8147903 | rs680014 | hCV806021 | rs618342 | 0.51 | 0.400661237 | 0.4335 |
| hCV8147903 | rs680014 | hCV8155000 | rs605183 | 0.51 | 0.400661237 | 1 |
| hCV8147903 | rs680014 | hCV8155010 | rs570029 | 0.51 | 0.400661237 | 1 |
| hCV8147903 | rs680014 | hCV8155011 | rs589394 | 0.51 | 0.400661237 | 1 |
| hCV8147903 | rs680014 | hCV8831345 | rs529195 | 0.51 | 0.400661237 | 1 |
| hCV8147903 | rs680014 | hCV8831346 | rs1239783 | 0.51 | 0.400661237 | 1 |
| hCV8147903 | rs680014 | hCV8831352 | rs500795 | 0.51 | 0.400661237 | 0.4335 |
| hCV8942032 | rs1264352 | hCV11196362 | rs3129820 | 0.51 | 0.674510346 | 0.6961 |
| hCV8942032 | rs1264352 | hCV11690723 | rs886424 | 0.51 | 0.674510346 | 0.9461 |
| hCV8942032 | rs1264352 | hCV15885725 | rs2532923 | 0.51 | 0.674510346 | 0.8224 |
| hCV8942032 | rs1264352 | hCV15947385 | rs2233980 | 0.51 | 0.674510346 | 0.7828 |
| hCV8942032 | rs1264352 | hCV16027870 | rs2517578 | 0.51 | 0.674510346 | 0.8297 |
| hCV8942032 | rs1264352 | hCV2437063 | rs3131060 | 0.51 | 0.674510346 | 0.9468 |
| hCV8942032 | rs1264352 | hCV2437065 | rs3129985 | 0.51 | 0.674510346 | 0.9468 |
| hCV8942032 | rs1264352 | hCV2437122 | rs3095337 | 0.51 | 0.674510346 | 0.7947 |
| hCV8942032 | rs1264352 | hCV2437158 | rs2284174 | 0.51 | 0.674510346 | 0.8428 |
| hCV8942032 | rs1264352 | hCV2452431 | rs3132625 | 0.51 | 0.674510346 | 0.6845 |
| hCV8942032 | rs1264352 | hCV25606044 | rs7750641 | 0.51 | 0.674510346 | 0.6923 |
| hCV8942032 | rs1264352 | hCV25606244 | rs3130247 | 0.51 | 0.674510346 | 0.7442 |
| hCV8942032 | rs1264352 | hCV25966128 | rs9262135 | 0.51 | 0.674510346 | 0.7934 |
| hCV8942032 | rs1264352 | hCV26544258 | rs1634726 | 0.51 | 0.674510346 | 0.7745 |
| hCV8942032 | rs1264352 | hCV26546104 | rs8233 | 0.51 | 0.674510346 | 0.7955 |
| hCV8942032 | rs1264352 | hCV26546345 | rs2535332 | 0.51 | 0.674510346 | 0.8946 |
| hCV8942032 | rs1264352 | hCV26546351 | rs2263298 | 0.51 | 0.674510346 | 0.8946 |
| hCV8942032 | rs1264352 | hCV27452306 | rs3094032 | 0.51 | 0.674510346 | 0.6961 |
| hCV8942032 | rs1264352 | hCV27452307 | rs3094036 | 0.51 | 0.674510346 | 0.6961 |
| hCV8942032 | rs1264352 | hCV27452310 | rs3094057 | 0.51 | 0.674510346 | 0.6961 |
| hCV8942032 | rs1264352 | hCV27452312 | rs3094061 | 0.51 | 0.674510346 | 0.6961 |
| hCV8942032 | rs1264352 | hCV27452313 | rs3094064 | 0.51 | 0.674510346 | 0.6961 |
| hCV8942032 | rs1264352 | hCV27452317 | rs3094034 | 0.51 | 0.674510346 | 0.6961 |
| hCV8942032 | rs1264352 | hCV27452321 | rs3094031 | 0.51 | 0.674510346 | 0.6961 |
| hCV8942032 | rs1264352 | hCV27452331 | rs3094086 | 0.51 | 0.674510346 | 0.8942 |
| hCV8942032 | rs1264352 | hCV27452332 | rs3094035 | 0.51 | 0.674510346 | 0.6961 |
| hCV8942032 | rs1264352 | hCV27452369 | rs3094127 | 0.51 | 0.674510346 | 0.7955 |
| hCV8942032 | rs1264352 | hCV27452387 | rs3094222 | 0.51 | 0.674510346 | 0.7571 |
| hCV8942032 | rs1264352 | hCV27452568 | rs3094703 | 0.51 | 0.674510346 | 0.6961 |
| hCV8942032 | rs1264352 | hCV27452590 | rs3094717 | 0.51 | 0.674510346 | 0.6845 |
| hCV8942032 | rs1264352 | hCV27452726 | rs3095329 | 0.51 | 0.674510346 | 0.7945 |
| hCV8942032 | rs1264352 | hCV27452728 | rs3095336 | 0.51 | 0.674510346 | 0.8946 |
| hCV8942032 | rs1264352 | hCV27452739 | rs3095330 | 0.51 | 0.674510346 | 0.8339 |
| hCV8942032 | rs1264352 | hCV27452751 | rs3095338 | 0.51 | 0.674510346 | 0.8946 |
| hCV8942032 | rs1264352 | hCV27452792 | rs3095153 | 0.51 | 0.674510346 | 0.8946 |
| hCV8942032 | rs1264352 | hCV27452821 | rs3095340 | 0.51 | 0.674510346 | 0.8428 |

TABLE 4-continued

| Interrogated SNP | Interrogated rs | LD SNP | LD SNP rs | Power | Threshold $r^2$ | $r^2$ |
|---|---|---|---|---|---|---|
| hCV8942032 | rs1264352 | hCV27462338 | rs3130353 | 0.51 | 0.674510346 | 0.6961 |
| hCV8942032 | rs1264352 | hCV27462341 | rs3130374 | 0.51 | 0.674510346 | 0.6961 |
| hCV8942032 | rs1264352 | hCV27462390 | rs3130660 | 0.51 | 0.674510346 | 0.7934 |
| hCV8942032 | rs1264352 | hCV27462600 | rs3131050 | 0.51 | 0.674510346 | 0.942 |
| hCV8942032 | rs1264352 | hCV27462601 | rs3131064 | 0.51 | 0.674510346 | 0.9485 |
| hCV8942032 | rs1264352 | hCV27462862 | rs3131788 | 0.51 | 0.674510346 | 0.7415 |
| hCV8942032 | rs1264352 | hCV27462962 | rs3129812 | 0.51 | 0.674510346 | 0.6961 |
| hCV8942032 | rs1264352 | hCV27462963 | rs3129815 | 0.51 | 0.674510346 | 0.6961 |
| hCV8942032 | rs1264352 | hCV27462964 | rs3129818 | 0.51 | 0.674510346 | 0.6961 |
| hCV8942032 | rs1264352 | hCV27462981 | rs3129973 | 0.51 | 0.674510346 | 0.8435 |
| hCV8942032 | rs1264352 | hCV27462982 | rs3129984 | 0.51 | 0.674510346 | 0.8946 |
| hCV8942032 | rs1264352 | hCV27462996 | rs3130123 | 0.51 | 0.674510346 | 0.6961 |
| hCV8942032 | rs1264352 | hCV27463014 | rs3130352 | 0.51 | 0.674510346 | 0.6961 |
| hCV8942032 | rs1264352 | hCV27463047 | rs3130782 | 0.51 | 0.674510346 | 0.8946 |
| hCV8942032 | rs1264352 | hCV27463445 | rs3131783 | 0.51 | 0.674510346 | 0.7423 |
| hCV8942032 | rs1264352 | hCV27463454 | rs3131934 | 0.51 | 0.674510346 | 0.7955 |
| hCV8942032 | rs1264352 | hCV27463630 | rs3130557 | 0.51 | 0.674510346 | 0.7415 |
| hCV8942032 | rs1264352 | hCV27463637 | rs3130641 | 0.51 | 0.674510346 | 0.942 |
| hCV8942032 | rs1264352 | hCV27463692 | rs3132580 | 0.51 | 0.674510346 | 0.8946 |
| hCV8942032 | rs1264352 | hCV27463694 | rs3132610 | 0.51 | 0.674510346 | 0.7442 |
| hCV8942032 | rs1264352 | hCV27463813 | rs3131044 | 0.51 | 0.674510346 | 0.9447 |
| hCV8942032 | rs1264352 | hCV27464298 | rs3132600 | 0.51 | 0.674510346 | 0.7998 |
| hCV8942032 | rs1264352 | hCV27464300 | rs3132605 | 0.51 | 0.674510346 | 0.8946 |
| hCV8942032 | rs1264352 | hCV27464304 | rs3132630 | 0.51 | 0.674510346 | 0.6845 |
| hCV8942032 | rs1264352 | hCV27464305 | rs3132631 | 0.51 | 0.674510346 | 0.6845 |
| hCV8942032 | rs1264352 | hCV27464307 | rs3132645 | 0.51 | 0.674510346 | 0.7345 |
| hCV8942032 | rs1264352 | hCV27465359 | rs3129978 | 0.51 | 0.674510346 | 0.8905 |
| hCV8942032 | rs1264352 | hCV27465360 | rs3129980 | 0.51 | 0.674510346 | 0.942 |
| hCV8942032 | rs1264352 | hCV27465386 | rs3130350 | 0.51 | 0.674510346 | 0.6961 |
| hCV8942032 | rs1264352 | hCV27465389 | rs3130364 | 0.51 | 0.674510346 | 0.6961 |
| hCV8942032 | rs1264352 | hCV27465407 | rs3130544 | 0.51 | 0.674510346 | 0.7218 |
| hCV8942032 | rs1264352 | hCV27465417 | rs3130673 | 0.51 | 0.674510346 | 0.8946 |
| hCV8942032 | rs1264352 | hCV27465853 | rs3132634 | 0.51 | 0.674510346 | 0.6961 |
| hCV8942032 | rs1264352 | hCV27465855 | rs3132649 | 0.51 | 0.674510346 | 0.6961 |
| hCV8942032 | rs1264352 | hCV29486333 | rs3132584 | 0.51 | 0.674510346 | 0.7955 |
| hCV8942032 | rs1264352 | hCV29504305 | rs3094712 | 0.51 | 0.674510346 | 0.6961 |
| hCV8942032 | rs1264352 | hCV29522452 | rs3095334 | 0.51 | 0.674510346 | 0.8946 |
| hCV8942032 | rs1264352 | hCV29540580 | rs3094067 | 0.51 | 0.674510346 | 0.6961 |
| hCV8942032 | rs1264352 | hCV29558680 | rs3132599 | 0.51 | 0.674510346 | 0.8946 |
| hCV8942032 | rs1264352 | hCV29594803 | rs9262204 | 0.51 | 0.674510346 | 0.9398 |
| hCV8942032 | rs1264352 | hCV29666963 | rs3130363 | 0.51 | 0.674510346 | 0.6961 |
| hCV8942032 | rs1264352 | hCV29666973 | rs9262130 | 0.51 | 0.674510346 | 0.7768 |
| hCV8942032 | rs1264352 | hCV29703261 | rs3095155 | 0.51 | 0.674510346 | 0.8696 |
| hCV8942032 | rs1264352 | hCV29721426 | rs3132616 | 0.51 | 0.674510346 | 0.6961 |
| hCV8942032 | rs1264352 | hCV29775548 | rs3132647 | 0.51 | 0.674510346 | 0.6952 |
| hCV8942032 | rs1264352 | hCV29847742 | rs3129809 | 0.51 | 0.674510346 | 0.7345 |
| hCV8942032 | rs1264352 | hCV29883892 | rs3132581 | 0.51 | 0.674510346 | 0.8865 |
| hCV8942032 | rs1264352 | hCV29992126 | rs3094627 | 0.51 | 0.674510346 | 0.6961 |
| hCV8942032 | rs1264352 | hCV29992140 | rs9262200 | 0.51 | 0.674510346 | 0.9468 |
| hCV8942032 | rs1264352 | hCV30028026 | rs3130372 | 0.51 | 0.674510346 | 0.6845 |
| hCV8942032 | rs1264352 | hCV30045930 | rs3095326 | 0.51 | 0.674510346 | 0.8435 |
| hCV8942032 | rs1264352 | hCV30045931 | rs3131055 | 0.51 | 0.674510346 | 0.8951 |
| hCV8942032 | rs1264352 | hCV30172261 | rs3130365 | 0.51 | 0.674510346 | 0.6961 |
| hCV8942032 | rs1264352 | hCV30190135 | rs3094621 | 0.51 | 0.674510346 | 0.6961 |
| hCV8942032 | rs1264352 | hCV30262083 | rs3094050 | 0.51 | 0.674510346 | 0.6961 |
| hCV8942032 | rs1264352 | hCV30262102 | rs3130665 | 0.51 | 0.674510346 | 0.8946 |
| hCV8942032 | rs1264352 | hCV30280013 | rs3094024 | 0.51 | 0.674510346 | 0.7442 |
| hCV8942032 | rs1264352 | hCV30352101 | rs3129821 | 0.51 | 0.674510346 | 0.6845 |
| hCV8942032 | rs1264352 | hCV30424437 | rs9262143 | 0.51 | 0.674510346 | 0.7934 |
| hCV8942032 | rs1264352 | hCV30442461 | rs9262141 | 0.51 | 0.674510346 | 0.7768 |
| hCV8942032 | rs1264352 | hCV30496055 | rs3130117 | 0.51 | 0.674510346 | 0.7442 |
| hCV8942032 | rs1264352 | hCV30622443 | rs3129823 | 0.51 | 0.674510346 | 0.6845 |
| hCV8942032 | rs1264352 | hCV3273752 | rs3130370 | 0.51 | 0.674510346 | 0.6845 |
| hCV8942032 | rs1264352 | hCV7926405 | rs3130126 | 0.51 | 0.674510346 | 0.6961 |
| hCV8942032 | rs1264352 | hCV8692767 | rs1264376 | 0.51 | 0.674510346 | 0.9468 |
| hCV8942032 | rs1264352 | hCV8692768 | rs1264377 | 0.51 | 0.674510346 | 0.8951 |
| hCV8942032 | rs1264352 | hCV8692796 | rs1059612 | 0.51 | 0.674510346 | 0.7934 |
| hCV8942032 | rs1264352 | hCV8692806 | rs1064627 | 0.51 | 0.674510346 | 0.7955 |
| hCV8942032 | rs1264352 | hCV8941738 | rs1634721 | 0.51 | 0.674510346 | 0.8435 |
| hCV8942032 | rs1264352 | hCV8941879 | rs1264308 | 0.51 | 0.674510346 | 0.8946 |
| hCV8942032 | rs1264352 | hCV8941918 | rs1049633 | 0.51 | 0.674510346 | 0.8946 |
| hCV8942032 | rs1264352 | hCV8941930 | rs886422 | 0.51 | 0.674510346 | 0.8946 |
| hCV8942032 | rs1264352 | hCV8941940 | rs1264322 | 0.51 | 0.674510346 | 0.8905 |
| hCV8942032 | rs1264352 | hCV8941988 | rs2535340 | 0.51 | 0.674510346 | 0.8946 |
| hCV8942032 | rs1264352 | hCV8942006 | rs1264341 | 0.51 | 0.674510346 | 0.8946 |
| hCV8942032 | rs1264352 | hCV8942015 | rs1264347 | 0.51 | 0.674510346 | 0.8946 |
| hCV8942032 | rs1264352 | hCV8942025 | rs1264349 | 0.51 | 0.674510346 | 0.8946 |
| hCV8942032 | rs1264352 | hCV8942026 | rs1264350 | 0.51 | 0.674510346 | 0.8812 |

TABLE 4-continued

| Interrogated SNP | Interrogated rs | LD SNP | LD SNP rs | Power | Threshold $r^2$ | $r^2$ |
|---|---|---|---|---|---|---|
| hCV8942032 | rs1264352 | hCV8942038 | rs1264353 | 0.51 | 0.674510346 | 0.9427 |
| hCV8942032 | rs1264352 | hCV9481170 | rs886423 | 0.51 | 0.674510346 | 1 |
| hCV8942032 | rs1264352 | hDV75255684 | rs2517546 | 0.51 | 0.674510346 | 0.6985 |

TABLE 5

Baseline Characteristics of ARIC Participants in Ischemic Stroke Study

| | Whites (N = 10401) | | | Blacks (N = 3814) | | |
|---|---|---|---|---|---|---|
| Characteristics | Cases (N = 275) Mean (SD) | Non-cases (N = 10126) Mean (SD) | p-value* | Cases (N = 220) Mean (SD) | Non-cases (N = 3594) Mean (SD) | p-value* |
| Age | 57.59 (5.32) | 54.10 (5.69) | <0.01 | 55.21 (5.79) | 53.25 (5.79) | <0.01 |
| Waist-to-hip ratio | 0.96 (0.07) | 0.92 (0.08) | <0.01 | 0.94 (0.07) | 0.92 (0.08) | <0.01 |
| | N (%) | N (%) | p-value* | N (%) | N (%) | p-value* |
| Male | 162 (59) | 4569 (45) | <0.01 | 97 (44) | 1318 (37) | 0.03 |
| Hypertensive | 137 (50) | 2516 (25) | <0.01 | 168 (77) | 1903 (53) | <0.01 |
| Diabetic | 55 (20) | 799 (8) | <0.01 | 94 (44) | 596 (17) | <0.01 |
| Smoker | 90 (33) | 2455 (24) | <0.01 | 81 (37) | 1036 (29) | 0.01 |

*p-value represents a comparison between cases and non-cases within an ethnic group

TABLE 6

SNPs Associated with Incident Ischemic Stroke in the ARIC Study

| Gene Symbol | SNP ID | Function* | Risk-raising allele (frequency) | Risk-lowering allele (frequency) | Model 1† HRR | 95% CI | p-value | Model 2‡ HRR | 95% CI | p-value |
|---|---|---|---|---|---|---|---|---|---|---|
| | | | Whites | | | | | | | |
| SERPINA9 | rs11628722 | Nonsynonymous Ala348Val | G (0.84) | A (0.16) | 1.31 | 1.00-1.70 | 0.05 | 1.32 | 1.02-1.72 | 0.03 |
| PALLD | rs7439293 | Intronic | A (0.62) | G (0.38) | 1.24 | 1.03-1.49 | 0.02 | 1.21 | 1.01-1.46 | 0.04 |
| IER2 | rs1042164 | Nonsynonymous Val133Ala | T (0.17) | C (0.83) | 1.38 | 1.12-1.71 | 0.003 | 1.39 | 1.12-1.72 | 0.003 |
| | | | Blacks | | | | | | | |
| SERPINA9 | rs11628722 | Nonsynonymous Ala348Val | G (0.45) | A (0.55) | 1.26 | 1.03-1.53 | 0.02 | 1.27 | 1.04-1.54 | 0.02 |
| EXOD1 | rs3213646 | Intronic | C (0.16) | T (0.84) | 1.29 | 1.01-1.64 | 0.04 | 1.29 | 1.01-1.65 | 0.04 |

*First amino acid corresponds to risk raising allele for nonsynonymous SNPs.
†Model 1 was adjusted for age and gender.
‡Model 2 was adjusted for age, gender, waist-to-hip ratio and diabetes, hypertension and smoking status.

TABLE 7

| hCV number | rs number | Gene Symbol | Risk Allele | White HRR | 95% CI | p-value (two-sided) | Black HRR | 95% CI | p-value (two-sided) |
|---|---|---|---|---|---|---|---|---|---|
| hCV2091644 | rs1010 | VAMP8 | C | 1.16 | 0.97-1.38 | 0.1 | 0.9 | 0.74-1.10 | 0.3 |
| hCV25925481 | rs11628722 | SERPINA9 | G | 1.31 | 1.00-1.70 | 0.05 | 1.26 | 1.03-1.53 | 0.02 |
| hCV323071 | rs7439293 | PALLD | A | 1.24 | 1.03-1.49 | 0.02 | 1.2 | 0.93-1.56 | 0.16 |
| hCV7425232 | rs3900940 | MYH15 | C | 1.18 | 0.98-1.42 | 0.08 | 1.1 | 0.85-1.43 | 0.49 |
| hCV9326822 | rs1042164 | IER2 | T | 1.38 | 1.12-1.71 | 0 | 0.54 | 0.27-1.09 | 0.08 |
| hCV15770510 | rs3027309 | ALOX12B | T | 1.17 | 0.95-1.46 | 0.14 | 1.25 | 0.88-1.77 | 0.21 |
| hCV9626088 | rs943133 | LOC391102 | A | 1.13 | 0.94-1.36 | 0.19 | 1 | 0.69-1.45 | 1 |

TABLE 8

| hCV number | rs number | Gene Symbol | Risk Allele | White HRR | 95% CI | p-value (two-sided) | Black HRR | 95% CI | p-value (two-sided) |
|---|---|---|---|---|---|---|---|---|---|
| hCV25924894 | rs17090921 | SERPINA9 | A | 1.12 | 0.93-1.35 | 0.23 | 1.19 | 0.92-1.52 | 0.18 |
| hCV1690777 | rs12684749 | NFIB | G | 0.99 | 0.64-1.53 | 0.97 | 1.68 | 0.90-3.13 | 0.1 |
| hCV25925481 | rs11628722 | SERPINA9 | G | 1.31 | 1.00-1.70 | 0.05 | 1.26 | 1.03-1.53 | 0.02 |
| hCV323071 | rs7439293 | PALLD | A | 1.24 | 1.03-1.49 | 0.02 | 1.2 | 0.93-1.56 | 0.16 |
| hCV25609987 | rs10817479 | WDR31 | A | 0.93 | 0.65-1.32 | 0.67 | 5.15 | 0.72-36.78 | 0.1 |
| hCV2192261 | rs3213646 | EXOD1 | C | 0.98 | 0.82-1.17 | 0.82 | 1.29 | 1.01-1.64 | 0.04 |

TABLE 9

| hCV number | rs number | Gene Symbol | Risk Allele | White HRR | 95% CI | p-value (two-sided) | Black HRR | 95% CI | p-value (two-sided) |
|---|---|---|---|---|---|---|---|---|---|
| hCV25924894 | rs17090921 | SERPINA9 | A | 1.12 | 0.93-1.35 | 0.23 | 1.19 | 0.92-1.52 | 0.18 |
| hCV25925481 | rs11628722 | SERPINA9 | G | 1.31 | 1.00-1.70 | 0.05 | 1.26 | 1.03-1.53 | 0.02 |
| hCV323071 | rs7439293 | PALLD | A | 1.24 | 1.03-1.49 | 0.02 | 1.2 | 0.93-1.56 | 0.16 |

TABLE 10

Baseline Characteristics of CHS Participants in Ischemic Stroke Study

| Characteristic | Whites | African Americans |
|---|---|---|
| Number of individuals in this analysis | 3849 | 673 |
| Male | 1575 (41) | 243 (36) |
| Age, mean (SD), y | 72.7 (5.6) | 72.9 (5.7) |
| BMI, mean (SD), kg/m² | 26.3 (4.5) | 28.5 (5.6) |
| Smoking, current | 423 (11) | 113 (17) |
| Diabetes | 511 (13) | 151 (23) |
| Impaired fasting glucose | 522 (14) | 92 (14) |
| Hypertension | 2110 (55) | 490 (73) |
| LDL cholesterol, mean (SD), mg/dL | 130 (36) | 129 (36) |
| HDL cholesterol, mean (SD), mg/dL | 54 (16) | 58 (15) |
| Total cholesterol, mean (SD), mg/dL | 212 (39) | 210 (39) |

Data presented as number of participants (%) unless otherwise indicated.

TABLE 11

SNPs Associated with Incident Ischemic Stroke in White Participants of CHS

| Gene | dbSNP | Prespecified Risk Allele | Risk Allele Frequency | HR (90% CI)* | P |
|---|---|---|---|---|---|
| HPS1 | rs1804689 | T | 0.30 | 1.23 (1.09-1.40) | 0.003 |
| ITGAE | rs220479 | C | 0.82 | 1.26 (1.08-1.48) | 0.008 |
| ABCG2 | rs2231137 | C | 0.95 | 1.46 (1.05-2.03) | 0.03 |
| MYH15 | rs3900940 | C | 0.29 | 1.15 (1.02-1.31) | 0.03 |
| FSTL4 | rs13183672 | A | 0.76 | 1.17 (1.01-1.35) | 0.04 |
| CALM1 | rs3814843 | G | 0.05 | 1.31 (1.02-1.68) | 0.04 |
| BAT2 | rs11538264 | G | 0.97 | 1.49 (1.02-2.16) | 0.04 |

*Hazard ratios (HR) are adjusted for baseline age, sex, body mass index, current smoking, diabetes, impaired fasting glucose, hypertension, LDL-cholesterol, and HDL-cholesterol at baseline. Hazard ratios are per copy of the risk allele.

TABLE 12

SNPs Associated with Incident Ischemic Stroke in African American Participants of CHS

| Gene | dbSNP | Pre-specified Risk Allele | Risk Allele Frequency | HR (90% CI)* | P |
|---|---|---|---|---|---|
| KRT4 | rs89962 | T | 0.11 | 2.08 (1.48-2.94) | <0.001 |
| LY6G5B | rs11758242 | C | 0.89 | 2.28 (1.20-4.33) | 0.02 |
| EDG1 | rs2038366 | G | 0.73 | 1.59 (1.08-2.35) | 0.02 |
| DMXL2 | rs12102203 | G | 0.47 | 1.40 (1.03-1.90) | 0.04 |
| ABCG2 | rs2231137 | C | 0.95 | 3.59 (1.11-11.7) | 0.04 |

*Hazard ratios (HR) are adjusted for baseline age, sex, body mass index, current smoking, diabetes, impaired fasting glucose, hypertension, LDL-cholesterol, and HDL-cholesterol at baseline. Hazard ratios are per copy of the risk allele.

TABLE 13

The Val Allele Homozygotes of ABCG2 Val12Met (rs2231137), Compared with the Met Allele Carriers, are Associated With Increased Risk of Incident Ischemic Stroke in Both White and African American Participants of CHS

| | ABCG2 Genotype | Events n | Total n | Model 1* HR (90% CI) | P | Model 2* HR (90% CI) | P |
|---|---|---|---|---|---|---|---|
| White | ValVal | 370 | 3398 | 1.58 (1.12-2.23) | 0.02 | 1.50 (1.06-2.12) | 0.03 |
| | ValMet + MetMet | 24 | 335 | 1 (Reference) | | 1 (Reference) | |
| | ValMet | 23 | 321 | | | | |
| | MetMet | 1 | 14 | | | | |

TABLE 13-continued

The Val Allele Homozygotes of ABCG2 Val12Met (rs2231137), Compared with the Met Allele Carriers, are Associated With Increased Risk of Incident Ischemic Stroke in Both White and African American Participants of CHS

| | ABCG2 Genotype | Events n | Total n | Model 1* HR (90% CI) | P | Model 2* HR (90% CI) | P |
|---|---|---|---|---|---|---|---|
| Af. Am. | ValVal | 66 | 592 | 3.80 (1.16-12.4) | 0.03 | 3.62 (1.11-11.9) | 0.04 |
| | ValMet + MetMet | 2 | 70 | 1 (Reference) | | 1 (Reference) | |
| | ValMet | 2 | 69 | | | | |
| | MetMet | 0 | 1 | | | | |

*Model 1 was adjusted for baseline age and sex. Model 2 was adjusted for baseline age, sex, body mass index, current smoking, diabetes, impaired fasting glucose, hypertension, LDL-cholesterol, and HDL-cholesterol.

TABLE 14

| gene | rs # | hCV# | risk allele | mode | HR (90% CI) AgeSex (whites) | p-value (whites) |
|---|---|---|---|---|---|---|
| CENPE | rs2243682 | hCV1624173 | A | dom | 1.2 (1.02, 1.42) | 0.034 |
| FCRLB | rs34868416 | hCV25951678 | A | rec | 2.01 (1.07, 3.76) | 0.034 |
| FSTL4 | rs3749817 | hCV25637605 | G | dom | 2.04 (1.2, 3.45) | 0.013 |

| gene | HR (90% CI) Full (whites) | p-value (whites) | HR (90% CI) AgeSex (blacks) | p-value (blacks) | HR (90% CI) Full (blacks) | p-value (blacks) |
|---|---|---|---|---|---|---|
| CENPE | 1.2 (1.01, 1.42) | 0.037 | .98 (.51, 1.9) | 0.517 | 1.17 (.6, 2.28) | 0.352 |
| FCRLB | 2.18 (1.16, 4.09) | 0.021 | 1.52 (.84, 2.74) | 0.122 | 1.82 (.97, 3.44) | 0.06 |
| FSTL4 | 2.04 (1.2, 3.46) | 0.013 | | | | |

"HR (90% CI) AgeSex" = hazard ratio (with 90% confidence intervals) adjusted for age and sex
"HR (90% CI) Full" = hazard ratio (with 90% confidence intervals) fully adjusted for all traditional risk factors including smoking, diabetes, hypertension, HDL-C, LDL-C, and BMI

TABLE 15

Characteristics of noncardioembolic stroke cases and healthy controls in VSR

| Characteristics | Cases n = 562 | Controls n = 815 | p |
|---|---|---|---|
| Age (SD) | 66.0 (14) | 58.8 (8.5) | <0.0001 |
| Male | 326 (58.0) | 397 (48.7) | 0.0007 |
| Smoking | 172 (32.0) | 147 (18.7) | <0.0001 |
| Hypertension | 400 (71.2) | 403 (49.5) | <0.0001 |
| Diabetes | 191 (34.0) | 36 (4.4) | <0.0001 |
| Dyslipidemia | 347 (61.7) | 464 (56.9) | 0.07 |
| BMI (SD) | 26.8 (4.9) | 26.0 (3.8) | 0.004 |

Age and BMI are presented as means (standard deviation, SD) Other risk factors are presented as counts (%) having the risk factor

TABLE 16

Characteristics of six SNPs tested for association with noncardioembolic stroke in VSR.

| Gene | CHD Risk Allele | Frequency in VSR Controls | Frequency in ARIC Whites* | Chrom Loc† | SNP ID | SNP Type | SNP Source |
|---|---|---|---|---|---|---|---|
| MYH15 | C | 0.29 | 0.30 | 3q13.13 | rs3900940 | Thr1125Ala | Bare et al |
| KIF6 | G | 0.37 | 0.36 | 6p21.2 | rs20455 | Trp719Arg | Bare et al |
| VAMP8 | C | 0.38 | 0.42 | 2p12 | rs1010 | 3'UTR | Bare et al |
| Chr9p21 | G | 0.46 | 0.49 | 9p21 | rs10757274 | Intergenic | McPherson et al |

TABLE 17

Adjusted association of six SNPs with noncardioembolic stroke in VSR

| Locus Genotype | Case n (%) | Control n (%) | Model 1 OR (90% CI) | p | q | Model 2 OR (90% CI) | p |
|---|---|---|---|---|---|---|---|
| C9p21 | | | | | | | |
| GG + GA | 386 (76.7) | 568 (72.4) | 1.20 (0.95-1.50) | 0.10 | 0.15 | 1.14 (0.89-1.46) | 0.20 |
| GG | 139 (27.6) | 154 (19.6) | 1.59 (1.20-2.11) | 0.004 | | 1.45 (1.06-1.98) | 0.03 |

TABLE 17-continued

Adjusted association of six SNPs with noncardioembolic stroke in VSR

| Locus | Case | Control | Model 1 | | | Model 2 | |
|---|---|---|---|---|---|---|---|
| Genotype | n (%) | n (%) | OR (90% CI) | p | q | OR (90% CI) | p |
| GA | 247 (49.1) | 414 (52.8) | 1.05 (0.82-1.34) | 0.38 | | 1.02 (0.78-1.33) | 0.45 |
| AA | 117 (23.3) | 216 (27.6) | ref | | | ref | |
| KIF6 | | | | | | | |
| GG + GA | 327 (64.8) | 475 (60.7) | 1.24 (1.01-1.52) | 0.05 | 0.12 | 1.23 (0.98-1.54) | 0.07 |
| GG | 73 (14.5) | 102 (13.0) | 1.24 (0.91-1.69) | 0.13 | | 1.30 (0.93-1.83) | 0.10 |
| GA | 254 (50.3) | 373 (47.7) | 1.24 (1.00-1.53) | 0.05 | | 1.20 (0.95-1.53) | 0.10 |
| AA | 178 (35.3) | 307 (39.3) | ref | | | ref | |
| MYH15 | | | | | | | |
| CC + CT | 281 (55.6) | 390 (49.8) | 1.31 (1.07-1.60) | 0.01 | 0.06 | 1.25 (1.00-1.56) | 0.05 |
| CC | 56 (11.1) | 72 (9.2) | 1.50 (1.06-2.11) | 0.03 | | 1.19 (0.80-1.75) | 0.24 |
| CT | 225 (44.5) | 318 (40.6) | 1.27 (1.03-1.56) | 0.03 | | 1.26 (1.00-1.59) | 0.05 |
| TT | 225 (44.5) | 394 (50.3) | ref | | | ref | |
| VAMP8 | | | | | | | |
| CC + CT | 326 (64.4) | 483 (61.6) | 1.21 (0.99-1.49) | 0.06 | 0.12 | 1.33 (1.06-1.67) | 0.02 |
| CC | 77 (15.2) | 112 (14.3) | 1.27 (0.93-1.72) | 0.10 | | 1.37 (0.98-1.91) | 0.06 |
| CT | 249 (49.2) | 371 (47.3) | 1.20 (0.96-1.49) | 0.09 | | 1.32 (1.04-1.68) | 0.03 |
| TT | 180 (35.6) | 301 (38.4) | ref | | | ref | |

TABLE 18

| SNP | Gene | OUTCOME | ADJUST? | MODE | GENOTYPE | OR | OR Lower 90% CI | OR Upper 90% CI | p-value (two-sided) |
|---|---|---|---|---|---|---|---|---|---|
| hCV1116793 | ZNF132 | ISCHEMIC | NO | GEN | TC | 0.83 | 0.69375216 | 0.992667515 | 0.0869 |
| hCV1116793 | ZNF132 | ISCHEMIC | NO | ADD | T | 0.84 | 0.724853655 | 0.974320962 | 0.053 |
| hCV1116793 | ZNF132 | ISCHEMIC | NO | DOM | TC or TT | 0.819 | 0.689223622 | 0.973935207 | 0.0578 |
| hCV16093418 | LOC646377 | ISCHEMIC | NO | GEN | AA | 1.483 | 0.912916828 | 2.408756165 | 0.1815 |
| hCV16093418 | LOC646377 | ISCHEMIC | NO | ADD | A | 1.16 | 0.992191149 | 1.356678591 | 0.118 |
| hCV16093418 | LOC646377 | ISCHEMIC | NO | DOM | AG or AA | 1.161 | 0.968083437 | 1.392968387 | 0.1766 |
| hCV1754669 | Chr 9 | ISCHEMIC | NO | GEN | AG | 0.849 | 0.694898144 | 1.0380978 | 0.1806 |
| hCV1754669 | Chr 9 | ISCHEMIC | NO | GEN | AA | 0.704 | 0.553438026 | 0.894406866 | 0.016 |
| hCV1754669 | Chr 9 | ISCHEMIC | NO | ADD | A | 0.839 | 0.744293003 | 0.946031417 | 0.0161 |
| hCV1754669 | Chr 9 | ISCHEMIC | NO | DOM | AG or AA | 0.802 | 0.663035663 | 0.970180153 | 0.0566 |
| hCV1754669 | Chr 9 | ISCHEMIC | NO | REC | AA | 0.785 | 0.643446754 | 0.957447873 | 0.0451 |
| hCV25637605 | FSTL4 | ISCHEMIC | NO | DOM | AG or AA | 1.141 | 0.96474641 | 1.349440416 | 0.1959 |
| hCV26505812 | Chr 9 | ISCHEMIC | NO | GEN | GG | 1.434 | 1.126756329 | 1.825140554 | 0.0139 |
| hCV26505812 | Chr 9 | ISCHEMIC | NO | ADD | G | 1.193 | 1.057688641 | 1.345699564 | 0.0159 |
| hCV26505812 | Chr 9 | ISCHEMIC | NO | DOM | GA or GG | 1.175 | 0.971230942 | 1.421611376 | 0.1636 |
| hCV26505812 | Chr 9 | ISCHEMIC | NO | REC | GG | 1.362 | 1.115126666 | 1.663679973 | 0.0111 |
| hCV7425232 | MYH15 | ISCHEMIC | NO | GEN | CT | 1.207 | 1.013576656 | 1.437676114 | 0.0772 |
| hCV7425232 | MYH15 | ISCHEMIC | NO | ADD | C | 1.138 | 1.002467038 | 1.290637136 | 0.0933 |
| hCV7425232 | MYH15 | ISCHEMIC | NO | DOM | CT or CC | 1.207 | 1.022059286 | 1.424442487 | 0.0628 |
| hCV1116793 | ZNF132 | ISCHEMIC | YES | GEN | TC | 0.703 | 0.562477582 | 0.877572242 | 0.0091 |
| hCV1116793 | ZNF132 | ISCHEMIC | YES | ADD | T | 0.75 | 0.624608329 | 0.899631989 | 0.0093 |
| hCV1116793 | ZNF132 | ISCHEMIC | YES | DOM | TC or TT | 0.701 | 0.565686919 | 0.867894166 | 0.0063 |
| hCV16093418 | LOC646377 | ISCHEMIC | YES | GEN | AA | 1.866 | 1.045328301 | 3.330322013 | 0.0766 |
| hCV16093418 | LOC646377 | ISCHEMIC | YES | ADD | A | 1.162 | 0.960599702 | 1.404663117 | 0.1948 |
| hCV16093418 | LOC646377 | ISCHEMIC | YES | REC | AA | 1.841 | 1.034539603 | 3.275411467 | 0.0815 |
| hCV1754669 | Chr 9 | ISCHEMIC | YES | GEN | AA | 0.76 | 0.568372651 | 1.01549685 | 0.1192 |
| hCV1754669 | Chr 9 | ISCHEMIC | YES | ADD | A | 0.87 | 0.752699651 | 1.006107576 | 0.1151 |
| hCV1754669 | Chr 9 | ISCHEMIC | YES | DOM | AG or AA | 0.805 | 0.638680148 | 1.014657888 | 0.1232 |
| hCV2091644 | VAMP8 | ISCHEMIC | YES | GEN | CT | 1.401 | 1.120353768 | 1.751995633 | 0.0131 |
| hCV2091644 | VAMP8 | ISCHEMIC | YES | GEN | CC | 1.38 | 1.009559907 | 1.885674346 | 0.0901 |
| hCV2091644 | VAMP8 | ISCHEMIC | YES | ADD | C | 1.221 | 1.052766014 | 1.416485778 | 0.0267 |
| hCV2091644 | VAMP8 | ISCHEMIC | YES | DOM | CT or CC | 1.396 | 1.129256555 | 1.725713348 | 0.0096 |
| hCV26505812 | Chr 9 | ISCHEMIC | YES | GEN | GG | 1.388 | 1.036839351 | 1.858599041 | 0.0645 |
| hCV26505812 | Chr 9 | ISCHEMIC | YES | ADD | G | 1.171 | 1.011727737 | 1.355459485 | 0.0756 |
| hCV26505812 | Chr 9 | ISCHEMIC | YES | REC | GG | 1.398 | 1.096801262 | 1.782473489 | 0.0232 |
| hCV945276 | KRT5 | ISCHEMIC | YES | REC | TT | 1.232 | 0.957897979 | 1.585681051 | 0.1725 |
| hCV1116793 | ZNF132 | ATHERO | NO | GEN | TC | 0.787 | 0.646590569 | 0.95833488 | 0.0454 |
| hCV1116793 | ZNF132 | ATHERO | NO | ADD | T | 0.819 | 0.696165402 | 0.962297139 | 0.0419 |
| hCV1116793 | ZNF132 | ATHERO | NO | DOM | TC or TT | 0.784 | 0.648664594 | 0.947280056 | 0.0344 |
| hCV1754669 | Chr 9 | ATHERO | NO | GEN | AG | 0.833 | 0.670269439 | 1.034455809 | 0.165 |
| hCV1754669 | Chr 9 | ATHERO | NO | GEN | AA | 0.676 | 0.520352663 | 0.878840811 | 0.014 |
| hCV1754669 | Chr 9 | ATHERO | NO | ADD | A | 0.823 | 0.72208458 | 0.937642062 | 0.0141 |
| hCV1754669 | Chr 9 | ATHERO | NO | DOM | AG or AA | 0.782 | 0.636551788 | 0.960683278 | 0.0493 |

TABLE 18-continued

| SNP | Gene | OUTCOME | ADJUST? | MODE | GENOTYPE | OR | OR Lower 90% CI | OR Upper 90% CI | p-value (two-sided) |
|---|---|---|---|---|---|---|---|---|---|
| hCV1754669 | Chr 9 | ATHERO | NO | REC | AA | 0.764 | 0.614147286 | 0.950963593 | 0.043 |
| hCV26505812 | Chr 9 | ATHERO | NO | GEN | GG | 1.571 | 1.210420113 | 2.038944965 | 0.0044 |
| hCV26505812 | Chr 9 | ATHERO | NO | ADD | G | 1.251 | 1.097125415 | 1.426047313 | 0.005 |
| hCV26505812 | Chr 9 | ATHERO | NO | DOM | GA or GG | 1.218 | 0.987731875 | 1.501018684 | 0.1217 |
| hCV26505812 | Chr 9 | ATHERO | NO | REC | GG | 1.485 | 1.199236975 | 1.839906031 | 0.0024 |
| hCV7425232 | MYH15 | ATHERO | NO | GEN | CT | 1.291 | 1.06621554 | 1.562183465 | 0.028 |
| hCV7425232 | MYH15 | ATHERO | NO | GEN | CC | 1.36 | 0.995974126 | 1.856019239 | 0.1044 |
| hCV7425232 | MYH15 | ATHERO | NO | ADD | C | 1.209 | 1.05488262 | 1.385651602 | 0.0221 |
| hCV7425232 | MYH15 | ATHERO | NO | DOM | CT or CC | 1.304 | 1.087542975 | 1.562799868 | 0.0161 |
| hCV945276 | KRT5 | ATHERO | NO | GEN | TT | 1.226 | 0.944746161 | 1.589848931 | 0.1986 |
| hCV1116793 | ZNF132 | ATHERO | YES | GEN | TC | 0.639 | 0.501790288 | 0.814951237 | 0.0024 |
| hCV1116793 | ZNF132 | ATHERO | YES | ADD | T | 0.698 | 0.570892416 | 0.853128157 | 0.0032 |
| hCV1116793 | ZNF132 | ATHERO | YES | DOM | TC or TT | 0.64 | 0.507110931 | 0.808823546 | 0.0017 |
| hCV16093418 | LOC646377 | ATHERO | YES | GEN | AA | 1.762 | 0.928367604 | 3.34386559 | 0.1459 |
| hCV16093418 | LOC646377 | ATHERO | YES | REC | AA | 1.74 | 0.920040581 | 3.292138982 | 0.1527 |
| hCV1754669 | Chr 9 | ATHERO | YES | GEN | AA | 0.765 | 0.558483335 | 1.046582925 | 0.1596 |
| hCV1754669 | Chr 9 | ATHERO | YES | ADD | A | 0.874 | 0.746743893 | 1.022073084 | 0.1568 |
| hCV2091644 | VAMP8 | ATHERO | YES | GEN | CT | 1.322 | 1.038739023 | 1.682015035 | 0.0569 |
| hCV2091644 | VAMP8 | ATHERO | YES | GEN | CC | 1.366 | 0.976758835 | 1.910405456 | 0.126 |
| hCV2091644 | VAMP8 | ATHERO | YES | ADD | C | 1.2 | 1.023536718 | 1.407388698 | 0.0592 |
| hCV2091644 | VAMP8 | ATHERO | YES | DOM | CT or CC | 1.332 | 1.06021742 | 1.673849394 | 0.0388 |
| hCV26505812 | Chr 9 | ATHERO | YES | GEN | GG | 1.449 | 1.059805605 | 1.98082713 | 0.0512 |
| hCV26505812 | Chr 9 | ATHERO | YES | ADD | G | 1.201 | 1.025903307 | 1.405546929 | 0.056 |
| hCV26505812 | Chr 9 | ATHERO | YES | REC | GG | 1.431 | 1.106229626 | 1.851215592 | 0.022 |
| hCV3054799 | KIF6 | ATHERO | YES | ADD | G | 1.156 | 0.984174559 | 1.356831226 | 0.1385 |
| hCV3054799 | KIF6 | ATHERO | YES | DOM | GA or GG | 1.226 | 0.976764207 | 1.538041725 | 0.1403 |
| hCV323071 | PALLD | ATHERO | YES | GEN | GA | 0.822 | 0.647104489 | 1.044405162 | 0.178 |
| hCV7425232 | MYH15 | ATHERO | YES | GEN | CT | 1.263 | 1.002774843 | 1.590469093 | 0.0961 |
| hCV7425232 | MYH15 | ATHERO | YES | ADD | C | 1.152 | 0.973983418 | 1.361464556 | 0.1655 |
| hCV7425232 | MYH15 | ATHERO | YES | DOM | CT or CC | 1.248 | 1.002130266 | 1.555305517 | 0.0966 |
| hCV1116793 | ZNF132 | EARLY-ONSET | NO | GEN | TC | 0.721 | 0.555259615 | 0.93717945 | 0.0401 |
| hCV1116793 | ZNF132 | EARLY-ONSET | NO | ADD | T | 0.742 | 0.596550429 | 0.9231085 | 0.0246 |
| hCV1116793 | ZNF132 | EARLY-ONSET | NO | DOM | TC or TT | 0.709 | 0.550475956 | 0.912444516 | 0.025 |
| hCV16093418 | LOC646377 | EARLY-ONSET | NO | GEN | AA | 2.279 | 1.165213696 | 4.458870577 | 0.0434 |
| hCV16093418 | LOC646377 | EARLY-ONSET | NO | REC | AA | 2.283 | 1.172006222 | 4.448126516 | 0.0417 |
| hCV1754669 | Chr 9 | EARLY-ONSET | NO | GEN | AA | 0.638 | 0.449570543 | 0.904532087 | 0.0342 |
| hCV1754669 | Chr 9 | EARLY-ONSET | NO | ADD | A | 0.805 | 0.677020314 | 0.957005634 | 0.0392 |
| hCV1754669 | Chr 9 | EARLY-ONSET | NO | REC | AA | 0.657 | 0.491043284 | 0.880225636 | 0.0181 |
| hCV26505812 | Chr 9 | EARLY-ONSET | NO | GEN | GG | 1.454 | 1.031679957 | 2.049942 | 0.0727 |
| hCV26505812 | Chr 9 | EARLY-ONSET | NO | ADD | G | 1.205 | 1.015074491 | 1.431092302 | 0.0737 |
| hCV26505812 | Chr 9 | EARLY-ONSET | NO | DOM | GA or GG | 1.257 | 0.954270123 | 1.654681429 | 0.1722 |
| hCV26505812 | Chr 9 | EARLY-ONSET | NO | REC | GG | 1.308 | 0.984656431 | 1.736831541 | 0.1199 |
| hCV3054799 | KIF6 | EARLY-ONSET | NO | GEN | GA | 1.256 | 0.968081501 | 1.629118384 | 0.1499 |
| hCV3054799 | KIF6 | EARLY-ONSET | NO | DOM | GA or GG | 1.215 | 0.949308931 | 1.553982515 | 0.1942 |
| hCV7425232 | MYH15 | EARLY-ONSET | NO | GEN | CC | 1.411 | 0.92477899 | 2.153297741 | 0.18 |
| hCV7425232 | MYH15 | EARLY-ONSET | NO | ADD | C | 1.188 | 0.989106766 | 1.42696955 | 0.1219 |
| hCV7425232 | MYH15 | EARLY-ONSET | NO | DOM | CT or CC | 1.227 | 0.964448349 | 1.560176569 | 0.1624 |
| hCV1116793 | ZNF132 | EARLY-ONSET | YES | GEN | TC | 0.569 | 0.383972632 | 0.843482605 | 0.0184 |
| hCV1116793 | ZNF132 | EARLY-ONSET | YES | GEN | TT | 0.257 | 0.07724157 | 0.857115583 | 0.0635 |
| hCV1116793 | ZNF132 | EARLY-ONSET | YES | ADD | T | 0.551 | 0.390357614 | 0.77793835 | 0.0045 |
| hCV1116793 | ZNF132 | EARLY-ONSET | YES | DOM | TC or TT | 0.536 | 0.36534707 | 0.78765705 | 0.0076 |
| hCV1116793 | ZNF132 | EARLY-ONSET | YES | REC | TT | 0.312 | 0.09554036 | 1.01979997 | 0.1057 |
| hCV1754669 | Chr 9 | EARLY-ONSET | YES | GEN | AA | 0.531 | 0.310682745 | 0.90627091 | 0.0515 |
| hCV1754669 | Chr 9 | EARLY-ONSET | YES | ADD | A | 0.754 | 0.582569376 | 0.975219212 | 0.071 |
| hCV1754669 | Chr 9 | EARLY-ONSET | YES | REC | AA | 0.471 | 0.300175493 | 0.740364979 | 0.0061 |
| hCV26505812 | Chr 9 | EARLY-ONSET | YES | GEN | GA | 1.613 | 1.036095685 | 2.50964297 | 0.0756 |
| hCV26505812 | Chr 9 | EARLY-ONSET | YES | GEN | GG | 1.607 | 0.955315621 | 2.704490393 | 0.1335 |
| hCV26505812 | Chr 9 | EARLY-ONSET | YES | ADD | G | 1.267 | 0.980473167 | 1.638072097 | 0.129 |
| hCV26505812 | Chr 9 | EARLY-ONSET | YES | DOM | GA or GG | 1.611 | 1.056911526 | 2.455300114 | 0.0627 |
| hCV3054799 | KIF6 | EARLY-ONSET | YES | GEN | GA | 1.469 | 0.997042382 | 2.16444072 | 0.1027 |
| hCV3054799 | KIF6 | EARLY-ONSET | YES | DOM | GA or GG | 1.423 | 0.980591812 | 2.063903309 | 0.1192 |
| hCV323071 | PALLD | EARLY-ONSET | YES | GEN | GA | 0.722 | 0.490060464 | 1.064203359 | 0.1673 |
| hCV323071 | PALLD | EARLY-ONSET | YES | DOM | GA or GG | 0.74 | 0.515454368 | 1.061949638 | 0.1704 |

TABLE 19A

| Study | Marker | Gene | rs | Ref Allele | ALL Allele | ALL cnt | ALL frq | Case cnt | Case frq | Control cnt |
|---|---|---|---|---|---|---|---|---|---|---|
| UCSF CCF | hCV1053082 | NEU3 | rs544115 | C | T | 884 | 0.2039 | 216 | 0.1898 | 668 |
| VSR | hCV1053082 | NEU3 | rs544115 | C | T | 500 | 0.1836 | 177 | 0.1615 | 323 |

TABLE 19A-continued

| | | | | | | | | | | |
|---|---|---|---|---|---|---|---|---|---|---|
| UCSF CCF | hCV1116757 | | rs3794971 | T | C | 844 | 0.1946 | 206 | 0.181 | 638 |
| VSR | hCV1116757 | | rs3794971 | T | C | 454 | 0.1695 | 164 | 0.1513 | 290 |
| UCSF CCF | hCV11425801 | PEX6 | rs3805953 | T | C | 2068 | 0.4763 | 570 | 0.5009 | 1498 |
| VSR | hCV11425801 | PEX6 | rs3805953 | T | C | 1320 | 0.4857 | 554 | 0.5064 | 766 |
| UCSF CCF | hCV11425842 | GNMT | rs10948059 | C | T | 2048 | 0.4723 | 513 | 0.4516 | 1535 |
| VSR | hCV11425842 | GNMT | rs10948059 | C | T | 1258 | 0.4618 | 485 | 0.4425 | 773 |
| UCSF CCF | hCV11548152 | | rs11580249 | G | T | 707 | 0.1631 | 210 | 0.1845 | 497 |
| VSR | hCV11548152 | | rs11580249 | G | T | 413 | 0.1513 | 184 | 0.1673 | 229 |
| UCSF CCF | hCV11738775 | | rs6754561 | T | C | 1616 | 0.3725 | 394 | 0.3462 | 1222 |
| VSR | hCV11738775 | | rs6754561 | T | C | 1025 | 0.3766 | 387 | 0.3531 | 638 |
| UCSF CCF | hCV11758801 | GUCY1B2 | rs11841997 | C | G | 131 | 0.0302 | 44 | 0.0387 | 87 |
| VSR | hCV11758801 | GUCY1B2 | rs11841997 | C | G | 87 | 0.0319 | 44 | 0.04 | 43 |
| UCSF CCF | hCV11861255 | GRIK3 | rs529407 | A | G | 1038 | 0.2392 | 260 | 0.2285 | 778 |
| VSR | hCV11861255 | GRIK3 | rs529407 | A | G | 674 | 0.2506 | 245 | 0.226 | 429 |
| UCSF CCF | hCV12071939 | | rs1950943 | G | T | 929 | 0.2142 | 221 | 0.1942 | 708 |
| VSR | hCV12071939 | | rs1950943 | G | T | 532 | 0.1952 | 193 | 0.1755 | 339 |
| UCSF CCF | hCV1209800 | CLIC5 | rs35067690 | G | T | 207 | 0.0477 | 38 | 0.0335 | 169 |
| VSR | hCV1209800 | CLIC5 | rs35067690 | G | T | 111 | 0.0406 | 34 | 0.0309 | 77 |
| UCSF CCF | hCV1262973 | PLEKHG3 | rs229653 | G | A | 382 | 0.088 | 114 | 0.1002 | 268 |
| VSR | hCV1262973 | PLEKHG3 | rs229653 | G | A | 277 | 0.1024 | 127 | 0.118 | 150 |
| UCSF CCF | hCV1348610 | C9orf46 | rs3739636 | G | A | 2013 | 0.4645 | 559 | 0.4921 | 1454 |
| VSR | hCV1348610 | C9orf46 | rs3739636 | G | A | 1223 | 0.4567 | 512 | 0.4794 | 711 |
| UCSF CCF | hCV1408483 | BCL2 | rs17070848 | C | T | 719 | 0.1657 | 209 | 0.1837 | 510 |
| VSR | hCV1408483 | BCL2 | rs17070848 | C | T | 526 | 0.1931 | 232 | 0.2117 | 294 |
| UCSF CCF | hCV1452085 | TRIM22 | rs12223005 | C | A | 468 | 0.1078 | 111 | 0.0975 | 357 |
| VSR | hCV1452085 | TRIM22 | rs12223005 | C | A | 279 | 0.1021 | 98 | 0.0889 | 181 |
| UCSF CCF | hCV15851766 | APC | rs2229995 | G | A | 87 | 0.0201 | 14 | 0.0123 | 73 |
| VSR | hCV15851766 | APC | rs2229995 | G | A | 59 | 0.022 | 15 | 0.0139 | 44 |
| UCSF CCF | hCV15857769 | | rs2924914 | C | T | 1314 | 0.3029 | 368 | 0.3234 | 946 |
| VSR | hCV15857769 | | rs2924914 | C | T | 786 | 0.2883 | 331 | 0.3015 | 455 |
| UCSF CCF | hCV15879601 | C6orf142 | rs2275769 | C | T | 333 | 0.0767 | 70 | 0.0615 | 263 |
| VSR | hCV15879601 | C6orf142 | rs2275769 | C | T | 171 | 0.0628 | 59 | 0.0537 | 112 |
| UCSF CCF | hCV16134786 | | rs2857595 | G | A | 774 | 0.1785 | 226 | 0.1989 | 548 |
| VSR | hCV16134786 | | rs2857595 | G | A | 510 | 0.1868 | 227 | 0.2064 | 283 |
| UCSF CCF | hCV1619596 | FKBP1A | rs1048621 | G | A | 1198 | 0.2764 | 337 | 0.2961 | 861 |
| VSR | hCV1619596 | FKBP1A | rs1048621 | G | A | 675 | 0.2474 | 297 | 0.27 | 378 |
| UCSF CCF | hCV16336 | HD | rs362277 | C | T | 469 | 0.108 | 107 | 0.094 | 362 |
| VSR | hCV16336 | HD | rs362277 | C | T | 294 | 0.1079 | 97 | 0.0885 | 197 |
| UCSF CCF | hCV1723718 | UMODL1 | rs12481805 | G | A | 1336 | 0.3081 | 377 | 0.3313 | 959 |
| VSR | hCV1723718 | UMODL1 | rs12481805 | G | A | 779 | 0.2858 | 336 | 0.306 | 443 |
| UCSF CCF | hCV1958451 | MIER1 | rs2985822 | G | T | 1073 | 0.2475 | 256 | 0.225 | 817 |
| VSR | hCV1958451 | MIER1 | rs2985822 | G | T | 676 | 0.2487 | 248 | 0.2271 | 428 |
| UCSF CCF | hCV2121658 | | rs1187332 | G | A | 534 | 0.1232 | 120 | 0.1058 | 414 |
| VSR | hCV2121658 | | rs1187332 | G | A | 331 | 0.1226 | 119 | 0.1104 | 212 |
| UCSF CCF | hCV2358247 | SPINT4 | rs415989 | A | G | 290 | 0.0669 | 88 | 0.0775 | 202 |
| VSR | hCV2358247 | SPINT4 | rs415989 | A | G | 150 | 0.0549 | 77 | 0.0699 | 73 |
| UCSF CCF | hCV2390937 | LOC441108 | rs739719 | C | A | 318 | 0.0733 | 70 | 0.0615 | 248 |
| VSR | hCV2390937 | LOC441108 | rs739719 | C | A | 185 | 0.0678 | 60 | 0.0545 | 125 |
| UCSF CCF | hCV25473186 | NPY2R | rs2880415 | T | C | 2044 | 0.4708 | 566 | 0.4974 | 1478 |
| VSR | hCV25473186 | NPY2R | rs2880415 | T | C | 1181 | 0.4336 | 509 | 0.4653 | 672 |
| UCSF CCF | hCV25596936 | EPHA1 | rs6967117 | C | T | 308 | 0.0709 | 92 | 0.0808 | 216 |
| VSR | hCV25596936 | EPHA1 | rs6967117 | C | T | 241 | 0.0884 | 118 | 0.1073 | 123 |
| UCSF CCF | hCV25615822 | DHODH | NONE | C | T | 114 | 0.0263 | 35 | 0.0308 | 79 |

TABLE 19A-continued

| | | | | | | | | | | |
|---|---|---|---|---|---|---|---|---|---|---|
| VSR | hCV25615822 | DHODH | NONE | C | T | 113 | 0.0414 | 56 | 0.0508 | 57 |
| UCSF CCF | hCV25983294 | EDG2 | rs3739709 | G | A | 821 | 0.1892 | 190 | 0.1673 | 631 |
| VSR | hCV25983294 | EDG2 | rs3739709 | G | A | 541 | 0.1988 | 197 | 0.1794 | 344 |
| UCSF CCF | hCV2637554 | CHPT1 | rs3205421 | T | C | 1293 | 0.2985 | 368 | 0.3245 | 925 |
| VSR | hCV2637554 | CHPT1 | rs3205421 | T | C | 842 | 0.3109 | 363 | 0.3336 | 479 |
| UCSF CCF | hCV26478797 | CHSY-2 | rs2015018 | G | A | 1100 | 0.2537 | 266 | 0.2337 | 834 |
| VSR | hCV26478797 | CHSY-2 | rs2015018 | G | A | 721 | 0.2653 | 270 | 0.2473 | 451 |
| UCSF CCF | hCV26881276 | C11orf47 | rs2344829 | A | G | 1429 | 0.3297 | 392 | 0.3451 | 1037 |
| VSR | hCV26881276 | C11orf47 | rs2344829 | A | G | 963 | 0.3527 | 418 | 0.38 | 545 |
| UCSF CCF | hCV27077072 | | rs8060368 | C | T | 1429 | 0.3293 | 353 | 0.3102 | 1076 |
| VSR | hCV27077072 | | rs8060368 | C | T | 911 | 0.3339 | 346 | 0.3145 | 565 |
| UCSF CCF | hCV27473671 | C9orf4 | rs3750465 | T | C | 1270 | 0.2925 | 357 | 0.3137 | 913 |
| VSR | hCV27473671 | C9orf4 | rs3750465 | T | C | 738 | 0.2709 | 324 | 0.2945 | 414 |
| UCSF CCF | hCV27494483 | SLC22A15 | rs3748743 | C | T | 226 | 0.0521 | 72 | 0.0633 | 154 |
| VSR | hCV27494483 | SLC22A15 | rs3748743 | C | T | 127 | 0.0466 | 63 | 0.0573 | 64 |
| UCSF CCF | hCV27504565 | MUTYH | rs3219489 | C | G | 1135 | 0.2618 | 277 | 0.2434 | 858 |
| VSR | hCV27504565 | MUTYH | rs3219489 | C | G | 594 | 0.2174 | 213 | 0.1933 | 381 |
| UCSF CCF | hCV27511436 | FZD1 | rs3750145 | T | C | 687 | 0.1592 | 157 | 0.1389 | 530 |
| VSR | hCV27511436 | FZD1 | rs3750145 | T | C | 474 | 0.1736 | 173 | 0.1573 | 301 |
| UCSF CCF | hCV2769503 | | rs4787956 | A | G | 1495 | 0.3445 | 426 | 0.3743 | 1069 |
| VSR | hCV2769503 | | rs4787956 | A | G | 891 | 0.3317 | 393 | 0.3666 | 498 |
| UCSF CCF | hCV27892569 | NRXN3 | rs4903741 | T | C | 1022 | 0.2364 | 289 | 0.2544 | 733 |
| VSR | hCV27892569 | NRXN3 | rs4903741 | T | C | 626 | 0.23 | 268 | 0.2432 | 358 |
| UCSF CCF | hCV28036404 | RBL1 | rs4812768 | T | A | 875 | 0.2017 | 216 | 0.1905 | 659 |
| VSR | hCV28036404 | RBL1 | rs4812768 | T | A | 511 | 0.1879 | 182 | 0.1667 | 329 |
| UCSF CCF | hCV2851380 | | rs12445805 | G | C | 450 | 0.1037 | 99 | 0.0871 | 351 |
| VSR | hCV2851380 | | rs12445805 | G | C | 320 | 0.1173 | 113 | 0.1027 | 207 |
| UCSF CCF | hCV29401764 | LOC646588 | rs7793552 | C | T | 1402 | 0.3233 | 347 | 0.3049 | 1055 |
| VSR | hCV29401764 | LOC646588 | rs7793552 | C | T | 913 | 0.3357 | 337 | 0.3086 | 576 |
| UCSF CCF | hCV29537898 | | rs6073804 | C | T | 393 | 0.0907 | 120 | 0.1056 | 273 |
| VSR | hCV29537898 | | rs6073804 | C | T | 216 | 0.0796 | 100 | 0.0921 | 116 |
| UCSF CCF | hCV29539757 | KCNQ3 | rs10110659 | C | A | 1311 | 0.3022 | 312 | 0.2746 | 999 |
| VSR | hCV29539757 | KCNQ3 | rs10110659 | C | A | 870 | 0.3191 | 318 | 0.2896 | 552 |
| UCSF CCF | hCV302629 | UBAC2 | rs9284183 | A | G | 1247 | 0.2876 | 359 | 0.316 | 888 |
| VSR | hCV302629 | UBAC2 | rs9284183 | A | G | 763 | 0.2815 | 319 | 0.2932 | 444 |
| UCSF CCF | hCV30308202 | LAMA2 | rs9482985 | G | C | 917 | 0.2115 | 219 | 0.1924 | 698 |
| VSR | hCV30308202 | LAMA2 | rs9482985 | G | C | 549 | 0.2017 | 200 | 0.1828 | 349 |
| UCSF CCF | hCV3054550 | AIG1 | rs1559599 | C | T | 641 | 0.1476 | 189 | 0.1661 | 452 |
| VSR | hCV3054550 | AIG1 | rs1559599 | C | T | 434 | 0.1589 | 189 | 0.1715 | 245 |
| UCSF CCF | hCV3082219 | RFXDC1 | rs1884833 | G | A | 505 | 0.1164 | 148 | 0.1301 | 357 |
| VSR | hCV3082219 | RFXDC1 | rs1884833 | G | A | 344 | 0.127 | 159 | 0.147 | 185 |
| UCSF CCF | hCV31137507 | CLOCK | rs7660668 | G | C | 1165 | 0.2683 | 328 | 0.2882 | 837 |
| VSR | hCV31137507 | CLOCK | rs7660668 | G | C | 741 | 0.272 | 317 | 0.2892 | 424 |
| UCSF CCF | hCV31227848 | HIVEP3 | rs11809423 | C | T | 172 | 0.0396 | 61 | 0.0536 | 111 |
| VSR | hCV31227848 | HIVEP3 | rs11809423 | C | T | 120 | 0.044 | 64 | 0.0583 | 56 |
| UCSF CCF | hCV31573621 | SKAP1 | rs11079818 | T | C | 1223 | 0.2817 | 295 | 0.2592 | 928 |
| VSR | hCV31573621 | SKAP1 | rs11079818 | T | C | 739 | 0.2751 | 276 | 0.2575 | 463 |
| UCSF CCF | hCV31705214 | LOC645397 | rs12804599 | A | T | 984 | 0.2266 | 283 | 0.2487 | 701 |
| VSR | hCV31705214 | LOC645397 | rs12804599 | A | T | 596 | 0.2183 | 266 | 0.2418 | 330 |
| UCSF CCF | hCV32160712 | | rs11079160 | A | T | 743 | 0.1713 | 221 | 0.1942 | 522 |
| VSR | hCV32160712 | | rs11079160 | A | T | 432 | 0.1595 | 191 | 0.1752 | 241 |
| UCSF CCF | hCV435733 | | rs10276935 | C | G | 1346 | 0.3103 | 383 | 0.3366 | 963 |
| VSR | hCV435733 | | rs10276935 | C | G | 819 | 0.3004 | 345 | 0.3142 | 474 |

TABLE 19A-continued

| Study | | Gene | rs | A1 | A2 | | | | | |
|---|---|---|---|---|---|---|---|---|---|---|
| UCSF CCF | hCV454333 | NVL | rs10916581 | C | T | 590 | 0.136 | 139 | 0.1224 | 451 |
| VSR | hCV454333 | NVL | rs10916581 | C | T | 324 | 0.1194 | 110 | 0.0998 | 214 |
| UCSF CCF | hCV540056 | SPHK1 | rs346802 | C | T | 163 | 0.0376 | 32 | 0.0281 | 131 |
| VSR | hCV540056 | SPHK1 | rs346802 | C | T | 90 | 0.033 | 26 | 0.0237 | 64 |
| UCSF CCF | hCV7917138 | OR5H8P | rs9822460 | A | G | 860 | 0.1984 | 255 | 0.2241 | 605 |
| VSR | hCV7917138 | OR5H8P | rs9822460 | A | G | 538 | 0.1981 | 231 | 0.2115 | 307 |
| UCSF CCF | hCV8147903 | FLJ25715 | rs680014 | G | A | 971 | 0.2237 | 225 | 0.1977 | 746 |
| VSR | hCV8147903 | FLJ25715 | rs680014 | G | A | 577 | 0.2124 | 214 | 0.1963 | 363 |
| UCSF CCF | hCV8754449 | TESK2 | rs781226 | C | T | 1126 | 0.2596 | 277 | 0.2434 | 849 |
| VSR | hCV8754449 | TESK2 | rs781226 | C | T | 606 | 0.2226 | 218 | 0.1989 | 388 |
| UCSF CCF | hCV8820007 | | rs938390 | T | A | 1055 | 0.2432 | 265 | 0.2333 | 790 |
| VSR | hCV8820007 | | rs938390 | T | A | 651 | 0.2399 | 234 | 0.2135 | 417 |
| UCSF CCF | hCV8942032 | DDR1 | rs1264352 | G | C | 610 | 0.1406 | 179 | 0.1573 | 431 |
| VSR | hCV8942032 | DDR1 | rs1264352 | G | C | 366 | 0.1343 | 165 | 0.1505 | 201 |

| Study | Marker | Control frq | Allele | ALL cnt | ALL frq | Case cnt | Case frq | Control cnt | Control frq |
|---|---|---|---|---|---|---|---|---|---|
| UCSF CCF | hCV1053082 | 0.2089 | C | 3452 | 0.796 | 922 | 0.8102 | 2530 | 0.7911 |
| VSR | hCV1053082 | 0.1984 | C | 2224 | 0.816 | 919 | 0.8385 | 1305 | 0.8016 |
| UCSF CCF | hCV1116757 | 0.1994 | T | 3494 | 0.805 | 932 | 0.819 | 2562 | 0.8006 |
| VSR | hCV1116757 | 0.1819 | T | 2224 | 0.831 | 920 | 0.8487 | 1304 | 0.8181 |
| UCSF CCF | hCV11425801 | 0.4675 | T | 2274 | 0.524 | 568 | 0.4991 | 1706 | 0.5325 |
| VSR | hCV11425801 | 0.4717 | T | 1398 | 0.514 | 540 | 0.4936 | 858 | 0.5283 |
| UCSF CCF | hCV11425842 | 0.4797 | C | 2288 | 0.528 | 623 | 0.5484 | 1665 | 0.5203 |
| VSR | hCV11425842 | 0.4748 | C | 1466 | 0.538 | 611 | 0.5575 | 855 | 0.5252 |
| UCSF CCF | hCV11548152 | 0.1555 | G | 3627 | 0.837 | 928 | 0.8155 | 2699 | 0.8445 |
| VSR | hCV11548152 | 0.1405 | G | 2317 | 0.849 | 916 | 0.8327 | 1401 | 0.8595 |
| UCSF CCF | hCV11738775 | 0.3819 | T | 2722 | 0.628 | 744 | 0.6538 | 1978 | 0.6181 |
| VSR | hCV11738775 | 0.3924 | T | 1697 | 0.623 | 709 | 0.6469 | 988 | 0.6076 |
| UCSF CCF | hCV11758801 | 0.0272 | C | 4207 | 0.97 | 1092 | 0.9613 | 3115 | 0.9728 |
| VSR | hCV11758801 | 0.0264 | C | 2643 | 0.968 | 1056 | 0.96 | 1587 | 0.9736 |
| UCSF CCF | hCV11861255 | 0.243 | A | 3302 | 0.761 | 878 | 0.7715 | 2424 | 0.757 |
| VSR | hCV11861255 | 0.2671 | A | 2016 | 0.749 | 839 | 0.774 | 1177 | 0.7329 |
| UCSF CCF | hCV12071939 | 0.2212 | G | 3409 | 0.786 | 917 | 0.8058 | 2492 | 0.7788 |
| VSR | hCV12071939 | 0.2085 | G | 2194 | 0.805 | 907 | 0.8245 | 1287 | 0.7915 |
| UCSF CCF | hCV1209800 | 0.0527 | G | 4133 | 0.952 | 1098 | 0.9665 | 3035 | 0.9473 |
| VSR | hCV1209800 | 0.0472 | G | 2621 | 0.959 | 1068 | 0.9691 | 1553 | 0.9528 |
| UCSF CCF | hCV1262973 | 0.0837 | G | 3958 | 0.912 | 1024 | 0.8998 | 2934 | 0.9163 |
| VSR | hCV1262973 | 0.0921 | G | 2427 | 0.898 | 949 | 0.882 | 1478 | 0.9079 |
| UCSF CCF | hCV1348610 | 0.4547 | G | 2321 | 0.536 | 577 | 0.5079 | 1744 | 0.5453 |
| VSR | hCV1348610 | 0.4416 | G | 1455 | 0.543 | 556 | 0.5206 | 899 | 0.5584 |
| UCSF CCF | hCV1408483 | 0.1594 | C | 3619 | 0.834 | 929 | 0.8163 | 2690 | 0.8406 |
| VSR | hCV1408483 | 0.1806 | C | 2198 | 0.807 | 864 | 0.7883 | 1334 | 0.8194 |
| UCSF CCF | hCV1452085 | 0.1115 | C | 3872 | 0.892 | 1027 | 0.9025 | 2845 | 0.8885 |
| VSR | hCV1452085 | 0.111 | C | 2453 | 0.898 | 1004 | 0.9111 | 1449 | 0.889 |
| UCSF CCF | hCV15851766 | 0.0228 | G | 4245 | 0.98 | 1122 | 0.9877 | 3123 | 0.9772 |
| VSR | hCV15851766 | 0.0274 | G | 2621 | 0.978 | 1061 | 0.9861 | 1560 | 0.9726 |
| UCSF CCF | hCV15857769 | 0.2956 | C | 3024 | 0.697 | 770 | 0.6766 | 2254 | 0.7044 |
| VSR | hCV15857769 | 0.2795 | C | 1940 | 0.712 | 767 | 0.6985 | 1173 | 0.7205 |
| UCSF CCF | hCV15879601 | 0.0821 | C | 4009 | 0.923 | 1068 | 0.9385 | 2941 | 0.9179 |
| VSR | hCV15879601 | 0.0689 | C | 2553 | 0.937 | 1039 | 0.9463 | 1514 | 0.9311 |
| UCSF CCF | hCV16134786 | 0.1712 | G | 3562 | 0.822 | 910 | 0.8011 | 2652 | 0.8288 |

TABLE 19A-continued

| | | | | | | | | | |
|---|---|---|---|---|---|---|---|---|---|
| VSR | hCV16134786 | 0.1736 | G | 2220 | 0.813 | 873 | 0.7936 | 1347 | 0.8264 |
| UCSF CCF | hCV1619596 | 0.2694 | G | 3136 | 0.724 | 801 | 0.7039 | 2335 | 0.7306 |
| VSR | hCV1619596 | 0.2322 | G | 2053 | 0.753 | 803 | 0.73 | 1250 | 0.7678 |
| UCSF CCF | hCV16336 | 0.113 | C | 3873 | 0.892 | 1031 | 0.906 | 2842 | 0.887 |
| VSR | hCV16336 | 0.121 | C | 2430 | 0.892 | 999 | 0.9115 | 1431 | 0.879 |
| UCSF CCF | hCV1723718 | 0.2999 | G | 3000 | 0.692 | 761 | 0.6687 | 2239 | 0.7001 |
| VSR | hCV1723718 | 0.2721 | G | 1947 | 0.714 | 762 | 0.694 | 1185 | 0.7279 |
| UCSF CCF | hCV1958451 | 0.2555 | G | 3263 | 0.753 | 882 | 0.775 | 2381 | 0.7445 |
| VSR | hCV1958451 | 0.2632 | G | 2042 | 0.751 | 844 | 0.7729 | 1198 | 0.7368 |
| UCSF CCF | hCV2121658 | 0.1294 | G | 3800 | 0.877 | 1014 | 0.8942 | 2786 | 0.8706 |
| VSR | hCV2121658 | 0.1307 | G | 2369 | 0.877 | 959 | 0.8896 | 1410 | 0.8693 |
| UCSF CCF | hCV2358247 | 0.0631 | A | 4046 | 0.933 | 1048 | 0.9225 | 2998 | 0.9369 |
| VSR | hCV2358247 | 0.0448 | A | 2582 | 0.945 | 1025 | 0.9301 | 1557 | 0.9552 |
| UCSF CCF | hCV2390937 | 0.0775 | C | 4022 | 0.927 | 1068 | 0.9385 | 2954 | 0.9225 |
| VSR | hCV2390937 | 0.0767 | C | 2545 | 0.932 | 1040 | 0.9455 | 1505 | 0.9233 |
| UCSF CCF | hCV25473186 | 0.4613 | T | 2298 | 0.529 | 572 | 0.5026 | 1726 | 0.5387 |
| VSR | hCV25473186 | 0.4123 | T | 1543 | 0.566 | 585 | 0.5347 | 958 | 0.5877 |
| UCSF CCF | hCV25596936 | 0.0674 | C | 4034 | 0.929 | 1046 | 0.9192 | 2988 | 0.9326 |
| VSR | hCV25596936 | 0.0756 | C | 2485 | 0.912 | 982 | 0.8927 | 1503 | 0.9244 |
| UCSF CCF | hCV25615822 | 0.0247 | C | 4224 | 0.974 | 1101 | 0.9692 | 3123 | 0.9753 |
| VSR | hCV25615822 | 0.035 | C | 2617 | 0.959 | 1046 | 0.9492 | 1571 | 0.965 |
| UCSF CCF | hCV25983294 | 0.1969 | G | 3519 | 0.811 | 946 | 0.8327 | 2573 | 0.8031 |
| VSR | hCV25983294 | 0.2118 | G | 2181 | 0.801 | 901 | 0.8206 | 1280 | 0.7882 |
| UCSF CCF | hCV2637554 | 0.2892 | T | 3039 | 0.702 | 766 | 0.6755 | 2273 | 0.7108 |
| VSR | hCV2637554 | 0.2957 | T | 1866 | 0.689 | 725 | 0.6664 | 1141 | 0.7043 |
| UCSF CCF | hCV26478797 | 0.2608 | G | 3236 | 0.746 | 872 | 0.7663 | 2364 | 0.7392 |
| VSR | hCV26478797 | 0.2774 | G | 1997 | 0.735 | 822 | 0.7527 | 1175 | 0.7226 |
| UCSF CCF | hCV26881276 | 0.3243 | A | 2905 | 0.67 | 744 | 0.6549 | 2161 | 0.6757 |
| VSR | hCV26881276 | 0.3344 | A | 1767 | 0.647 | 682 | 0.62 | 1085 | 0.6656 |
| UCSF CCF | hCV27077072 | 0.336 | C | 2911 | 0.671 | 785 | 0.6898 | 2126 | 0.664 |
| VSR | hCV27077072 | 0.3471 | C | 1817 | 0.666 | 754 | 0.6855 | 1063 | 0.6529 |
| UCSF CCF | hCV27473671 | 0.285 | T | 3072 | 0.708 | 781 | 0.6863 | 2291 | 0.715 |
| VSR | hCV27473671 | 0.2549 | T | 1986 | 0.729 | 776 | 0.7055 | 1210 | 0.7451 |
| UCSF CCF | hCV27494483 | 0.0481 | C | 4114 | 0.948 | 1066 | 0.9367 | 3048 | 0.9519 |
| VSR | hCV27494483 | 0.0394 | C | 2599 | 0.953 | 1037 | 0.9427 | 1562 | 0.9606 |
| UCSF CCF | hCV27504565 | 0.2683 | C | 3201 | 0.738 | 861 | 0.7566 | 2340 | 0.7317 |
| VSR | hCV27504565 | 0.2337 | C | 2138 | 0.783 | 889 | 0.8067 | 1249 | 0.7663 |
| UCSF CCF | hCV27511436 | 0.1665 | T | 3627 | 0.841 | 973 | 0.8611 | 2654 | 0.8335 |
| VSR | hCV27511436 | 0.1847 | T | 2256 | 0.826 | 927 | 0.8427 | 1329 | 0.8153 |
| UCSF CCF | hCV2769503 | 0.3339 | A | 2845 | 0.656 | 712 | 0.6257 | 2133 | 0.6661 |
| VSR | hCV2769503 | 0.3086 | A | 1795 | 0.668 | 679 | 0.6334 | 1116 | 0.6914 |
| UCSF CCF | hCV27892569 | 0.2299 | T | 3302 | 0.764 | 847 | 0.7456 | 2455 | 0.7701 |
| VSR | hCV27892569 | 0.221 | T | 2096 | 0.77 | 834 | 0.7568 | 1262 | 0.779 |
| UCSF CCF | hCV28036404 | 0.2057 | T | 3463 | 0.798 | 918 | 0.8095 | 2545 | 0.7943 |
| VSR | hCV28036404 | 0.2021 | T | 2209 | 0.812 | 910 | 0.8333 | 1299 | 0.7979 |
| UCSF CCF | hCV2851380 | 0.1096 | G | 3890 | 0.896 | 1037 | 0.9129 | 2853 | 0.8904 |
| VSR | hCV2851380 | 0.1271 | G | 2408 | 0.883 | 987 | 0.8973 | 1421 | 0.8729 |
| UCSF CCF | hCV29401764 | 0.3299 | C | 2934 | 0.677 | 791 | 0.6951 | 2143 | 0.6701 |
| VSR | hCV29401764 | 0.3538 | C | 1807 | 0.664 | 755 | 0.6914 | 1052 | 0.6462 |
| UCSF CCF | hCV29537898 | 0.0854 | C | 3941 | 0.909 | 1016 | 0.8944 | 2925 | 0.9146 |
| VSR | hCV29537898 | 0.0713 | C | 2496 | 0.92 | 986 | 0.9079 | 1510 | 0.9287 |
| UCSF CCF | hCV29539757 | 0.312 | C | 3027 | 0.698 | 824 | 0.7254 | 2203 | 0.688 |

TABLE 19A-continued

|  |  |  |  |  |  |  |  |  |  |
|---|---|---|---|---|---|---|---|---|---|
| VSR | hCV29539757 | 0.3391 | C | 1856 | 0.681 | 780 | 0.7104 | 1076 | 0.6609 |
| UCSF CCF | hCV302629 | 0.2775 | A | 3089 | 0.712 | 777 | 0.684 | 2312 | 0.7225 |
| VSR | hCV302629 | 0.2737 | A | 1947 | 0.719 | 769 | 0.7068 | 1178 | 0.7263 |
| UCSF CCF | hCV30308202 | 0.2183 | G | 3419 | 0.789 | 919 | 0.8076 | 2500 | 0.7817 |
| VSR | hCV30308202 | 0.2144 | G | 2173 | 0.798 | 894 | 0.8172 | 1279 | 0.7856 |
| UCSF CCF | hCV3054550 | 0.1411 | C | 3701 | 0.852 | 949 | 0.8339 | 2752 | 0.8589 |
| VSR | hCV3054550 | 0.1503 | C | 2298 | 0.841 | 913 | 0.8285 | 1385 | 0.8497 |
| UCSF CCF | hCV3082219 | 0.1115 | G | 3835 | 0.884 | 990 | 0.8699 | 2845 | 0.8885 |
| VSR | hCV3082219 | 0.1138 | G | 2364 | 0.873 | 923 | 0.853 | 1441 | 0.8862 |
| UCSF CCF | hCV31137507 | 0.2612 | G | 3177 | 0.732 | 810 | 0.7118 | 2367 | 0.7388 |
| VSR | hCV31137507 | 0.2604 | G | 1983 | 0.728 | 779 | 0.7108 | 1204 | 0.7396 |
| UCSF CCF | hCV31227848 | 0.0347 | C | 4168 | 0.96 | 1077 | 0.9464 | 3091 | 0.9653 |
| VSR | hCV31227848 | 0.0344 | C | 2608 | 0.956 | 1034 | 0.9417 | 1574 | 0.9656 |
| UCSF CCF | hCV31573621 | 0.2896 | T | 3119 | 0.718 | 843 | 0.7408 | 2276 | 0.7104 |
| VSR | hCV31573621 | 0.2869 | T | 1947 | 0.725 | 796 | 0.7425 | 1151 | 0.7131 |
| UCSF CCF | hCV31705214 | 0.2188 | A | 3358 | 0.773 | 855 | 0.7513 | 2503 | 0.7812 |
| VSR | hCV31705214 | 0.2025 | A | 2134 | 0.782 | 834 | 0.7582 | 1300 | 0.7975 |
| UCSF CCF | hCV32160712 | 0.1631 | A | 3595 | 0.829 | 917 | 0.8058 | 2678 | 0.8369 |
| VSR | hCV32160712 | 0.1489 | A | 2276 | 0.841 | 899 | 0.8248 | 1377 | 0.8511 |
| UCSF CCF | hCV435733 | 0.3009 | C | 2992 | 0.69 | 755 | 0.6634 | 2237 | 0.6991 |
| VSR | hCV435733 | 0.2912 | C | 1907 | 0.7 | 753 | 0.6858 | 1154 | 0.7088 |
| UCSF CCF | hCV454333 | 0.1408 | C | 3748 | 0.864 | 997 | 0.8776 | 2751 | 0.8592 |
| VSR | hCV454333 | 0.1328 | C | 2390 | 0.881 | 992 | 0.9002 | 1398 | 0.8672 |
| UCSF CCF | hCV540056 | 0.0409 | C | 4177 | 0.962 | 1106 | 0.9719 | 3071 | 0.9591 |
| VSR | hCV540056 | 0.0394 | C | 2634 | 0.967 | 1072 | 0.9763 | 1562 | 0.9606 |
| UCSF CCF | hCV7917138 | 0.1893 | A | 3474 | 0.802 | 883 | 0.7759 | 2591 | 0.8107 |
| VSR | hCV7917138 | 0.189 | A | 2178 | 0.802 | 861 | 0.7885 | 1317 | 0.811 |
| UCSF CCF | hCV8147903 | 0.233 | G | 3369 | 0.776 | 913 | 0.8023 | 2456 | 0.767 |
| VSR | hCV8147903 | 0.2232 | G | 2139 | 0.788 | 876 | 0.8037 | 1263 | 0.7768 |
| UCSF CCF | hCV8754449 | 0.2653 | C | 3212 | 0.74 | 861 | 0.7566 | 2351 | 0.7347 |
| VSR | hCV8754449 | 0.2386 | C | 2116 | 0.777 | 878 | 0.8011 | 1238 | 0.7614 |
| UCSF CCF | hCV8820007 | 0.2467 | T | 3283 | 0.757 | 871 | 0.7667 | 2412 | 0.7533 |
| VSR | hCV8820007 | 0.2577 | T | 2063 | 0.76 | 862 | 0.7865 | 1201 | 0.7423 |
| UCSF CCF | hCV8942032 | 0.1347 | G | 3728 | 0.859 | 959 | 0.8427 | 2769 | 0.8653 |
| VSR | hCV8942032 | 0.1233 | G | 2360 | 0.866 | 931 | 0.8495 | 1429 | 0.8767 |

TABLE 19B

| Study | Marker | rs | Genot | ALL cnt | ALL frq | Case cnt | Case frq | Control cnt | Control frq | Genot | ALL cnt | ALL frq |
|---|---|---|---|---|---|---|---|---|---|---|---|---|
| UCSFCCF | hCV1053082 | rs544115 | T T | 98 | 0.0452 | 17 | 0.0299 | 81 | 0.0507 | T C | 688 | 0.3173 |
| VSR | hCV1053082 | rs544115 | T T | 52 | 0.0382 | 16 | 0.0292 | 36 | 0.0442 | T C | 396 | 0.2907 |
| UCSFCCF | hCV1116757 | rs3794971 | C C | 85 | 0.0392 | 24 | 0.0422 | 61 | 0.0381 | C T | 674 | 0.3107 |
| VSR | hCV1116757 | rs3794971 | C C | 41 | 0.0306 | 13 | 0.024 | 28 | 0.0351 | C T | 372 | 0.2778 |
| UCSFCCF | hCV11425801 | rs3805953 | C C | 499 | 0.2298 | 143 | 0.2513 | 356 | 0.2222 | C T | 1070 | 0.4929 |
| VSR | hCV11425801 | rs3805953 | C C | 319 | 0.2347 | 140 | 0.2559 | 179 | 0.2204 | C T | 682 | 0.5018 |
| UCSFCCF | hCV11425842 | rs10948059 | T T | 486 | 0.2242 | 111 | 0.1954 | 375 | 0.2344 | T C | 1076 | 0.4963 |
| VSR | hCV11425842 | rs10948059 | T T | 283 | 0.2078 | 104 | 0.1898 | 179 | 0.2199 | T C | 692 | 0.5081 |
| UCSFCCF | hCV11548152 | rs11580249 | T T | 52 | 0.024 | 15 | 0.0264 | 37 | 0.0232 | T G | 603 | 0.2783 |
| VSR | hCV11548152 | rs11580249 | T T | 34 | 0.0249 | 17 | 0.0309 | 17 | 0.0209 | T G | 345 | 0.2527 |
| UCSFCCF | hCV11738775 | rs6754561 | C C | 279 | 0.1286 | 57 | 0.1002 | 222 | 0.1388 | C T | 1058 | 0.4878 |
| VSR | hCV11738775 | rs6754561 | C C | 201 | 0.1477 | 65 | 0.1186 | 136 | 0.1673 | C T | 623 | 0.4578 |
| UCSFCCF | hCV11758801 | rs11841997 | G G | 4 | 0.0018 | 2 | 0.0035 | 2 | 0.0012 | G C | 123 | 0.0567 |
| VSR | hCV11758801 | rs11841997 | G G | 2 | 0.0015 | 2 | 0.0036 | 0 | 0 | G C | 83 | 0.0608 |
| UCSFCCF | hCV11861255 | rs529407 | G G | 144 | 0.0664 | 27 | 0.0475 | 117 | 0.0731 | G A | 750 | 0.3456 |
| VSR | hCV11861255 | rs529407 | G G | 95 | 0.0706 | 30 | 0.0554 | 65 | 0.0809 | G A | 484 | 0.3599 |
| UCSFCCF | hCV12071939 | rs1950943 | T T | 94 | 0.0433 | 15 | 0.0264 | 79 | 0.0494 | T G | 741 | 0.3416 |
| VSR | hCV12071939 | rs1950943 | T T | 61 | 0.0448 | 25 | 0.0455 | 36 | 0.0443 | T G | 410 | 0.3008 |
| UCSFCCF | hCV1209800 | rs35067690 | T T | 4 | 0.0018 | 0 | 0 | 4 | 0.0025 | T G | 199 | 0.0917 |

TABLE 19B-continued

| | | | | | | | | | | | | | |
|---|---|---|---|---|---|---|---|---|---|---|---|---|---|
| VSR | hCV1209800 | rs35067690 | T T | 4 | 0.0029 | 0 | 0 | 4 | 0.0049 | T G | 103 | 0.0754 |
| UCSFCCF | hCV1262973 | rs229653 | A A | 29 | 0.0134 | 11 | 0.0193 | 18 | 0.0112 | A G | 324 | 0.1493 |
| VSR | hCV1262973 | rs229653 | A A | 16 | 0.0118 | 5 | 0.0093 | 11 | 0.0135 | A G | 245 | 0.1812 |
| UCSFCCF | hCV1348610 | rs3739636 | A A | 474 | 0.2187 | 135 | 0.2377 | 339 | 0.212 | A G | 1065 | 0.4912 |
| VSR | hCV1348610 | rs3739636 | A A | 301 | 0.2566 | 137 | 0.2566 | 164 | 0.2037 | A G | 621 | 0.4638 |
| UCSFCCF | hCV1408483 | rs17070848 | T T | 56 | 0.0246 | 14 | 0.0246 | 42 | 0.0262 | T C | 607 | 0.2799 |
| VSR | hCV1408483 | rs17070848 | T T | 50 | 0.0401 | 22 | 0.0401 | 28 | 0.0344 | T C | 426 | 0.3128 |
| UCSFCCF | hCV1452085 | rs12223005 | A A | 28 | 0.0053 | 3 | 0.0053 | 25 | 0.0156 | A C | 412 | 0.1899 |
| VSR | hCV1452085 | rs12223005 | A A | 17 | 0.0127 | 7 | 0.0127 | 10 | 0.0123 | A C | 245 | 0.1794 |
| UCSFCCF | hCV15851766 | rs2229995 | A A | 0 | 0 | 0 | 0 | 0 | 0 | A G | 87 | 0.0402 |
| VSR | hCV15851766 | rs2229995 | A A | 0 | 0 | 0 | 0 | 0 | 0 | A G | 59 | 0.044 |
| UCSFCCF | hCV15857769 | rs2924914 | T T | 212 | 0.0977 | 65 | 0.1142 | 147 | 0.0919 | T C | 890 | 0.4183 |
| VSR | hCV15857769 | rs2924914 | T T | 106 | 0.0778 | 53 | 0.0965 | 53 | 0.0651 | T C | 574 | 0.4098 |
| UCSFCCF | hCV15879601 | rs2275769 | T T | 13 | 0.006 | 2 | 0.0035 | 11 | 0.0069 | T C | 307 | 0.116 |
| VSR | hCV15879601 | rs2275769 | T T | 8 | 0.0059 | 0 | 0 | 8 | 0.0098 | T C | 155 | 0.1075 |
| UCSFCCF | hCV16134786 | rs2857595 | A A | 72 | 0.0332 | 22 | 0.0387 | 50 | 0.0312 | A G | 630 | 0.3204 |
| VSR | hCV16134786 | rs2857595 | A A | 53 | 0.0388 | 22 | 0.04 | 31 | 0.038 | A G | 404 | 0.3327 |
| UCSFCCF | hCV1619596 | rs1048621 | A A | 186 | 0.0858 | 54 | 0.0949 | 132 | 0.0826 | A G | 826 | 0.4025 |
| VSR | hCV1619596 | rs1048621 | A A | 83 | 0.0609 | 37 | 0.0673 | 46 | 0.0565 | A G | 509 | 0.4055 |
| UCSFCCF | hCV16336 | rs362277 | T T | 31 | 0.0143 | 7 | 0.0123 | 24 | 0.015 | T C | 407 | 0.1634 |
| VSR | hCV16336 | rs362277 | T T | 15 | 0.011 | 2 | 0.0036 | 13 | 0.016 | T C | 264 | 0.1697 |
| UCSFCCF | hCV1723718 | rs12481805 | A A | 199 | 0.0918 | 61 | 0.1072 | 138 | 0.0863 | A G | 938 | 0.4482 |
| VSR | hCV1723718 | rs12481805 | A A | 123 | 0.0902 | 53 | 0.0965 | 70 | 0.086 | A G | 533 | 0.4189 |
| UCSFCCF | hCV1958451 | rs2985822 | T T | 135 | 0.623 | 30 | 0.0527 | 105 | 0.0657 | T G | 803 | 0.3445 |
| VSR | hCV1958451 | rs2985822 | T T | 90 | 0.0662 | 27 | 0.0495 | 63 | 0.0775 | T G | 496 | 0.3553 |
| UCSFCCF | hCV2121658 | rs1187332 | A A | 23 | 0.0106 | 6 | 0.0106 | 17 | 0.0106 | A G | 488 | 0.1905 |
| VSR | hCV2121658 | rs1187332 | A A | 18 | 0.0133 | 3 | 0.0056 | 15 | 0.0185 | A G | 295 | 0.2096 |
| UCSFCCF | hCV2358247 | rs415989 | G G | 14 | 0.0065 | 2 | 0.0035 | 12 | 0.0075 | G A | 262 | 0.1208 |
| VSR | hCV2358247 | rs415989 | G G | 5 | 0.0037 | 5 | 0.0091 | 0 | 0 | G A | 140 | 0.1025 |
| UCSFCCF | hCV2390937 | rs739719 | A A | 12 | 0.0055 | 2 | 0.0035 | 10 | 0.0062 | A C | 294 | 0.1355 |
| VSR | hCV2390937 | rs739719 | A A | 3 | 0.0022 | 1 | 0.0018 | 2 | 0.0025 | A C | 179 | 0.1311 |
| UCSFCCF | hCV25473186 | rs2880415 | C C | 488 | 0.2248 | 135 | 0.2373 | 353 | 0.2203 | C T | 1068 | 0.4919 |
| VSR | hCV25473186 | rs2880415 | C C | 246 | 0.1806 | 109 | 0.1993 | 137 | 0.1681 | C T | 689 | 0.5059 |
| UCSFCCF | hCV25596936 | rs6967117 | T T | 13 | 0.006 | 2 | 0.0035 | 11 | 0.0069 | T C | 282 | 0.1299 |
| VSR | hCV25596936 | rs6967117 | T T | 15 | 0.011 | 7 | 0.0127 | 8 | 0.0098 | T C | 211 | 0.1548 |
| UCSFCCF | hCV25615822 | NONE | T T | 1 | 0.0005 | 1 | 0.0018 | 0 | 0 | T C | 112 | 0.0516 |
| VSR | hCV25615822 | NONE | T T | 2 | 0.0015 | 1 | 0.0018 | 1 | 0.0012 | T C | 109 | 0.0799 |
| UCSFCCF | hCV25983294 | rs3739709 | A A | 75 | 0.0346 | 19 | 0.0335 | 56 | 0.035 | A G | 671 | 0.3092 |
| VSR | hCV25983294 | rs3739709 | A A | 64 | 0.047 | 23 | 0.0419 | 41 | 0.0505 | A G | 413 | 0.3035 |
| UCSFCCF | hCV2637554 | rs3205421 | C C | 190 | 0.0877 | 64 | 0.1129 | 126 | 0.0788 | C T | 913 | 0.4215 |
| VSR | hCV2637554 | rs3205421 | C C | 139 | 0.1027 | 63 | 0.1158 | 76 | 0.0938 | C T | 564 | 0.4165 |
| UCSFCCF | hCV26478797 | rs2015018 | A A | 122 | 0.0563 | 31 | 0.0545 | 91 | 0.0569 | A G | 856 | 0.3948 |
| VSR | hCV26478797 | rs2015018 | A A | 95 | 0.0699 | 28 | 0.0513 | 67 | 0.0824 | A G | 531 | 0.3907 |
| UCSFCCF | hCV26881276 | rs2344829 | G G | 250 | 0.1154 | 66 | 0.1162 | 184 | 0.1151 | G A | 929 | 0.4287 |
| VSR | hCV26881276 | rs2344829 | G G | 183 | 0.1341 | 86 | 0.1564 | 97 | 0.119 | G A | 597 | 0.4374 |
| UCSFCCF | hCV27077072 | rs8060368 | T T | 237 | 0.1092 | 60 | 0.1054 | 177 | 0.1106 | T C | 955 | 0.4401 |
| VSR | hCV27077072 | rs8060368 | T T | 152 | 0.1114 | 54 | 0.0982 | 98 | 0.1204 | T C | 607 | 0.445 |
| UCSFCCF | hCV27473671 | rs3750465 | C C | 183 | 0.0843 | 54 | 0.0949 | 129 | 0.0805 | C T | 904 | 0.4164 |
| VSR | hCV27473671 | rs3750465 | C C | 103 | 0.0756 | 51 | 0.0927 | 52 | 0.064 | C T | 532 | 0.3906 |
| UCSFCCF | hCV27494483 | rs3748742 | T T | 12 | 0.005 | 4 | 0.007 | 8 | 0.005 | T C | 202 | 0.0931 |
| VSR | hCV27494483 | rs3748742 | T T | 3 | 0.0022 | 2 | 0.0036 | 1 | 0.0012 | T C | 121 | 0.0888 |
| UCSFCCF | hCV27504565 | rs3219489 | G G | 138 | 0.0637 | 39 | 0.0685 | 99 | 0.0619 | G C | 859 | 0.3962 |
| VSR | hCV27504565 | rs3219489 | G G | 67 | 0.049 | 13 | 0.0236 | 54 | 0.0663 | G C | 460 | 0.3367 |
| UCSFCCF | hCV27511436 | rs3750145 | C C | 55 | 0.0255 | 5 | 0.0088 | 50 | 0.0314 | C T | 577 | 0.2375 |
| VSR | hCV27511436 | rs3750145 | C C | 47 | 0.0344 | 16 | 0.0291 | 31 | 0.038 | C T | 380 | 0.2784 |
| UCSFCCF | hCV2769503 | rs4787956 | G G | 253 | 0.1166 | 74 | 0.1301 | 179 | 0.1118 | G A | 989 | 0.4558 |
| VSR | hCV2769503 | rs4787956 | G G | 146 | 0.1087 | 65 | 0.1213 | 81 | 0.1004 | G A | 599 | 0.446 |
| UCSFCCF | hCV27892569 | rs4903741 | C C | 113 | 0.0523 | 35 | 0.0616 | 78 | 0.0489 | C T | 796 | 0.3682 |
| VSR | hCV27892569 | rs4903741 | C C | 88 | 0.0647 | 34 | 0.0617 | 54 | 0.0667 | C T | 450 | 0.3306 |
| UCSFCCF | hCV28036404 | rs4812768 | A A | 99 | 0.0456 | 17 | 0.03 | 82 | 0.0512 | A T | 677 | 0.3121 |
| VSR | hCV28036404 | rs4812768 | A A | 39 | 0.0287 | 13 | 0.0238 | 26 | 0.0319 | A T | 433 | 0.3184 |
| UCSFCCF | hCV2851380 | rs12445805 | C C | 32 | 0.0147 | 4 | 0.007 | 28 | 0.0175 | C G | 386 | 0.1779 |
| VSR | hCV2851380 | rs12445805 | C C | 21 | 0.0154 | 7 | 0.0127 | 14 | 0.0172 | C G | 278 | 0.2038 |
| UCSFCCF | hCV29401764 | rs7793552 | T T | 223 | 0.1029 | 62 | 0.109 | 161 | 0.1007 | T C | 956 | 0.441 |
| VSR | hCV29401764 | rs7793552 | T T | 159 | 0.1169 | 58 | 0.1062 | 101 | 0.1241 | T C | 595 | 0.4375 |
| UCSFCCF | hCV29537898 | rs6073804 | T T | 23 | 0.0106 | 10 | 0.0176 | 13 | 0.0081 | T C | 347 | 0.1601 |
| VSR | hCV29537898 | rs6073804 | T T | 6 | 0.0044 | 5 | 0.0092 | 1 | 0.0012 | T C | 204 | 0.1504 |
| UCSFCCF | hCV29538757 | rs10110659 | A A | 192 | 0.0885 | 49 | 0.0863 | 143 | 0.0893 | A C | 927 | 0.4274 |
| VSR | hCV29538757 | rs10110659 | A A | 136 | 0.0998 | 46 | 0.0838 | 90 | 0.1106 | A C | 598 | 0.4387 |
| UCSFCCF | hCV302629 | rs9284183 | G G | 185 | 0.0853 | 68 | 0.1197 | 117 | 0.0731 | G A | 877 | 0.4045 |
| VSR | hCV302629 | rs9284183 | G G | 111 | 0.0819 | 55 | 0.1011 | 56 | 0.0691 | G A | 541 | 0.3993 |
| UCSFCCF | hCV30308202 | rs9482985 | C C | 101 | 0.0466 | 17 | 0.0299 | 84 | 0.0525 | C G | 715 | 0.3298 |
| VSR | hCV30308202 | rs9482985 | C C | 66 | 0.0485 | 25 | 0.0457 | 41 | 0.0504 | C G | 417 | 0.3064 |
| UCSFCCF | hCV3054550 | rs1559599 | T T | 50 | 0.023 | 17 | 0.0299 | 33 | 0.0206 | T C | 541 | 0.2492 |
| VSR | hCV3054550 | rs1559599 | T T | 36 | 0.0264 | 14 | 0.0254 | 22 | 0.027 | T C | 362 | 0.265 |
| UCSFCCF | hCV3082219 | rs1884833 | A A | 27 | 0.0124 | 7 | 0.0123 | 20 | 0.0125 | A G | 451 | 0.2078 |
| VSR | hCV3082219 | rs1884833 | A A | 21 | 0.0155 | 11 | 0.0203 | 10 | 0.0123 | A G | 302 | 0.223 |
| UCSFCCF | hCV31137507 | rs7660668 | C C | 162 | 0.0746 | 47 | 0.0826 | 115 | 0.0718 | C G | 841 | 0.3874 |
| VSR | hCV31137507 | rs7660668 | C C | 101 | 0.0742 | 46 | 0.0839 | 55 | 0.0676 | C G | 539 | 0.3957 |
| UCSFCCF | hCV31227848 | rs11809423 | T T | 4 | 0.0018 | 1 | 0.0018 | 3 | 0.0019 | T C | 164 | 0.0756 |

TABLE 19B-continued

| Study | Marker | | | Case cnt | Case frq | Control cnt | Control frq | | | Genot | ALL cnt | ALL frq | Case cnt | Case frq | Control cnt | Control frq |
|---|---|---|---|---|---|---|---|---|---|---|---|---|---|---|---|---|
| VSR | hCV31227848 | rs11809423 | T T | 2 | 0.0015 | 1 | 0.0018 | 1 | 0.0012 | T C | 116 | 0.085 | | | | |
| UCSFCCF | hCV31573621 | rs11079818 | C C | 164 | 0.0755 | 36 | 0.0633 | 128 | 0.0799 | C T | 895 | 0.4123 | | | | |
| VSR | hCV31573621 | rs11079818 | C C | 100 | 0.0745 | 30 | 0.056 | 70 | 0.0867 | C T | 539 | 0.4013 | | | | |
| UCSFCCF | hCV31705214 | rs12804599 | T T | 116 | 0.0534 | 41 | 0.0721 | 75 | 0.0468 | T A | 752 | 0.3464 | | | | |
| VSR | hCV31705214 | rs12804599 | T T | 71 | 0.052 | 31 | 0.0564 | 40 | 0.0491 | T A | 454 | 0.3326 | | | | |
| UCSFCCF | hCV32160712 | rs11079160 | T T | 57 | 0.0263 | 17 | 0.0299 | 40 | 0.025 | T A | 629 | 0.29 | | | | |
| VSR | hCV32160712 | rs11079160 | T T | 37 | 0.0273 | 20 | 0.0367 | 17 | 0.021 | T A | 358 | 0.2644 | | | | |
| UCSFCCF | hCV435733 | rs10276935 | G G | 226 | 0.1042 | 65 | 0.1142 | 161 | 0.1006 | G C | 894 | 0.4122 | | | | |
| VSR | hCV435733 | rs10276935 | G G | 132 | 0.0968 | 46 | 0.0838 | 86 | 0.1057 | G C | 555 | 0.4072 | | | | |
| UCSFCCF | hCV454333 | rs10916581 | T T | 42 | 0.0194 | 6 | 0.0106 | 36 | 0.0225 | T C | 506 | 0.2333 | | | | |
| VSR | hCV454333 | rs10916581 | T T | 25 | 0.0184 | 5 | 0.0091 | 20 | 0.0248 | T C | 274 | 0.2019 | | | | |
| UCSFCCF | hCV540056 | rs346802 | T T | 2 | 0.0009 | 1 | 0.0018 | 1 | 0.0006 | T C | 159 | 0.0733 | | | | |
| VSR | hCV540056 | rs346802 | T T | 0 | 0 | 0 | 0 | 0 | 0 | T C | 90 | 0.0661 | | | | |
| UCSFCCF | hCV7917138 | rs9822460 | G G | 94 | 0.0434 | 29 | 0.051 | 65 | 0.0407 | G A | 672 | 0.3101 | | | | |
| VSR | hCV7917138 | rs9822460 | G G | 53 | 0.039 | 29 | 0.0531 | 24 | 0.0296 | G A | 432 | 0.3181 | | | | |
| UCSFCCF | hCV8147903 | rs680014 | A A | 118 | 0.0544 | 25 | 0.0439 | 93 | 0.0581 | A G | 735 | 0.3387 | | | | |
| VSR | hCV8147903 | rs680014 | A A | 66 | 0.0486 | 21 | 0.0385 | 45 | 0.0554 | A G | 445 | 0.3277 | | | | |
| UCSFCCF | hCV8754449 | rs781226 | T T | 137 | 0.0632 | 37 | 0.065 | 100 | 0.0625 | T C | 852 | 0.3928 | | | | |
| VSR | hCV8754449 | rs781226 | T T | 73 | 0.0536 | 15 | 0.0274 | 58 | 0.0713 | T C | 460 | 0.338 | | | | |
| UCSFCCF | hCV8820007 | rs938390 | A A | 143 | 0.0659 | 29 | 0.0511 | 114 | 0.0712 | A T | 769 | 0.3545 | | | | |
| VSR | hCV8820007 | rs938390 | A A | 94 | 0.0693 | 28 | 0.0511 | 66 | 0.0816 | A T | 463 | 0.3412 | | | | |
| UCSFCCF | hCV8942032 | rs1264352 | C C | 46 | 0.0212 | 14 | 0.0246 | 32 | 0.02 | C G | 518 | 0.2388 | | | | |
| VSR | hCV8942032 | rs1264352 | C C | 34 | 0.0249 | 16 | 0.0292 | 18 | 0.0221 | C G | 298 | 0.2186 | | | | |

| Study | Marker | Case cnt | Case frq | Control cnt | Control frq | Genot | ALL cnt | ALL frq | Case cnt | Case frq | Control cnt | Control frq |
|---|---|---|---|---|---|---|---|---|---|---|---|---|
| UCSFCCF | hCV1053082 | 182 | 0.3199 | 506 | 0.3164 | C C | 1382 | 0.6375 | 370 | 0.6503 | 1012 | 0.6329 |
| VSR | hCV1053082 | 145 | 0.2646 | 251 | 0.3084 | C C | 914 | 0.6711 | 387 | 0.7062 | 527 | 0.6474 |
| UCSFCCF | hCV1116757 | 158 | 0.2777 | 516 | 0.3225 | T T | 1410 | 0.6501 | 387 | 0.6801 | 1023 | 0.6394 |
| VSR | hCV1116757 | 138 | 0.2546 | 234 | 0.2936 | T T | 926 | 0.6916 | 391 | 0.7214 | 535 | 0.6713 |
| UCSFCCF | hCV11425801 | 284 | 0.4991 | 786 | 0.4906 | T T | 602 | 0.2773 | 142 | 0.2496 | 460 | 0.2871 |
| VSR | hCV11425801 | 274 | 0.5009 | 408 | 0.5025 | T T | 358 | 0.2634 | 133 | 0.2431 | 225 | 0.2771 |
| UCSFCCF | hCV11425842 | 291 | 0.5123 | 785 | 0.4906 | C C | 606 | 0.2795 | 166 | 0.2923 | 440 | 0.275 |
| VSR | hCV11425842 | 277 | 0.5055 | 415 | 0.5098 | C C | 387 | 0.2841 | 167 | 0.3047 | 220 | 0.2703 |
| UCSFCCF | hCV11548152 | 180 | 0.3163 | 423 | 0.2647 | G G | 1512 | 0.6977 | 374 | 0.6573 | 1138 | 0.7121 |
| VSR | hCV11548152 | 150 | 0.2727 | 195 | 0.2393 | G G | 986 | 0.7223 | 383 | 0.6964 | 603 | 0.7399 |
| UCSFCCF | hCV11738775 | 280 | 0.4921 | 778 | 0.4862 | T T | 832 | 0.3836 | 232 | 0.4077 | 600 | 0.375 |
| VSR | hCV11738775 | 257 | 0.469 | 366 | 0.4502 | T T | 537 | 0.3946 | 226 | 0.4124 | 311 | 0.3825 |
| UCSFCCF | hCV11758801 | 40 | 0.0704 | 83 | 0.0518 | C C | 2042 | 0.9414 | 526 | 0.9261 | 1516 | 0.9469 |
| VSR | hCV11758801 | 40 | 0.0727 | 43 | 0.0528 | C C | 1280 | 0.9377 | 508 | 0.9236 | 772 | 0.9472 |
| UCSFCCF | hCV11861255 | 206 | 0.362 | 544 | 0.3398 | A A | 1276 | 0.588 | 336 | 0.5905 | 940 | 0.5871 |
| VSR | hCV11861255 | 185 | 0.3413 | 299 | 0.3724 | A A | 766 | 0.5695 | 327 | 0.6033 | 439 | 0.5467 |
| UCSFCCF | hCV12071939 | 191 | 0.3357 | 550 | 0.3438 | G G | 1334 | 0.615 | 363 | 0.638 | 971 | 0.6069 |
| VSR | hCV12071939 | 143 | 0.26 | 267 | 0.3284 | G G | 892 | 0.6544 | 382 | 0.6945 | 510 | 0.6273 |
| UCSFCCF | hCV1209800 | 38 | 0.0669 | 161 | 0.1005 | G G | 1967 | 0.9065 | 530 | 0.9331 | 1437 | 0.897 |
| VSR | hCV1209800 | 34 | 0.0617 | 69 | 0.0847 | G G | 1259 | 0.9217 | 517 | 0.9383 | 742 | 0.9104 |
| UCSFCCF | hCV1262973 | 92 | 0.1617 | 232 | 0.1449 | G G | 1817 | 0.8373 | 466 | 0.819 | 1351 | 0.8438 |
| VSR | hCV1262973 | 117 | 0.2175 | 128 | 0.1572 | G G | 1091 | 0.807 | 416 | 0.7732 | 675 | 0.8292 |
| UCSFCCF | hCV1348610 | 289 | 0.5088 | 776 | 0.4853 | G G | 628 | 0.2898 | 144 | 0.2535 | 484 | 0.3027 |
| VSR | hCV1348610 | 238 | 0.4457 | 383 | 0.4758 | G G | 417 | 0.3114 | 159 | 0.2978 | 258 | 0.3205 |
| UCSFCCF | hCV1408483 | 181 | 0.3181 | 426 | 0.2662 | C C | 1506 | 0.6943 | 374 | 0.6573 | 1132 | 0.7075 |
| VSR | hCV1408483 | 188 | 0.3431 | 238 | 0.2924 | C C | 886 | 0.6505 | 338 | 0.6168 | 548 | 0.6732 |
| UCSFCCF | hCV1452085 | 105 | 0.1845 | 307 | 0.1918 | C C | 1730 | 0.7972 | 461 | 0.8102 | 1269 | 0.7926 |
| VSR | hCV1452085 | 84 | 0.1525 | 161 | 0.1975 | C C | 1104 | 0.8082 | 460 | 0.8348 | 644 | 0.7902 |
| UCSFCCF | hCV15851766 | 14 | 0.0246 | 73 | 0.0457 | G G | 2079 | 0.9597 | 554 | 0.9754 | 1525 | 0.9543 |
| VSR | hCV15851766 | 15 | 0.0279 | 44 | 0.0549 | G G | 1281 | 0.956 | 523 | 0.9721 | 758 | 0.9451 |
| UCSFCCF | hCV15857769 | 238 | 0.4183 | 652 | 0.4075 | C C | 1067 | 0.4919 | 266 | 0.4675 | 801 | 0.5006 |
| VSR | hCV15857769 | 225 | 0.4098 | 349 | 0.4287 | C C | 683 | 0.5011 | 271 | 0.4936 | 412 | 0.5061 |
| UCSFCCF | hCV15879601 | 66 | 0.116 | 241 | 0.1504 | C C | 1851 | 0.8526 | 501 | 0.8805 | 1350 | 0.8427 |
| VSR | hCV15879601 | 59 | 0.1075 | 96 | 0.1181 | C C | 1199 | 0.8803 | 490 | 0.8925 | 709 | 0.8721 |
| UCSFCCF | hCV16134786 | 182 | 0.3204 | 448 | 0.28 | G G | 1466 | 0.6762 | 364 | 0.6408 | 1102 | 0.6888 |
| VSR | hCV16134786 | 183 | 0.3327 | 221 | 0.2712 | G G | 908 | 0.6652 | 345 | 0.6273 | 563 | 0.6908 |
| UCSFCCF | hCV1619596 | 229 | 0.4025 | 597 | 0.3736 | G G | 1155 | 0.533 | 286 | 0.5026 | 869 | 0.5438 |
| VSR | hCV1619596 | 223 | 0.4055 | 286 | 0.3514 | G G | 772 | 0.566 | 290 | 0.5273 | 482 | 0.5921 |
| UCSFCCF | hCV16336 | 93 | 0.1634 | 314 | 0.196 | C C | 1733 | 0.7982 | 469 | 0.8243 | 1264 | 0.789 |
| VSR | hCV16336 | 93 | 0.1697 | 171 | 0.2101 | C C | 1083 | 0.7952 | 453 | 0.8266 | 630 | 0.774 |
| UCSFCCF | hCV1723718 | 255 | 0.4482 | 683 | 0.4271 | G G | 1031 | 0.4756 | 253 | 0.4446 | 778 | 0.4866 |
| VSR | hCV1723718 | 230 | 0.4189 | 303 | 0.3722 | G G | 707 | 0.5187 | 266 | 0.4845 | 441 | 0.5418 |
| UCSFCCF | hCV1958451 | 196 | 0.3445 | 607 | 0.3796 | G G | 1230 | 0.5673 | 343 | 0.6028 | 887 | 0.5547 |
| VSR | hCV1958451 | 194 | 0.3553 | 302 | 0.3715 | G G | 773 | 0.5688 | 325 | 0.5952 | 448 | 0.551 |
| UCSFCCF | hCV2121658 | 108 | 0.1905 | 380 | 0.2375 | G G | 1656 | 0.7642 | 453 | 0.7989 | 1203 | 0.7519 |
| VSR | hCV2121658 | 113 | 0.2096 | 182 | 0.2244 | G G | 1037 | 0.7681 | 423 | 0.7848 | 614 | 0.7571 |
| UCSFCCF | hCV2358247 | 84 | 0.1479 | 178 | 0.1112 | A A | 1892 | 0.8727 | 482 | 0.8486 | 1410 | 0.8812 |
| VSR | hCV2358247 | 67 | 0.1216 | 73 | 0.0896 | A A | 1221 | 0.8939 | 479 | 0.8693 | 742 | 0.9104 |
| UCSFCCF | hCV2390937 | 66 | 0.116 | 228 | 0.1424 | C C | 1864 | 0.859 | 501 | 0.8805 | 1363 | 0.8513 |
| VSR | hCV2390937 | 58 | 0.1055 | 121 | 0.1485 | C C | 1183 | 0.8667 | 491 | 0.8927 | 692 | 0.8491 |
| UCSFCCF | hCV25473186 | 296 | 0.5202 | 772 | 0.4819 | T T | 615 | 0.2833 | 138 | 0.2425 | 477 | 0.2978 |
| VSR | hCV25473186 | 291 | 0.532 | 398 | 0.4883 | T T | 427 | 0.3135 | 147 | 0.2687 | 280 | 0.3436 |
| UCSFCCF | hCV25596936 | 88 | 0.1547 | 194 | 0.1211 | C C | 1876 | 0.8641 | 479 | 0.8418 | 1397 | 0.872 |

TABLE 19B-continued

| | | | | | | | | | | | | |
|---|---|---|---|---|---|---|---|---|---|---|---|---|
| VSR | hCV25596936 | 104 | 0.1891 | 107 | 0.1316 | C | C | 1137 | 0.8342 | 439 | 0.7982 | 698 | 0.8585 |
| UCSFCCF | hCV25615822 | 33 | 0.0581 | 79 | 0.0493 | C | C | 2056 | 0.9479 | 534 | 0.9401 | 1522 | 0.9507 |
| VSR | hCV25615822 | 54 | 0.098 | 55 | 0.0676 | C | C | 1254 | 0.9187 | 496 | 0.9002 | 758 | 0.9312 |
| UCSFCCF | hCV25983294 | 152 | 0.2676 | 519 | 0.324 | G | G | 1424 | 0.6562 | 397 | 0.6989 | 1027 | 0.6411 |
| VSR | hCV25983294 | 151 | 0.275 | 262 | 0.3227 | G | G | 884 | 0.6495 | 375 | 0.6831 | 509 | 0.6268 |
| UCSFCCF | hCV2637554 | 240 | 0.4233 | 673 | 0.4209 | T | T | 1063 | 0.4908 | 263 | 0.4638 | 800 | 0.5003 |
| VSR | hCV2637554 | 237 | 0.4357 | 327 | 0.4037 | T | T | 651 | 0.4808 | 244 | 0.4485 | 407 | 0.5025 |
| UCSFCCF | hCV26478797 | 204 | 0.3585 | 652 | 0.4078 | G | G | 1190 | 0.5489 | 334 | 0.587 | 856 | 0.5353 |
| VSR | hCV26478797 | 214 | 0.3919 | 317 | 0.3899 | G | G | 733 | 0.5394 | 304 | 0.5568 | 429 | 0.5277 |
| UCSFCCF | hCV26881276 | 260 | 0.4577 | 669 | 0.4184 | A | A | 988 | 0.4559 | 242 | 0.4261 | 746 | 0.4665 |
| VSR | hCV26881276 | 246 | 0.4473 | 351 | 0.4307 | A | A | 585 | 0.4286 | 218 | 0.3964 | 367 | 0.4503 |
| UCSFCCF | hCV27077072 | 233 | 0.4095 | 722 | 0.451 | C | C | 978 | 0.4507 | 276 | 0.4851 | 702 | 0.4385 |
| VSR | hCV27077072 | 238 | 0.4327 | 369 | 0.4533 | C | C | 605 | 0.4435 | 258 | 0.4691 | 347 | 0.4263 |
| UCSFCCF | hCV27473671 | 249 | 0.4376 | 655 | 0.4089 | T | T | 1084 | 0.4993 | 266 | 0.4675 | 818 | 0.5106 |
| VSR | hCV27473671 | 222 | 0.4036 | 310 | 0.3818 | T | T | 727 | 0.5338 | 277 | 0.5036 | 450 | 0.5542 |
| UCSFCCF | hCV27494483 | 64 | 0.1125 | 138 | 0.0862 | C | C | 1956 | 0.9014 | 501 | 0.8805 | 1455 | 0.9088 |
| VSR | hCV27494483 | 59 | 0.1073 | 62 | 0.0763 | C | C | 1239 | 0.909 | 489 | 0.8891 | 750 | 0.9225 |
| UCSFCCF | hCV27504565 | 199 | 0.3497 | 660 | 0.4128 | C | C | 1171 | 0.5401 | 331 | 0.5817 | 840 | 0.5253 |
| VSR | hCV27504565 | 187 | 0.3394 | 273 | 0.335 | C | C | 839 | 0.6142 | 351 | 0.637 | 4888 | 0.5988 |
| UCSFCCF | hCV27511436 | 147 | 0.2602 | 430 | 0.2701 | T | T | 1525 | 0.707 | 413 | 0.731 | 1112 | 0.6985 |
| VSR | hCV27511436 | 141 | 0.2564 | 239 | 0.2933 | T | T | 938 | 0.6872 | 393 | 0.7145 | 545 | 0.6687 |
| UCSFCCF | hCV2769503 | 278 | 0.4886 | 711 | 0.4441 | A | A | 928 | 0.4276 | 217 | 0.3814 | 711 | 0.4441 |
| VSR | hCV2769503 | 263 | 0.4907 | 336 | 0.4164 | A | A | 598 | 0.4453 | 208 | 0.3881 | 390 | 0.4833 |
| UCSFCCF | hCV27892569 | 219 | 0.3856 | 577 | 0.362 | T | T | 1253 | 0.5796 | 314 | 0.5528 | 939 | 0.5891 |
| VSR | hCV27892569 | 200 | 0.363 | 250 | 0.3086 | T | T | 823 | 0.6047 | 317 | 0.5753 | 506 | 0.6247 |
| UCSFCCF | hCV28036404 | 182 | 0.321 | 495 | 0.309 | T | T | 1393 | 0.6422 | 368 | 0.649 | 1025 | 0.6398 |
| VSR | hCV28036404 | 156 | 0.2857 | 277 | 0.3403 | T | T | 888 | 0.6529 | 377 | 0.6905 | 511 | 0.6278 |
| UCSFCCF | hCV2851380 | 91 | 0.1602 | 295 | 0.1841 | G | G | 1752 | 0.8074 | 473 | 0.8327 | 1279 | 0.7984 |
| VSR | hCV2851380 | 99 | 0.18 | 179 | 0.2199 | G | G | 1065 | 0.7808 | 444 | 0.8073 | 621 | 0.7629 |
| UCSFCCF | hCV29401764 | 223 | 0.3919 | 733 | 0.4584 | C | C | 989 | 0.4562 | 284 | 0.4991 | 705 | 0.4406 |
| VSR | hCV29401764 | 221 | 0.4048 | 374 | 0.4595 | C | C | 606 | 0.4456 | 267 | 0.489 | 339 | 0.4165 |
| UCSFCCF | hCV29537898 | 100 | 0.1761 | 247 | 0.1545 | C | C | 1797 | 0.8293 | 458 | 0.8063 | 1339 | 0.8374 |
| VSR | hCV29537898 | 90 | 0.1657 | 114 | 0.1402 | C | C | 1146 | 0.8451 | 448 | 0.825 | 698 | 0.8585 |
| UCSFCCF | hCV29538757 | 214 | 0.3768 | 713 | 0.4453 | C | C | 1050 | 0.4841 | 305 | 0.537 | 745 | 0.4653 |
| VSR | hCV29538757 | 226 | 0.4117 | 372 | 0.457 | C | C | 629 | 0.4615 | 277 | 0.5046 | 352 | 0.5324 |
| UCSFCCF | hCV302629 | 223 | 0.3926 | 654 | 0.4088 | A | A | 1106 | 0.5101 | 277 | 0.4877 | 829 | 0.5181 |
| VSR | hCV302629 | 209 | 0.3842 | 332 | 0.4094 | A | A | 703 | 0.5188 | 280 | 0.5147 | 423 | 0.5216 |
| UCSFCCF | hCV30308202 | 185 | 0.3251 | 530 | 0.3315 | G | G | 1352 | 0.6236 | 367 | 0.645 | 985 | 0.616 |
| VSR | hCV30308202 | 150 | 0.2742 | 267 | 0.328 | G | G | 878 | 0.6451 | 372 | 0.6801 | 506 | 0.6216 |
| UCSFCCF | hCV3054550 | 155 | 0.2724 | 386 | 0.2409 | C | C | 1580 | 0.7278 | 397 | 0.6977 | 1183 | 0.7385 |
| VSR | hCV3054550 | 161 | 0.2922 | 201 | 0.2466 | C | C | 968 | 0.7086 | 376 | 0.6824 | 592 | 0.7264 |
| UCSFCCF | hCV3082219 | 134 | 0.2355 | 317 | 0.198 | G | G | 1692 | 0.7797 | 428 | 0.7522 | 1264 | 0.7895 |
| VSR | hCV3082219 | 137 | 0.2532 | 165 | 0.203 | G | G | 1031 | 0.7614 | 393 | 0.7264 | 638 | 0.7847 |
| UCSFCCF | hCV31137507 | 234 | 0.4112 | 607 | 0.3789 | G | G | 1168 | 0.538 | 288 | 0.5062 | 880 | 0.5493 |
| VSR | hCV31137507 | 225 | 0.4106 | 314 | 0.3857 | G | G | 722 | 0.5301 | 277 | 0.5055 | 445 | 0.5467 |
| UCSFCCF | hCV31227848 | 59 | 0.1037 | 105 | 0.0656 | C | C | 2002 | 0.9226 | 509 | 0.8946 | 1493 | 0.9325 |
| VSR | hCV31227848 | 62 | 0.1129 | 54 | 0.0663 | C | C | 1246 | 0.9135 | 486 | 0.8852 | 760 | 0.9325 |
| UCSFCCF | hCV31573621 | 223 | 0.3919 | 672 | 0.4195 | T | T | 1112 | 0.5122 | 310 | 0.5448 | 802 | 0.5006 |
| VSR | hCV31573621 | 216 | 0.403 | 323 | 0.4002 | T | T | 704 | 0.5242 | 290 | 0.541 | 414 | 0.513 |
| UCSFCCF | hCV31705214 | 201 | 0.3533 | 551 | 0.3439 | A | A | 1303 | 0.6002 | 327 | 0.5747 | 976 | 0.6092 |
| VSR | hCV31705214 | 204 | 0.3709 | 250 | 0.3067 | A | A | 840 | 0.6154 | 315 | 0.5727 | 525 | 0.6442 |
| UCSFCCF | hCV32160712 | 187 | 0.3286 | 442 | 0.2762 | A | A | 1483 | 0.6837 | 365 | 0.6415 | 1118 | 0.6988 |
| VSR | hCV32160712 | 151 | 0.2771 | 207 | 0.2559 | A | A | 959 | 0.7083 | 374 | 0.6862 | 585 | 0.7231 |
| UCSFCCF | hCV435733 | 253 | 0.4446 | 641 | 0.4006 | C | C | 1049 | 0.4836 | 251 | 0.4411 | 798 | 0.4988 |
| VSR | hCV435733 | 253 | 0.4608 | 302 | 0.371 | C | C | 676 | 0.496 | 250 | 0.4554 | 426 | 0.5233 |
| UCSFCCF | hCV454333 | 127 | 0.2236 | 379 | 0.2367 | C | C | 1621 | 0.7473 | 435 | 0.7658 | 1186 | 0.7408 |
| VSR | hCV454333 | 100 | 0.1815 | 174 | 0.2159 | C | C | 1058 | 0.7797 | 446 | 0.8094 | 612 | 0.7593 |
| UCSFCCF | hCV540056 | 30 | 0.0527 | 129 | 0.0806 | C | C | 2009 | 0.9258 | 538 | 0.9455 | 1471 | 0.9188 |
| VSR | hCV540056 | 26 | 0.0474 | 64 | 0.0787 | C | C | 1272 | 0.9339 | 523 | 0.9526 | 749 | 0.9213 |
| UCSFCCF | hCV7917138 | 197 | 0.3462 | 475 | 0.2972 | A | A | 1401 | 0.6465 | 343 | 0.6028 | 1058 | 0.6621 |
| VSR | hCV7917138 | 173 | 0.3168 | 259 | 0.319 | A | A | 873 | 0.6429 | 344 | 0.63 | 529 | 0.6515 |
| UCSFCCF | hCV8147903 | 175 | 0.3076 | 560 | 0.3498 | G | G | 1317 | 0.6069 | 369 | 0.6485 | 948 | 0.5921 |
| VSR | hCV8147903 | 172 | 0.3156 | 273 | 0.3358 | G | G | 847 | 0.6237 | 352 | 0.6459 | 495 | 0.6089 |
| UCSFCCF | hCV8754449 | 203 | 0.3568 | 649 | 0.4056 | C | C | 1180 | 0.544 | 329 | 0.5782 | 851 | 0.5319 |
| VSR | hCV8754449 | 188 | 0.3431 | 272 | 0.3346 | C | C | 828 | 0.6084 | 345 | 0.6296 | 483 | 0.5941 |
| UCSFCCF | hCV8820007 | 207 | 0.3644 | 562 | 0.351 | T | T | 1257 | 0.5795 | 332 | 0.5845 | 925 | 0.5778 |
| VSR | hCV8820007 | 178 | 0.3248 | 285 | 0.3523 | T | T | 800 | 0.5895 | 342 | 0.6241 | 458 | 0.5661 |
| UCSFCCF | hCV8942032 | 151 | 0.2654 | 367 | 0.2294 | G | G | 1605 | 0.74 | 404 | 0.71 | 1201 | 0.7506 |
| VSR | hCV8942032 | 133 | 0.2427 | 165 | 0.2025 | G | G | 1031 | 0.7564 | 399 | 0.7281 | 632 | 0.7755 |

TABLE 19C

| Study | Marker | rs | HW (Control) pExact | allelicAsc chi2 | allelicAsc pAsym | allelicAsc pExact | DomGenotAsc chi2 | DomGenotAsc pAsym | RecGenotAsc chi2 | RecGenotAsc pAsym | AddGenotAsc chi2 | AddGenotAsc pAsym | OR.Hom | OR.Hom. 95Cl.L |
|---|---|---|---|---|---|---|---|---|---|---|---|---|---|---|
| UCSF | hCV1053082 | rs544115 | 9.57E-02 | 1.8813 | 1.70E-01 | 1.84E-01 | 0.5478 | 4.59E-01 | 4.1986 | 4.05E-02 | 1.8401 | 1.75E-01 | 0.574 | 0.3358 |
| CCF | | | | | | | | | | | | | | |
| VSR | hCV1053082 | rs544115 | 3.79E-01 | 5.9535 | 1.47E-02 | 1.54E-02 | 5.1272 | 2.36E-02 | 2.0145 | 1.56E-01 | 5.7805 | 1.62E-02 | 0.6052 | 0.331 |
| UCSF | hCV1116757 | rs3794971 | 7.54E-01 | 1.8049 | 1.79E-01 | 1.91E-01 | 3.0663 | 7.99E-02 | 0.1832 | 6.69E-01 | 1.7897 | 1.81E-01 | 1.04 | 0.6394 |
| CCF | | | | | | | | | | | | | | |
| VSR | hCV1116757 | rs3794971 | 7.21E-01 | 4.3026 | 0.0381 | 0.0407 | 3.8015 | 0.0512 | 1.3504 | 0.2450 | 4.246 | 0.0393 | 0.6353 | 0.3249 |
| UCSF | hCV11425801 | rs3805953 | 5.81E-01 | 3.7417 | 5.31E-02 | 5.74E-02 | 2.959 | 8.54E-02 | 2.008 | 1.56E-01 | 3.6971 | 5.45E-02 | 1.3012 | 0.993 |
| CCF | | | | | | | | | | | | | | |
| VSR | hCV11425801 | rs3805953 | 8.33E-01 | 3.1552 | 7.57E-02 | 7.83E-02 | 1.9414 | 1.64E-01 | 2.2927 | 1.30E-01 | 3.1695 | 7.50E-02 | 1.3231 | 0.9724 |
| UCSF | hCV11425842 | rs10948059 | 5.15E-01 | 2.6567 | 1.03E-01 | 1.04E-01 | 0.6196 | 4.31E-01 | 3.6571 | 5.58E-02 | 2.6452 | 1.04E-01 | 0.7846 | 0.5948 |
| CCF | | | | | | | | | | | | | | |
| VSR | hCV11425842 | rs10948059 | 5.74E-01 | 2.7491 | 9.73E-02 | 9.99E-02 | 1.9136 | 1.67E-01 | 1.8051 | 1.79E-01 | 2.8113 | 9.36E-02 | 0.7654 | 0.5589 |
| UCSF | hCV11548152 | rs11580249 | 8.49E-01 | 5.1795 | 2.29E-02 | 2.49E-02 | 5.9849 | 1.44E-02 | 0.1844 | 6.68E-01 | 5.2806 | 2.16E-02 | 1.2336 | 0.6694 |
| CCF | | | | | | | | | | | | | | |
| VSR | hCV11548152 | rs11580249 | 7.72E-01 | 3.669 | 5.54E-02 | 5.68E-02 | 3.1002 | 7.83E-02 | 1.3657 | 2.43E-01 | 3.6121 | 5.74E-02 | 1.5744 | 0.7942 |
| UCSF | hCV11738775 | rs6754561 | 2.44E-01 | 4.5652 | 3.26E-02 | 3.52E-02 | 1.902 | 1.68E-01 | 5.5721 | 1.82E-02 | 4.7722 | 2.89E-02 | 0.664 | 0.4783 |
| CCF | | | | | | | | | | | | | | |
| VSR | hCV11738775 | rs6754561 | 1.22E-01 | 4.301 | 3.81E-02 | 3.97E-02 | 1.223 | 2.69E-01 | 6.1599 | 1.31E-02 | 3.6121 | 4.05E-02 | 0.6577 | 0.4674 |
| UCSF | hCV11758801 | rs11841997 | 3.28E-01 | 3.8274 | 5.04E-02 | 5.52E-02 | 3.307 | 6.90E-02 | 1.1756 | 2.78E-01 | 3.7093 | 5.41E-02 | 2.8821 | 0.405 |
| CCF | | | | | | | | | | | | | | |
| VSR | hCV11758801 | rs11841997 | 1.00E+00 | 3.9487 | 4.69E-02 | 5.84E-02 | 3.133 | 7.67E-02 | 2.968 | 8.49E-02 | 3.892 | 4.85E-02 | 0.6456 | 0.4172 |
| UCSF | hCV11861255 | rs529407 | 2.74E-03 | 0.9704 | 3.25E-01 | 3.32E-01 | 0.0198 | 8.87E-01 | 4.4502 | 3.49E-01 | 0.9239 | 3.36E-01 | | |
| CCF | | | | | | | | | | | | | | |
| VSR | hCV11861255 | rs529407 | 1.76E-01 | 5.8243 | 1.58E-02 | 1.62E-02 | 4.2314 | 3.97E-02 | 3.2296 | 7.23E-02 | 5.5905 | 1.81E-02 | 0.6196 | 0.3928 |
| UCSF | hCV12071939 | rs1950943 | 9.42E-01 | 3.6497 | 5.61E-02 | 5.84E-02 | 1.7131 | 1.91E-01 | 5.3616 | 2.06E-02 | 3.7053 | 5.42E-02 | 0.5079 | 0.2887 |
| CCF | | | | | | | | | | | | | | |
| VSR | hCV12071939 | rs1950943 | 9.15E-01 | 4.558 | 3.28E-02 | 3.42E-02 | 6.5586 | 1.04E-02 | 0.0106 | 9.15E-01 | 4.3724 | 3.65E-02 | 0.9271 | 0.5472 |
| UCSF | hCV1209800 | rs35067690 | 1.00E+00 | 6.8747 | 8.74E-03 | 9.31E-03 | 6.4426 | 1.11E-02 | 1.4208 | 2.33E-01 | 6.9406 | 8.43E-03 | 0 | |
| CCF | | | | | | | | | | | | | | |
| VSR | hCV1209800 | rs35067690 | 9.86E-02 | 4.5292 | 3.33E-02 | 3.77E-02 | 3.5355 | 6.01E-02 | 2.7122 | 9.96E-02 | 4.3855 | 3.62E-02 | 0 | 0.8307 |
| UCSF | hCV1262973 | rs229653 | 3.31E-02 | 2.8401 | 9.19E-02 | 9.99E-02 | 1.9058 | 1.67E-01 | 2.0833 | 1.49E-01 | 2.6543 | 1.03E-01 | 1.7717 | |
| CCF | | | | | | | | | | | | | | |
| VSR | hCV1262973 | rs229653 | 9.20E-02 | 4.7235 | 2.98E-02 | 3.25E-02 | 6.5217 | 1.07E-02 | 0.4932 | 4.82E-01 | 4.6556 | 3.10E-02 | 0.7375 | 0.2545 |
| UCSF | hCV1348610 | rs3739636 | 3.92E-01 | 4.7184 | 2.98E-02 | 3.18E-02 | 4.9229 | 2.65E-02 | 1.6159 | 2.04E-01 | 4.6621 | 3.08E-02 | 1.3385 | 1.019 |
| CCF | | | | | | | | | | | | | | |
| VSR | hCV1348610 | rs3739636 | 3.18E-01 | 3.6947 | 5.46E-02 | 5.73E-02 | 0.7744 | 3.79E-01 | 5.1413 | 2.34E-02 | 3.4678 | 6.26E-02 | 1.3555 | 1.0033 |
| UCSF | hCV1408483 | rs17070848 | 7.80E-01 | 3.5792 | 5.85E-02 | 6.33E-02 | 4.9851 | 2.56E-02 | 0.0452 | 8.31E-01 | 3.6225 | 5.70E-02 | 1.0089 | 0.5449 |
| CCF | | | | | | | | | | | | | | |
| VSR | hCV1408483 | rs17070848 | 7.23E-01 | 4.0633 | 4.38E-02 | 4.77E-02 | 4.5874 | 3.22E-02 | 0.306 | 5.80E-01 | 4.0784 | 4.34E-02 | 1.2739 | 0.7171 |
| UCSF | hCV1453085 | rs12223005 | 2.06E-01 | 1.6991 | 1.92E-01 | 2.01E-01 | 0.8011 | 3.71E-01 | 3.5259 | 6.04E-02 | 1.6769 | 1.95E-01 | 0.3303 | 0.0993 |
| CCF | | | | | | | | | | | | | | |
| VSR | hCV1453085 | rs12223005 | 1.00E+00 | 3.5065 | 6.11E-02 | 6.21E-02 | 4.2302 | 3.97E-02 | 0.005 | 9.36E-01 | 3.431 | 6.40E-02 | 0.98 | 0.3703 |
| UCSF | hCV1585766 | rs2229995 | 1.00E+00 | 4.7105 | 3.00E-02 | 3.54E-02 | 4.8091 | 2.83E-02 | | | 4.8091 | 2.83E-02 | | |
| CCF | | | | | | | | | | | | | | |
| VSR | hCV1585766 | rs2229995 | 1.00E+00 | 5.444 | 1.96E-02 | 2.19E-02 | 5.5693 | 1.83E-02 | 2.3797 | 1.23E-01 | 5.5693 | 1.83E-02 | | |
| UCSF | hCV1585769 | rs2924914 | 4.01E-01 | 3.0613 | 8.02E-02 | 8.41E-02 | 1.8442 | 1.74E-01 | | | 2.9769 | 8.45E-02 | 1.3315 | 0.9638 |
| CCF | | | | | | | | | | | | | | |

TABLE 19C-continued

| | | | | | | | | | | | | | |
|---|---|---|---|---|---|---|---|---|---|---|---|---|---|
| VSR<br>UCSF<br>CCF | hCV15857769<br>hCV15879601 | rs2924914<br>rs2275769 | 8.13E-02<br>8.69E-01 | 1.5429<br>5.0195 | 2.14E-01<br>2.51E-02 | 2.27E-01<br>2.73E-02 | 0.2055<br>4.7726 | 6.50E-01<br>2.89E-02 | 4.5155<br>0.7923 | 3.36E-01<br>3.73E-01 | 1.5844<br>5.012 | 2.08E-01<br>2.52E-02 | 1.5203<br>0.4899 | 1.0085<br>1.0852 |
| VSR<br>UCSF<br>CCF | hCV15879601<br>hCV16134786 | rs2275769<br>rs2857595 | 4.68E-02<br>5.97E-01 | 2.5557<br>4.3847 | 1.10E-01<br>3.63E-02 | 1.26E-01<br>3.81E-02 | 1.3012<br>4.3936 | 2.54E-01<br>3.61E-02 | 5.4341<br>0.7309 | 1.97E-02<br>3.93E-01 | 2.4744<br>4.3449 | 1.16E-01<br>3.71E-02 | 0<br>1.3321 | 0.7957 |
| VSR<br>UCSF<br>CCF | hCV16134786<br>hCV1619596 | rs2857595<br>rs1048621 | 1.14E-01<br>4.21E-02 | 4.6354<br>2.9988 | 3.13E-02<br>8.33E-02 | 3.54E-02<br>8.94E-02 | 5.9503<br>2.857 | 1.47E-02<br>9.10E-02 | 0.0339<br>0.809 | 8.53E-01<br>3.68E-01 | 4.5185<br>2.8638 | 3.35E-02<br>9.06E-02 | 1.1581<br>1.243 | 0.6598<br>0.8815 |
| VSR<br>UCSF<br>CCF | hCV1619596<br>hCV16336 | rs1048621<br>rs362277 | 6.94E-01<br>3.82E-01 | 5.0407<br>3.1329 | 2.48E-01<br>7.67E-02 | 2.67E-02<br>8.47E-02 | 5.6219<br>3.2376 | 1.77E-02<br>7.20E-02 | 0.6652<br>0.2141 | 4.15E-01<br>6.44E-01 | 5.0508<br>3.0502 | 2.46E-02<br>8.07E-02 | 1.3369<br>0.7861 | 0.8468<br>0.3365 |
| VSR<br>UCSF<br>CCF | hCV16336<br>hCV1723718 | rs362277<br>rs12481805 | 7.41E-01<br>5.13E-01 | 7.1876<br>3.8839 | 7.34E-03<br>4.88E-02 | 8.10E-03<br>5.19E-02 | 5.5815<br>2.9562 | 1.82E-02<br>8.56E-02 | 4.5646<br>2.1993 | 3.26E-02<br>1.38E-01 | 7.2354<br>3.9421 | 7.15E-03<br>4.71E-02 | 0.214<br>1.3593 | 0.048<br>0.9742 |
| VSR<br>UCSF<br>CCF | hCV1723718<br>hCV1958451 | rs12481805<br>rs2985822 | 9.24E-01<br>9.48E-01 | 3.6917<br>4.1971 | 5.47E-02<br>4.05E-02 | 5.72E-02<br>4.14E-02 | 4.3047<br>3.9539 | 3.80E-02<br>4.68E-02 | 0.444<br>1.2038 | 5.05E-01<br>2.73E-01 | 3.5428<br>4.174 | 5.98E-02<br>4.10E-02 | 1.2553<br>0.7389 | 0.8516<br>0.4833 |
| VSR<br>UCSF<br>CCF | hCV1958451<br>hCV2121658 | rs2985822<br>rs1187332 | 2.40E-01<br>3.41E-01 | 4.5604<br>4.3002 | 3.27E-02<br>3.81E-02 | 3.35E-02<br>4.02E-02 | 2.6009<br>5.1465 | 1.07E-01<br>2.33E-02 | 4.153<br>0.0001 | 4.16E-02<br>9.61E-01 | 4.4562<br>4.49 | 3.48E-02<br>3.41E-02 | 0.5908<br>0.9373 | 0.3682<br>0.3672 |
| VSR<br>UCSF<br>CCF | hCV2121658<br>hCV2358247 | rs1187332<br>rs415989 | 7.57E-01<br>3.03E-02 | 2.4843<br>2.7624 | 1.15E-01<br>9.65E-02 | 1.20E-01<br>9.75E-02 | 1.3947<br>4.0243 | 2.38E-01<br>4.48E-02 | 4.1148<br>1.0344 | 4.25E-01<br>3.09E-01 | 2.5241<br>2.6772 | 1.12E-01<br>1.02E-01 | 0.2903<br>0.4876 | 0.0835<br>0.1087 |
| VSR<br>UCSF<br>CCF | hCV2358247<br>hCV2390937 | rs415989<br>rs739719 | 4.00E-01<br>8.61E-01 | 7.9749<br>3.1417 | 4.74E-03<br>7.63E-02 | 6.00E-03<br>8.49E-02 | 5.853<br>2.9448 | 1.56E-02<br>8.62E-02 | 7.4228<br>0.5694 | 6.44E-03<br>4.50E-01 | 7.8768<br>3.1343 | 5.01E-03<br>7.67E-02 | 0.5441 | 0.1188 |
| VSR<br>UCSF<br>CCF | hCV2390937<br>hCV25473186 | rs739719<br>rs2880415 | 2.18E-01<br>2.28E-01 | 5.0969<br>4.3841 | 2.40E-02<br>3.63E-02 | 2.44E-02<br>3.81E-02 | 5.414<br>6.3063 | 2.00E-02<br>1.20E-02 | 0.0605<br>0.6889 | 8.05E-01<br>4.07E-01 | 5.2977<br>4.3289 | 2.14E-02<br>3.75E-02 | 0.7047<br>1.3219 | 0.0637<br>1.0048 |
| VSR<br>UCSF<br>CCF | hCV25473186<br>hCV25596936 | rs2880415<br>rs6967117 | 8.85E-01<br>1.59E-01 | 7.4863<br>2.2975 | 6.22E-03<br>1.30E-01 | 6.51E-03<br>1.39E-01 | 8.5136<br>3.2629 | 3.52E-03<br>7.09E-02 | 2.1489<br>0.7923 | 1.43E-01<br>3.73E-01 | 7.7174<br>2.2646 | 5.47E-03<br>1.32E-01 | 1.5155<br>0.5303 | 1.0992<br>0.1171 |
| VSR<br>UCSF<br>CCF | hCV25596936<br>hCV25615822 | rs6967117<br>NONE | 1.24E-01<br>6.23E-01 | 8.1435<br>1.2345 | 4.32E-03<br>2.67E-01 | 4.78E-03<br>2.80E-01 | 8.6432<br>0.9387 | 3.28E-03<br>3.33E-01 | 0.2513<br>2.82 | 6.16E-01<br>9.31E-02 | 7.8335<br>1.2457 | 5.13E-03<br>2.64E-01 | 1.3912 | 0.501 |
| VSR<br>UCSF<br>CCF | NONE<br>hCV25983294 | NONE<br>rs3739709 | 1.00E+00<br>3.85E-01 | 4.1369<br>4.819 | 4.20E-02<br>2.81E-02 | 4.98E-02<br>3.07E-02 | 4.2329<br>6.2248 | 3.96E-02<br>1.26E-02 | 0.0772<br>0.0285 | 7.81E-01<br>8.65E-01 | 4.1629<br>4.8577 | 4.13E-02<br>2.75E-02 | 1.5282<br>0.8777 | 0.0954<br>0.515 |
| VSR<br>UCSF<br>CCF | hCV25983294<br>hCV2637554 | rs3739709<br>rs3205421 | 3.44E-01<br>3.62E-01 | 4.3198<br>4.974 | 3.77E-02<br>2.57E-02 | 3.98E-02<br>2.85E-02 | 4.5466<br>2.2274 | 3.30E-02<br>1.36E-01 | 0.5404<br>6.0734 | 4.62E-01<br>1.37E-02 | 4.1249<br>5.0067 | 4.23E-02<br>2.52E-02 | 0.7614<br>1.5451 | 0.4492<br>1.1091 |
| VSR<br>UCSF<br>CCF | hCV2637554<br>hCV26478797 | rs3205421<br>rs2015018 | 3.99E-01<br>2.31E-02 | 4.3776<br>3.2424 | 3.64E-02<br>7.18E-02 | 3.80E-02<br>7.43E-02 | 3.793<br>4.5232 | 5.15E-02<br>3.34E-02 | 1.707<br>0.0466 | 1.91E-01<br>8.29E-01 | 4.2587<br>3.3871 | 3.90E-02<br>6.57E-02 | 1.3827<br>0.8731 | 0.9553<br>0.5698 |
| VSR<br>UCSF<br>CCF | hCV26478797<br>hCV26881276 | rs2015018<br>rs2344829 | 4.32E-01<br>7.67E-02 | 3.0398<br>1.6418 | 8.12E-02<br>2.00E-01 | 8.40E-02<br>2.12E-01 | 1.1134<br>2.7694 | 2.91E-01<br>9.61E-02 | 4.8681<br>0.0052 | 2.74E-02<br>9.35E-01 | 3.047<br>1.5938 | 8.09E-02<br>2.07E-01 | 0.5897<br>1.1057 | 0.3705<br>0.8058 |
| VSR<br>UCSF<br>CCF | hCV26881276<br>hCV27077072 | rs2344829<br>rs8060368 | 3.46E-01<br>6.95E-01 | 5.9931<br>2.5397 | 1.44E-02<br>1.11E-01 | 1.60E-02<br>1.14E-01 | 3.9019<br>3.68 | 4.82E-02<br>5.51E-02 | 3.9451<br>0.1126 | 4.70E-02<br>7.37E-01 | 5.7504<br>2.5305 | 1.65E-02<br>1.12E-01 | 1.4926<br>0.8622 | 1.0675<br>0.6234 |

TABLE 19C-continued

| | | | | | | | | | | |
|---|---|---|---|---|---|---|---|---|---|---|
| VSR | hCV27077072 | rs8060368 | 1.00E+00 | 3.1185 | 7.74E-02 | 8.22E-02 | 2.4362 | 1.19E-01 | 1.6353 | 3.0097 | 7.74E-02 | 0.7411 | 0.5123 |
| UCSF | hCV27473671 | rs3750465 | 9.51E-01 | 3.3546 | 6.70E-02 | 6.87E-02 | 3.1234 | 7.72E-02 | 1.1247 | 3.3751 | 6.62E-02 | 1.2873 | 0.9103 |
| CCF | | | | | | | | | | | |
| VSR | hCV27473671 | rs3750465 | 9.27E-01 | 5.2115 | 2.24E-02 | 2.50E-02 | 3.367 | 6.65E-02 | 3.8604 | 5.1535 | 2.32E-02 | 1.5933 | 1.0529 |
| UCSF | hCV27494483 | rs3748743 | 2.72E-02 | 3.9163 | 4.78E-02 | 5.21E-02 | 3.7863 | 5.17E-02 | 0.3155 | 3.7048 | 5.43E-02 | 1.4521 | 0.4354 |
| CCF | | | | | | | | | | | |
| VSR | hCV27494483 | rs3748743 | 1.00E+00 | 4.7395 | 2.95E-02 | 3.30E-02 | 4.4302 | 3.53E-02 | 0.865 | 4.7363 | 2.95E-02 | 3.0675 | 0.2774 |
| UCSF | hCV27504565 | rs3219489 | 4.17E-02 | 2.6893 | 1.01E-01 | 1.07E-01 | 5.3732 | 2.04E-02 | 0.3093 | 2.7588 | 9.67E-02 | 0.9997 | 0.6757 |
| CCF | | | | | | | | | | | |
| VSR | hCV27504565 | rs3219489 | 6.37E-02 | 6.3249 | 1.19E-02 | 1.22E-02 | 2.0298 | 1.54E-01 | 12.829 | 6.2596 | 1.24E-02 | 0.3347 | 0.1799 |
| UCSF | hCV27511436 | rs3750145 | 2.79E-01 | 4.7174 | 2.99E-02 | 2.96E-02 | 2.1238 | 1.45E-01 | 8.5394 | 4.7125 | 2.99E-02 | 0.2692 | 0.1066 |
| CCF | | | | | | | | | | | |
| VSR | hCV27511436 | rs3750145 | 4.85E-01 | 3.434 | 6.39E-02 | 7.13E-02 | 3.2092 | 7.32E-02 | 0.7905 | 3.3344 | 6.78E-02 | 0.7158 | 0.3861 |
| UCSF | hCV2769503 | rs4787956 | 9.55E-01 | 6.0949 | 1.36E-02 | 1.50E-02 | 6.7483 | 9.38E-03 | 1.3572 | 6.1512 | 1.31E-02 | 1.3545 | 0.9929 |
| CCF | | | | | | | | | | | |
| VSR | hCV2769503 | rs4787956 | 5.09E-01 | 9.7933 | 1.75E-03 | 1.95E-03 | 11.821 | 5.86E-04 | 1.4515 | 9.8523 | 1.70E-03 | 1.5046 | 1.0422 |
| UCSF | hCV27892569 | rs4903741 | 3.97E-01 | 2.7801 | 9.54E-02 | 9.57E-02 | 2.2605 | 1.33E-01 | 1.3606 | 2.8366 | 9.21E-02 | 1.3419 | 0.8828 |
| CCF | | | | | | | | | | | |
| VSR | hCV27892569 | rs4903741 | 4.12E-03 | 1.8263 | 1.77E-01 | 1.79E-01 | 3.3443 | 6.74E-02 | 0.1334 | 1.7125 | 1.91E-01 | 1.005 | 0.6399 |
| UCSF | hCV28036404 | rs4812768 | 3.21E-02 | 1.2024 | 2.73E-01 | 2.82E-01 | 0.1544 | 6.94E-01 | 4.3224 | 1.1665 | 2.80E-01 | 0.5774 | 0.3379 |
| CCF | | | | | | | | | | | |
| VSR | hCV28036404 | rs4812768 | 1.28E-01 | 5.3749 | 2.04E-02 | 2.13E-02 | 5.6716 | 1.72E-02 | 0.7758 | 5.6186 | 1.78E-02 | 0.6777 | 0.3437 |
| UCSF | hCV2851380 | rs12445805 | 2.89E-02 | 4.529 | 3.33E-02 | 3.60E-02 | 3.185 | 7.43E-02 | 3.1432 | 4.3423 | 3.72E-02 | 0.3863 | 0.1348 |
| CCF | | | | | | | | | | | |
| VSR | hCV2851380 | rs12445805 | 7.53E-01 | 3.7815 | 5.18E-02 | 5.25E-02 | 3.776 | 5.20E-02 | 0.433 | 3.7227 | 5.37E-02 | 0.6993 | 0.28 |
| UCSF | hCV29401764 | rs7793552 | 1.57E-01 | 2.3924 | 1.22E-01 | 1.30E-01 | 5.7341 | 1.66E-02 | 0.3114 | 2.411 | 1.20E-01 | 0.956 | 0.6916 |
| CCF | | | | | | | | | | | |
| VSR | hCV29401764 | rs7793552 | 9.39E-01 | 5.9882 | 1.44E-02 | 1.46E-02 | 6.9627 | 8.32E-03 | 1.0087 | 5.8764 | 1.53E-02 | 0.7291 | 0.5084 |
| UCSF | hCV29537898 | rs6073804 | 6.31E-01 | 4.1761 | 4.10E-02 | 4.70E-02 | 2.8557 | 9.10E-02 | 3.5835 | 4.0584 | 4.40E-02 | 2.2489 | 0.9794 |
| CCF | | | | | | | | | | | |
| VSR | hCV29537898 | rs6073804 | 1.14E-01 | 3.821 | 5.06E-02 | 5.96E-02 | 2.7919 | 9.47E-02 | 4.704 | 3.9237 | 4.76E-02 | 7.7902 | 0.9071 |
| UCSF | hCV29539757 | rs10110659 | 1.46E-01 | 5.5454 | 1.85E-02 | 1.97E-02 | 8.6151 | 3.33E-03 | 0.0484 | 5.6203 | 1.78E-02 | 0.837 | 0.5894 |
| CCF | | | | | | | | | | | |
| VSR | hCV29539757 | rs10110659 | 6.39E-01 | 7.379 | 6.60E-03 | 7.33E-03 | 6.8624 | 8.80E-03 | 2.6171 | 7.4502 | 6.34E-03 | 0.6495 | 0.4404 |
| UCSF | hCV302629 | rs9284183 | 4.55E-01 | 6.072 | 1.37E-02 | 1.46E-02 | 1.5552 | 2.12E-01 | 11.66 | 5.9952 | 1.43E-02 | 1.7394 | 1.2525 |
| CCF | | | | | | | | | | | |
| VSR | hCV302629 | rs9284183 | 4.28E-01 | 1.2194 | 2.69E-01 | 2.76E-01 | 0.0616 | 8.04E-01 | 4.4477 | 1.2037 | 2.73E-01 | 1.4837 | 0.993 |
| UCSF | hCV3030202 | rs9482985 | 2.71E-01 | 3.3551 | 6.70E-02 | 6.92E-02 | 1.5017 | 2.20E-01 | 4.8497 | 3.3181 | 6.85E-02 | 0.5432 | 0.3182 |
| CCF | | | | | | | | | | | |
| VSR | hCV3030202 | rs9482985 | 4.66E-01 | 4.0472 | 4.42E-02 | 4.58E-02 | 4.8822 | 2.71E-02 | 0.1543 | 3.8598 | 4.95E-02 | 0.8294 | 0.4955 |
| UCSF | hCV3054550 | rs1559599 | 8.36E-01 | 4.1733 | 4.11E-02 | 4.60E-02 | 3.5169 | 6.07E-02 | 1.6062 | 4.1327 | 4.21E-02 | 1.5351 | 0.8458 |
| CCF | | | | | | | | | | | |
| VSR | hCV3054550 | rs1559599 | 3.36E-01 | 2.2114 | 1.37E-01 | 1.50E-01 | 3.0804 | 7.92E-02 | 0.0322 | 2.193 | 1.39E-01 | 1.0019 | 0.5064 |
| UCSF | hCV3082219 | rs1884833 | 1.00E+00 | 2.8129 | 9.35E-02 | 9.54E-02 | 3.4024 | 6.51E-02 | 0.0012 | 2.8432 | 9.18E-02 | 1.0336 | 0.434 |
| CCF | | | | | | | | | | | |
| VSR | hCV3082219 | rs1884833 | 1.00E+00 | 6.4474 | 1.11E-02 | 1.33E-02 | 6.0815 | 1.37E-02 | 1.3727 | 6.4841 | 1.09E-02 | 1.7858 | 0.7515 |
| UCSF | hCV31137507 | rs7660668 | 4.76E-01 | 3.1157 | 7.75E-02 | 7.98E-02 | 3.147 | 7.61E-02 | 0.7113 | 3.0745 | 7.95E-02 | 1.2488 | 0.8674 |
| CCF | | | | | | | | | | | |
| VSR | hCV31137507 | rs7660668 | 1.00E+00 | 2.7419 | 9.77E-02 | 1.04E-01 | 2.2328 | 1.35E-01 | 1.279 | 2.7397 | 9.79E-02 | 1.3436 | 0.8834 |
| UCSF | hCV31227848 | rs11809423 | 4.36E-01 | 7.9108 | 4.91E-03 | 6.04E-03 | 8.4827 | 3.59E-03 | 0.0031 | 7.8545 | 5.07E-03 | 0.9777 | 0.1015 |
| CCF | | | | | | | | | | | |

TABLE 19C-continued

| Study | Marker | | | OR.Hom. 95CLU | OR.Het | OR.Het. 95CI.L | OR.Het. 95CLU | G Statistic | G Statistic pAsym | OR | std.ln (OR) | OR99CI.L | OR99CI.U | OR95CI.L | OR95CI.U |
|---|---|---|---|---|---|---|---|---|---|---|---|---|---|---|---|
| VSR | hCV31227848 | rs11809423 | | 1.00E+00 | 8.9352 | 2.80E-03 | 3.13E-03 | 9.2748 | 2.32E-03 | 0.0792 | 7.78E-01 | 9.0359 | 2.65E-03 | 1.5638 | 0.0976 |
| UCSF | hCV31573621 | rs11079818 | | 4.66E-01 | 3.8384 | 5.01E-02 | 5.05E-02 | 3.2818 | 7.01E-02 | 1.663 | 1.97E-01 | 3.9118 | 4.79E-02 | 0.7276 | 0.4915 |
| CCF | | | | | | | | | | | | | | | |
| VSR | hCV31573621 | rs11079818 | | 5.47E-01 | 2.7923 | 9.47E-02 | 1.03E-01 | 1.0148 | 3.14E-01 | 4.4251 | 3.54E-02 | 2.8097 | 9.37E-02 | 0.6118 | 0.3888 |
| UCSF | hCV31705214 | rs12804599 | | 8.84E-01 | 4.2814 | 3.85E-02 | 3.94E-02 | 2.0882 | 1.48E-01 | 5.2885 | 2.15E-02 | 4.2313 | 3.97E-02 | 1.6316 | 1.0929 |
| CCF | | | | | | | | | | | | | | | |
| VSR | hCV31705214 | rs12804599 | | 1.58E-01 | 5.9636 | 1.46E-02 | 1.60E-02 | 7.0819 | 7.79E-03 | 0.3533 | 5.52E-01 | 5.8152 | 1.59E-02 | 1.2917 | 0.7918 |
| UCSF | hCV32160712 | rs11079160 | | 7.14E-01 | 5.7112 | 1.69E-02 | 1.94E-02 | 6.367 | 1.16E-02 | 0.3901 | 5.32E-01 | 5.8369 | 1.57E-02 | 1.3018 | 0.7291 |
| CCF | | | | | | | | | | | | | | | |
| VSR | hCV32160712 | rs11079160 | | 8.90E-01 | 3.3547 | 6.70E-02 | 6.90E-02 | 2.1431 | 1.43E-01 | 3.0135 | 8.26E-02 | 3.3083 | 6.89E-02 | 1.8402 | 0.9516 |
| UCSF | hCV435733 | rs10276935 | | 5.73E-02 | 4.9763 | 2.57E-02 | 2.77E-02 | 5.5811 | 1.82E-02 | 0.833 | 3.61E-01 | 4.7987 | 2.85E-02 | 1.2836 | 0.9311 |
| CCF | | | | | | | | | | | | | | | |
| VSR | hCV435733 | rs10276935 | | 4.96E-03 | 1.658 | 1.98E-01 | 2.02E-01 | 6.059 | 1.38E-02 | 1.7917 | 1.81E-01 | 1.6077 | 2.05E-01 | 0.9114 | 0.6167 |
| UCSF | hCV454333 | rs10916581 | | 4.08E-01 | 2.4396 | 1.18E-01 | 1.31E-01 | 1.3942 | 2.38E-01 | 3.1385 | 7.65E-02 | 2.4218 | 1.20E-01 | 0.4544 | 0.1901 |
| CCF | | | | | | | | | | | | | | | |
| VSR | hCV454333 | rs10916581 | | 9.04E-02 | 6.7538 | 9.35E-03 | 9.52E-03 | 4.7879 | 2.87E-02 | 4.4834 | 3.42E-02 | 6.4961 | 1.08E-02 | 0.343 | 0.1278 |
| UCSF | hCV540056 | rs346802 | | 5.17E-01 | 3.8011 | 5.12E-02 | 5.63E-02 | 4.3627 | 3.67E-02 | 0.5851 | 4.44E-01 | 3.8532 | 4.97E-02 | 2.7342 | 0.1707 |
| CCF | | | | | | | | | | | | | | | |
| VSR | hCV540056 | rs346802 | | 6.30E-01 | 5.0445 | 2.47E-02 | 2.84E-02 | 5.223 | 2.23E-02 | 1.0708 | | 5.223 | 2.23E-02 | 1.3762 | 0.8737 |
| UCSF | hCV7917138 | rs9822460 | | 2.21E-01 | 6.3815 | 1.15E-02 | 1.21E-02 | 6.4489 | 1.11E-02 | | 3.01E-01 | 6.2249 | 1.26E-02 | | |
| CCF | | | | | | | | | | | | | | | |
| VSR | hCV7917138 | rs9822460 | | 3.02E-02 | 2.0808 | 1.49E-01 | 1.55E-01 | 0.6537 | 4.19E-01 | 4.8306 | 2.80E-02 | 2.0835 | 1.49E-01 | 1.8582 | 1.0639 |
| UCSF | hCV8147903 | rs680014 | | 4.01E-01 | 6.0117 | 1.42E-02 | 1.45E-02 | 5.5927 | 1.80E-02 | 1.6351 | 2.01E-01 | 5.8658 | 1.54E-02 | 0.6906 | 0.437 |
| CCF | | | | | | | | | | | | | | | |
| VSR | hCV8147903 | rs680014 | | 3.63E-02 | 2.8258 | 9.28E-02 | 9.42E-02 | 1.9048 | 1.68E-01 | 1.996 | 1.58E-01 | 2.7684 | 9.61E-02 | 0.6562 | 0.3841 |
| UCSF | hCV8754449 | rs781226 | | 1.09E-01 | 2.0954 | 1.48E-01 | 1.56E-01 | 3.6323 | 5.67E-02 | 0.0453 | 8.31E-01 | 2.1424 | 1.43E-01 | 0.9571 | 0.6428 |
| CCF | | | | | | | | | | | | | | | |
| VSR | hCV8754449 | rs781226 | | 2.62E-02 | 5.9675 | 1.46E-02 | 1.46E-02 | 1.7282 | 1.89E-01 | 12.467 | 4.14E-04 | 5.8303 | 1.58E-02 | 0.3621 | 0.2018 |
| UCSF | hCV8820007 | rs938390 | | 2.66E-02 | 0.8237 | 3.64E-01 | 3.76E-01 | 0.0782 | 7.79E-01 | 2.764 | 9.64E-02 | 0.7944 | 3.73E-01 | 0.7088 | 0.4627 |
| CCF | | | | | | | | | | | | | | | |
| VSR | hCV8820007 | rs938390 | | 2.72E-02 | 7.008 | 8.11E-03 | 8.99E-03 | 4.5349 | 3.32E-02 | 4.7099 | 3.00E-02 | 6.5843 | 1.03E-02 | 0.5681 | 0.3573 |
| UCSF | hCV8942032 | rs1264352 | | 5.20E-01 | 3.55 | 5.95E-02 | 6.61E-02 | 3.5971 | 5.79E-02 | 0.4287 | 5.13E-01 | 3.5083 | 6.11E-02 | 1.3006 | 0.6871 |
| CCF | | | | | | | | | | | | | | | |
| VSR | hCV8942032 | rs1264352 | | 7.41E-02 | 4.1819 | 4.09E-02 | 4.49E-02 | 3.9886 | 4.58E-02 | 0.6813 | 4.09E-01 | 3.947 | 4.70E-02 | 1.408 | 0.7097 |

| Study | Marker | OR.Hom. 95CLU | OR.Het | OR.Het 95CI.L | OR.Het. 95CLU | G Statistic | G Statistic pAsym | OR | std.ln (OR) | OR99CI.L | OR99CI.U | OR95CI.L | OR95CI.U |
|---|---|---|---|---|---|---|---|---|---|---|---|---|---|
| UCSF | hCV1053082 | 0.9814 | 0.9838 | 0.7998 | 1.2101 | 4.5688 | 1.02E-01 | 0.8873 | 0.0872 | 0.7088 | 1.1108 | 0.7479 | 1.0527 |
| CCF | | | | | | | | | | | | | | |
| VSR | hCV1053082 | 1.1065 | 0.7867 | 0.617 | 1.003 | 5.8263 | 5.43E-02 | 0.7782 | 0.103 | 0.5969 | 1.0145 | 0.636 | 0.9521 |
| UCSF | hCV1116757 | 1.6918 | 0.8094 | 0.654 | 1.0017 | 3.9968 | 1.36E-01 | 0.8876 | 0.0888 | 0.7061 | 1.1157 | 0.7458 | 1.0563 |
| CCF | | | | | | | | | | | | | | |
| VSR | hCV1116757 | 1.2422 | 0.8069 | 0.63 | 1.0336 | 4.2673 | 1.18E-01 | 0.8016 | 0.1068 | 0.6088 | 1.0553 | 0.6502 | 0.9881 |
| UCSF | hCV11425801 | 1.7051 | 1.1705 | 0.9281 | 1.4761 | 3.7602 | 1.53E-01 | 1.1429 | 0.0691 | 0.9566 | 1.3654 | 0.9982 | 1.3085 |
| CCF | | | | | | | | | | | | | | |
| VSR | hCV11425801 | 1.8004 | 1.1361 | 0.873 | 1.4785 | 3.1782 | 2.04E-01 | 1.1491 | 0.0783 | 0.9393 | 1.4059 | 0.9857 | 1.3397 |
| UCSF | hCV11425842 | 1.035 | 0.9826 | 0.7858 | 1.2287 | 3.7537 | 1.53E-01 | 0.8932 | 0.0693 | 0.7471 | 1.0678 | 0.7797 | 1.0232 |
| CCF | | | | | | | | | | | | | | |
| VSR | hCV11425842 | 1.0482 | 0.8793 | 0.6833 | 1.1315 | 2.8121 | 2.45E-01 | 0.878 | 0.0785 | 0.7173 | 1.0747 | 0.7528 | 1.024 |
| UCSF | hCV11548152 | 2.273 | 1.2948 | 1.0496 | 1.5973 | 5.8774 | 5.29E-02 | 1.2289 | 0.0907 | 0.9729 | 1.5522 | 1.0288 | 1.4679 |
| CCF | | | | | | | | | | | | | | |

TABLE 19C-continued

| | | | | | | | | | | |
|---|---|---|---|---|---|---|---|---|---|---|
| VSR | hCV11548152 | 3.1213 | 1.2111 | 0.9447 | 1.5526 | 3.5834 | 1.67E-01 | 1.2289 | 0.1077 | 0.9311 | 1.622 | 0.995 | 1.5179 |
| UCSF | hCV11738775 | 0.9219 | 0.9308 | 0.759 | 1.1414 | 6.296 | 4.29E-02 | 0.8572 | 0.0722 | 0.7118 | 1.0323 | 0.7442 | 0.9874 |
| CCF | | | | | | | | | | | | | |
| VSR | hCV11738775 | 0.9255 | 0.9663 | 0.7646 | 1.2211 | 6.3672 | 4.14E-02 | 0.8453 | 0.0811 | 0.686 | 1.0416 | 0.7211 | 0.9909 |
| UCSF | hCV11758801 | 20.513 | 1.389 | 0.9403 | 2.0517 | 3.3582 | 1.87E-01 | 1.4427 | 0.1883 | 0.8882 | 2.3432 | 0.9974 | 2.0867 |
| CCF | | | | | | | | | | | | | |
| VSR | hCV11758801 | 1.4137 | 0.906 | 2.2057 | 1.2979 | 5.0497 | | 1.5378 | 0.2181 | 0.8769 | 2.6969 | 1.0029 | 2.3579 |
| UCSF | hCV11861255 | 0.9991 | 1.0594 | 0.8647 | | | 8.01E-02 | 0.9226 | 0.0817 | 0.7474 | 1.1389 | 0.786 | 1.083 |
| CCF | | | | | | | | | | | | | |
| VSR | hCV11861255 | 0.9773 | 0.8306 | 0.6583 | 1.0482 | 5.7533 | 5.63E-02 | 0.8012 | 0.0919 | 0.6322 | 1.0153 | 0.669 | 0.9594 |
| UCSF | hCV12071939 | 0.8937 | 0.9289 | 0.7575 | 1.1392 | 6.4 | 4.08E-02 | 0.8483 | 0.0862 | 0.6794 | 1.0592 | 0.7164 | 1.0044 |
| CCF | | | | | | | | | | | | | |
| VSR | hCV12071939 | 1.5708 | 0.715 | 0.561 | 0.9113 | 7.4172 | 2.45E-02 | 0.8078 | 0.1001 | 0.6243 | 1.0453 | 0.664 | 0.9829 |
| UCSF | hCV1209800 | | 0.6399 | 0.4432 | 0.9239 | | | 0.6215 | 0.183 | 0.388 | 0.9957 | 0.4342 | 0.8896 |
| CCF | | | | | | | | | | | | | |
| VSR | hCV1209800 | | 0.7072 | 0.462 | 1.0826 | 2.9516 | 2.29E-01 | 0.6421 | 0.2097 | 0.3741 | 1.012 | 0.4257 | 0.9685 |
| UCSF | hCV1262973 | 3.7788 | 1.1497 | 0.8834 | 1.4962 | | | 1.2188 | 0.1176 | 0.9004 | 1.6498 | 0.968 | 1.5346 |
| CCF | | | | | | | | | | | | | |
| VSR | hCV1262973 | 2.1377 | 1.4832 | 1.1222 | 1.9602 | 7.9944 | 1.84E-02 | 1.3186 | 0.1276 | 0.9493 | 1.8315 | 1.0269 | 1.6932 |
| UCSF | hCV1348610 | 1.7582 | 1.2518 | 0.9947 | 1.5753 | 5.2978 | 7.07E-02 | 1.162 | 0.0692 | 0.9724 | 1.3886 | 1.0147 | 1.3307 |
| CCF | | | | | | | | | | | | | |
| VSR | hCV1348610 | 1.8313 | 1.0083 | 0.7811 | 1.3017 | 5.0887 | 7.85E-02 | 1.1644 | 0.0792 | 0.9495 | 1.4278 | 0.997 | 1.3598 |
| UCSF | hCV1408483 | 1.8681 | 1.286 | 1.0429 | 1.5858 | 5.472 | 6.48E-02 | 1.1866 | 0.0905 | 0.9398 | 1.4982 | 0.9937 | 1.417 |
| CCF | | | | | | | | | | | | | |
| VSR | hCV1408483 | 2.263 | 1.2807 | 1.0131 | 1.619 | 4.5423 | 1.03E-01 | 1.2184 | 0.0981 | 0.9464 | 1.5685 | 1.0053 | 1.4766 |
| UCSF | hCV1452085 | 1.0993 | 0.9415 | 0.7362 | 1.2039 | 4.3881 | 1.11E-01 | 0.8613 | 0.1146 | 0.6411 | 1.1571 | 0.688 | 1.0783 |
| CCF | | | | | | | | | | | | | |
| VSR | hCV1452085 | 2.5937 | 0.7304 | 0.5467 | 0.9759 | 4.5378 | 1.03E-01 | 0.7814 | 0.132 | 0.5562 | 1.0978 | 0.6033 | 1.0121 |
| UCSF | hCV15851766 | | 0.5279 | 0.2956 | 0.9429 | | | 0.5338 | 0.2938 | 0.2504 | 1.1379 | 0.3001 | 0.9495 |
| CCF | | | | | | | | | | | | | |
| VSR | hCV15851766 | 1.8396 | 0.4941 | 0.2721 | 0.8972 | 3.1352 | 2.09E-01 | 0.5012 | 0.3016 | 0.2305 | 1.0901 | 0.2775 | 0.9053 |
| UCSF | hCV15857769 | | 1.0992 | 0.8971 | 1.3468 | | | 1.1387 | 0.0743 | 0.9404 | 1.3788 | 0.9845 | 1.3172 |
| CCF | | | | | | | | | | | | | |
| VSR | hCV15857769 | 2.2918 | 0.9801 | 0.781 | 1.23 | 4.4526 | 1.08E-01 | 1.1125 | 0.0859 | 0.8918 | 1.388 | 0.9402 | 1.3165 |
| UCSF | hCV15879601 | 2.2181 | 0.7379 | 0.5516 | 0.9872 | 5.1115 | 7.76E-02 | 0.7329 | 0.1392 | 0.5121 | 1.0489 | 0.558 | 0.9628 |
| CCF | | | | | | | | | | | | | |
| VSR | hCV15879601 | | 0.8893 | 0.6304 | 1.2545 | 4.4069 | 1.10E-01 | 0.7676 | 0.1658 | 0.5008 | 1.1767 | 0.5546 | 1.0624 |
| UCSF | hCV16134786 | 2.23 | 1.2299 | 0.9978 | 1.5159 | | | 1.2019 | 0.0879 | 0.9584 | 1.5073 | 1.0117 | 1.4278 |
| CCF | | | | | | | | | | | | | |
| VSR | hCV16134786 | 2.0327 | 1.3513 | 1.0658 | 1.7133 | 6.1591 | 4.60E-02 | 1.2376 | 0.0991 | 0.9587 | 1.5977 | 1.0191 | 1.5031 |
| UCSF | hCV1619596 | 1.7527 | 1.1655 | 0.9517 | 1.4273 | 2.9745 | 2.26E-01 | 1.141 | 0.0762 | 0.9377 | 1.3884 | 0.9827 | 1.3248 |
| CCF | | | | | | | | | | | | | |
| VSR | hCV1619596 | 2.1107 | 1.2959 | 1.032 | 1.6274 | 5.6095 | 6.05E-02 | 1.2231 | 0.0898 | 0.9706 | 1.5413 | 1.0258 | 1.4584 |
| UCSF | hCV16336 | 1.8365 | 0.7982 | 0.6189 | 1.0296 | 3.2722 | 1.95E-01 | 0.8148 | 0.1159 | 0.6045 | 1.0982 | 0.6492 | 1.0226 |
| CCF | | | | | | | | | | | | | |
| VSR | hCV16336 | 0.9528 | 0.7564 | 0.5717 | 1.0007 | 9.0123 | 1.10E-02 | 0.7053 | 0.1307 | 0.5037 | 0.9876 | 0.5459 | 0.9113 |
| UCSF | hCV1723718 | 1.8965 | 1.1481 | 0.9381 | 1.4051 | 3.9209 | 1.41E-01 | 1.1566 | 0.0739 | 0.9562 | 1.399 | 1.0007 | 1.3368 |
| CCF | | | | | | | | | | | | | |
| VSR | hCV1723718 | 1.8502 | 1.2585 | 1.0007 | 1.5826 | 4.2931 | 1.17E-01 | 1.1795 | 0.086 | 0.9452 | 1.4719 | 0.9966 | 1.396 |
| UCSF | hCV1958451 | 1.1295 | 0.835 | 0.6812 | 1.0236 | 4.2666 | 1.18E-01 | 0.8459 | 0.0818 | 0.6853 | 1.0442 | 0.7206 | 0.9929 |
| CCF | | | | | | | | | | | | | |

TABLE 19C-continued

| | | | | | | | | | | | | | |
|---|---|---|---|---|---|---|---|---|---|---|---|---|---|
| VSR | hCV1958451 | 0.948 | 0.8855 | 0.7035 | 1.1145 | 5.3527 | 6.88E-02 | 0.8225 | 0.0916 | 0.6496 | 1.0413 | 0.6873 | 0.9842 |
| UCSF | hCV2121658 | 2.3922 | 0.7548 | 0.594 | 0.959 | 5.3775 | 6.80E-02 | 0.7964 | 0.11 | 0.5999 | 1.0572 | 0.642 | 0.9879 |
| CCF | | | | | | | | | | | | | |
| VSR | hCV2121658 | 1.009 | 0.9012 | 0.6911 | 1.1752 | 5.1433 | 7.64E-02 | 0.8253 | 0.122 | 0.6028 | 1.1299 | 0.6498 | 1.0481 |
| UCSF | hCV2358247 | 2.1862 | 1.3805 | 1.0441 | 1.8253 | 5.9832 | 5.02E-02 | 1.2462 | 0.1327 | 0.8855 | 1.754 | 0.9609 | 1.6163 |
| CCF | | | | | | | | | | | | | |
| VSR | hCV2358247 | | 1.4217 | 1.0009 | 2.0194 | 3.1758 | | 1.6023 | 0.1682 | 1.0388 | 2.4713 | 1.1522 | 2.2281 |
| UCSF | hCV2390937 | 2.4919 | 0.7875 | 0.5878 | 1.0551 | | 2.04E-01 | 0.7807 | 0.14 | 0.5444 | 1.1196 | 0.5934 | 1.0272 |
| CCF | | | | | | | | | | | | | |
| VSR | hCV2390937 | 7.7934 | 0.6756 | 0.4839 | 0.9432 | 5.0842 | 7.87E-02 | 0.6946 | 0.1622 | 0.4575 | 1.0547 | 0.5055 | 0.9545 |
| UCSF | hCV2473186 | 1.7391 | 1.3253 | 1.0508 | 1.6714 | 6.4292 | 4.02E-02 | 1.1555 | 0.0691 | 0.9672 | 1.3806 | 1.0092 | 1.3231 |
| CCF | | | | | | | | | | | | | |
| VSR | hCV2473186 | 2.0894 | 1.3927 | 1.0842 | 1.789 | 8.9051 | 1.16E-02 | 1.2404 | 0.0788 | 1.0126 | 1.5194 | 1.0629 | 1.4475 |
| UCSF | hCV2596936 | 2.401 | 1.3229 | 1.0074 | 1.7373 | 4.7012 | 9.53E-02 | 1.2167 | 0.1296 | 0.8714 | 1.6988 | 0.9438 | 1.5685 |
| CCF | | | | | | | | | | | | | |
| VSR | hCV2596936 | 3.8636 | 1.5454 | 1.1505 | 2.0759 | 8.4034 | 1.50E-02 | 1.4683 | 0.1352 | 1.0364 | 2.0802 | 1.1264 | 1.914 |
| UCSF | hCV2615822 | | 1.1906 | 0.7838 | 1.8085 | | | 1.2567 | 0.2061 | 0.7391 | 2.1366 | 0.8391 | 1.882 |
| CCF | | | | | | | | | | | | | |
| VSR | hCV2615822 | 24.49 | 1.5004 | 1.0137 | 2.2209 | 3.6716 | 1.59E-01 | 1.4756 | 0.1923 | 0.8991 | 2.4217 | 1.0121 | 2.1512 |
| UCSF | hCV2983294 | 1.4958 | 0.7576 | 0.6112 | 0.9391 | 6.5483 | 3.78E-02 | 0.819 | 0.0911 | 0.6477 | 1.0355 | 0.6851 | 0.979 |
| CCF | | | | | | | | | | | | | |
| VSR | hCV2983294 | 1.2907 | 0.7823 | 0.615 | 0.9951 | 4.5596 | 1.02E-01 | 0.8136 | 0.0994 | 0.6298 | 1.0509 | 0.6696 | 0.9885 |
| UCSF | hCV2637554 | 2.1524 | 1.0848 | 0.8856 | 1.3286 | 6.3881 | 4.10E-02 | 1.1805 | 0.0745 | 0.9745 | 1.4301 | 1.0202 | 1.366 |
| CCF | | | | | | | | | | | | | |
| VSR | hCV2637554 | 2.0013 | 1.2089 | 0.96 | 1.5224 | 4.2815 | 1.18E-01 | 1.1927 | 0.0843 | 0.96 | 1.4817 | 1.0111 | 1.4068 |
| UCSF | hCV2678797 | 1.3378 | 0.8019 | 0.6554 | 0.9812 | 4.6697 | 9.68E-02 | 0.8647 | 0.0808 | 0.7022 | 1.0647 | 0.738 | 1.013 |
| CCF | | | | | | | | | | | | | |
| VSR | hCV2678797 | 0.9388 | 0.9527 | 0.759 | 1.1958 | 5.2035 | 7.41E-02 | 0.8558 | 0.0894 | 0.6798 | 1.0773 | 0.7182 | 1.0196 |
| UCSF | hCV2681276 | 1.5173 | 1.198 | 0.9771 | 1.4689 | 3.0209 | 2.21E-01 | 1.098 | 0.073 | 0.9099 | 1.325 | 0.9517 | 1.2667 |
| CCF | | | | | | | | | | | | | |
| VSR | hCV2681276 | 2.087 | 1.1799 | 0.9339 | 1.4906 | 5.8097 | 5.48E-02 | 1.2202 | 0.0813 | 0.9896 | 1.5046 | 1.0404 | 1.4311 |
| UCSF | hCV2707072 | 1.1924 | 0.8208 | 0.67 | 1.0055 | 3.7499 | 1.53E-01 | 0.8885 | 0.0742 | 0.7339 | 1.0756 | 0.7682 | 1.0276 |
| CCF | | | | | | | | | | | | | |
| VSR | hCV2707072 | 1.072 | 0.8675 | 0.6898 | 1.0909 | 3.1285 | 2.09E-01 | 0.8634 | 0.0832 | 0.6968 | 1.0698 | 0.7334 | 1.0163 |
| UCSF | hCV2473671 | 1.8204 | 1.169 | 0.9561 | 1.4294 | 3.4061 | 1.82E-01 | 1.147 | 0.0749 | 0.9457 | 1.3912 | 0.9904 | 1.3285 |
| CCF | | | | | | | | | | | | | |
| VSR | hCV2473671 | 2.4111 | 1.1634 | 0.926 | 1.4617 | 5.4661 | 6.50E-02 | 1.2203 | 0.0873 | 0.9746 | 1.5279 | 1.0284 | 1.448 |
| UCSF | hCV2494483 | 4.843 | 1.3469 | 0.9846 | 1.8425 | 3.554 | 1.69E-01 | 1.3368 | 0.1471 | 0.9151 | 1.9528 | 1.0019 | 1.7837 |
| CCF | | | | | | | | | | | | | |
| VSR | hCV2494483 | 33.922 | 1.4595 | 1.0039 | 2.122 | 4.3507 | 1.14E-01 | 1.4827 | 0.1819 | 0.928 | 2.3692 | 1.038 | 2.118 |
| UCSF | hCV2504565 | 1.4792 | 0.7652 | 0.6244 | 0.9376 | 7.0162 | 3.00E-02 | 0.8774 | 0.0798 | 0.7144 | 1.0776 | 0.7504 | 1.0256 |
| CCF | | | | | | | | | | | | | |
| VSR | hCV2504565 | 0.6227 | 0.9523 | 0.7558 | 1.2 | 14.186 | 8.31E-04 | 0.7854 | 0.0962 | 0.6131 | 1.0062 | 0.6505 | 0.9483 |
| UCSF | hCV2511436 | 0.6798 | 0.9205 | 0.7397 | 1.1455 | 10.955 | 4.18E-03 | 0.808 | 0.0983 | 0.6273 | 1.0408 | 0.6664 | 0.9797 |
| CCF | | | | | | | | | | | | | |
| VSR | hCV2511436 | 1.3267 | 0.8181 | 0.6402 | 1.0455 | 3.3771 | 1.85E-01 | 0.824 | 0.1046 | 0.6294 | 1.0787 | 0.6713 | 1.0114 |
| UCSF | hCV2769503 | 1.8479 | 1.2811 | 1.0429 | 1.5738 | 6.9114 | 3.16E-02 | 1.1938 | 0.0718 | 0.9922 | 1.4364 | 1.0371 | 1.3743 |
| CCF | | | | | | | | | | | | | |
| VSR | hCV2769503 | 2.1723 | 1.4676 | 1.1624 | 1.853 | 11.864 | 2.65E-03 | 1.2971 | 0.0832 | 1.0469 | 1.607 | 1.1019 | 1.5268 |
| UCSF | hCV27892569 | 2.0397 | 1.135 | 0.9281 | 1.3881 | 2.8209 | 2.44E-01 | 1.1428 | 0.0801 | 0.9298 | 1.4046 | 0.9768 | 1.337 |
| CCF | | | | | | | | | | | | | |

TABLE 19C-continued

| | | | | | | | | | | | |
|---|---|---|---|---|---|---|---|---|---|---|---|
| VSR | hCV27892569 | 1.5785 | 1.277 | 1.0116 | 1.612 | 4.3397 | 1.14E-01 | 1.1328 | 0.0923 | 0.8931 | 1.4367 | 0.9453 | 1.3574 |
| UCSF | hCV28036404 | 0.9867 | 1.0241 | 0.8322 | 1.2603 | 4.7358 | 9.37E-02 | 0.9087 | 0.0873 | 0.7256 | 1.138 | 0.7657 | 1.0784 |
| CCF | | | | | | | | | | | | | |
| VSR | hCV28036404 | 1.3363 | 0.7634 | 0.6022 | 0.9676 | 5.7808 | 5.56E-02 | 0.7897 | 0.102 | 0.6072 | 1.0269 | 0.6466 | 0.9644 |
| UCSF | hCV2851380 | 1.1071 | 0.8341 | 0.6447 | 1.0792 | 5.5293 | 6.30E-02 | 0.776 | 0.1194 | 0.5705 | 1.0555 | 0.614 | 0.9807 |
| CCF | | | | | | | | | | | | | |
| VSR | hCV2851380 | 1.7468 | 0.7736 | 0.5881 | 1.0174 | 3.8106 | 1.49E-01 | 0.7859 | 0.1241 | 0.5709 | 1.0819 | 0.6163 | 1.0023 |
| UCSF | hCV29401764 | 1.3214 | 0.7552 | 0.6161 | 0.9257 | 7.6343 | 2.20E-02 | 0.8911 | 0.0746 | 0.7354 | 1.0798 | 0.7699 | 1.0313 |
| CCF | | | | | | | | | | | | | |
| VSR | hCV29401764 | 1.0456 | 0.7503 | 0.5955 | 0.9452 | 6.9627 | 3.08E-02 | 0.8152 | 0.0835 | 0.6574 | 1.0109 | 0.6921 | 0.9603 |
| UCSF | | | | | | | | | | | | | |
| CCF | hCV29537898 | 5.1638 | 1.1836 | 0.9169 | 1.528 | 4.7982 | 9.08E-02 | 1.2655 | 0.1154 | 0.94 | 1.7036 | 1.0093 | 1.5867 |
| VSR | hCV29537898 | 66.901 | 1.23 | 0.9105 | 1.6616 | 6.3117 | 4.26E-02 | 1.3202 | 0.1425 | 0.9147 | 1.9055 | 0.9986 | 1.7455 |
| UCSF | hCV29539757 | 1.1886 | 0.7331 | 0.5986 | 0.8979 | 9.1106 | 1.05E-02 | 0.835 | 0.0766 | 0.6854 | 1.0172 | 0.7185 | 0.9703 |
| CCF | | | | | | | | | | | | | |
| VSR | hCV29539757 | 0.9579 | 0.772 | 0.6145 | 0.97 | 7.5953 | 2.24E-02 | 0.7947 | 0.0847 | 0.639 | 0.9884 | 0.6732 | 0.9381 |
| UCSF | hCV302629 | 2.4155 | 1.0205 | 0.8322 | 1.2514 | 10.938 | 4.22E-03 | 1.203 | 0.075 | 0.9915 | 1.4595 | 1.0384 | 1.3936 |
| CCF | | | | | | | | | | | | | |
| VSR | hCV302629 | 2.2169 | 0.951 | 0.7559 | 1.1966 | 4.5406 | 1.03E-01 | 1.1006 | 0.0868 | 0.8801 | 1.3764 | 0.9284 | 1.3047 |
| UCSF | hCV30308202 | 0.9273 | 0.9368 | 0.7625 | 1.151 | 5.6664 | 5.88E-02 | 0.8535 | 0.0865 | 0.683 | 1.0666 | 0.7204 | 1.0113 |
| CCF | | | | | | | | | | | | | |
| VSR | hCV30308202 | 1.3882 | 0.7642 | 0.6007 | 0.9721 | 4.9764 | 8.31E-02 | 0.8199 | 0.0988 | 0.6356 | 1.0575 | 0.6755 | 0.9951 |
| UCSF | hCV3054550 | 2.7861 | 1.1966 | 0.9619 | 1.4885 | 4.0552 | 1.32E-01 | 1.2126 | 0.0944 | 0.9507 | 1.5465 | 1.0076 | 1.4592 |
| CCF | | | | | | | | | | | | | |
| VSR | hCV3054550 | 1.9825 | 1.2611 | 0.9878 | 1.6101 | 3.4557 | 1.78E-01 | 1.1702 | 0.1058 | 0.8911 | 1.5368 | 0.9511 | 1.4399 |
| UCSF | hCV3082219 | 2.4615 | 1.2484 | 0.9921 | 1.5709 | 3.4741 | 1.76E-01 | 1.1914 | 0.1045 | 0.9102 | 1.5593 | 0.9707 | 1.4621 |
| CCF | | | | | | | | | | | | | |
| VSR | hCV3082219 | 4.2435 | 1.3479 | 1.0403 | 1.7465 | 6.3282 | 4.23E-02 | 1.3418 | 0.1161 | 0.995 | 1.8094 | 1.0688 | 1.6846 |
| UCSF | hCV31137507 | 1.798 | 1.1779 | 0.9633 | 1.4403 | 3.228 | 1.99E-01 | 1.1451 | 0.0768 | 0.9396 | 1.3957 | 0.9851 | 1.3312 |
| CCF | | | | | | | | | | | | | |
| VSR | hCV31137507 | 2.0436 | 1.1512 | 0.9168 | 1.4454 | 2.724 | 2.56E-01 | 1.1555 | 0.0873 | 0.9227 | 1.447 | 0.9737 | 1.3713 |
| UCSF | hCV31227848 | 9.4209 | 1.6482 | 1.1797 | 2.3027 | 7.5344 | 2.31E-02 | 1.5772 | 0.1633 | 1.0357 | 2.4017 | 1.1453 | 2.172 |
| CCF | | | | | | | | | | | | | |
| VSR | hCV31227848 | 25.061 | 1.7955 | 1.2252 | 2.6312 | 8.0196 | 1.81E-02 | 1.7397 | 0.1873 | 1.0738 | 2.8185 | 1.2051 | 2.5114 |
| UCSF | hCV31573621 | 1.0772 | 0.8585 | 0.7027 | 1.0489 | 3.9481 | 1.39E-01 | 0.8583 | 0.0781 | 0.7019 | 1.0494 | 0.7365 | 1.0001 |
| CCF | | | | | | | | | | | | | |
| VSR | hCV31573621 | 0.9627 | 0.9547 | 0.7597 | 1.1997 | 4.7176 | 9.45E-02 | 0.862 | 0.0889 | 0.6855 | 1.0839 | 0.7241 | 1.0261 |
| UCSF | hCV31705214 | 2.436 | 1.0888 | 0.8875 | 1.3357 | 5.6238 | 6.01E-02 | 1.1819 | 0.0808 | 0.9598 | 1.4553 | 1.0087 | 1.3847 |
| CCF | | | | | | | | | | | | | |
| VSR | hCV31705214 | 2.1071 | 1.36 | 1.0787 | 1.7147 | 7.0676 | 2.92E-02 | 1.2564 | 0.0936 | 0.9873 | 1.5989 | 1.0459 | 1.5094 |
| UCSF | hCV32160712 | 2.3242 | 1.2959 | 1.0527 | 1.5953 | 6.2375 | 4.42E-02 | 1.2364 | 0.0889 | 0.9833 | 1.5546 | 1.0387 | 1.4718 |
| CCF | | | | | | | | | | | | | |
| VSR | hCV32160712 | 3.5585 | 1.141 | 0.8916 | 1.4602 | 4.0086 | 1.35E-01 | 1.2139 | 0.1059 | 0.924 | 1.5948 | 0.9863 | 1.4941 |
| UCSF | hCV435733 | 1.7695 | 1.2548 | 1.0241 | 1.5376 | 5.6002 | 6.08E-02 | 1.1784 | 0.0736 | 0.9748 | 1.4245 | 1.02 | 1.3613 |
| CCF | | | | | | | | | | | | | |
| VSR | hCV435733 | 1.347 | 1.4275 | 1.1357 | 1.7943 | 11.119 | 3.85E-03 | 1.1155 | 0.0849 | 0.8964 | 1.388 | 0.9445 | 1.3173 |
| UCSF | hCV454333 | 1.086 | 0.9136 | 0.7266 | 1.1488 | 4.1171 | 1.28E-01 | 0.8504 | 0.1038 | 0.6509 | 1.1111 | 0.6938 | 1.0423 |
| CCF | | | | | | | | | | | | | |
| VSR | hCV454333 | 0.921 | 0.7886 | 0.5993 | 1.0378 | 7.7331 | 2.09E-02 | 0.7244 | 0.1244 | 0.5257 | 0.9981 | 0.5676 | 0.9245 |
| UCSF | hCV540056 | 43.792 | 0.6359 | 0.4223 | 0.9575 | 4.7627 | 9.24E-02 | 0.6783 | 0.2003 | 0.4049 | 1.1362 | 0.4581 | 1.0044 |
| CCF | | | | | | | | | | | | | |

TABLE 19C-continued

| | | | | | | | | | | | | |
|---|---|---|---|---|---|---|---|---|---|---|---|---|
| VSR | hCV540056 | | 0.5818 | 0.3639 | 0.9302 | | 0.5919 | 0.2359 | 0.3224 | 1.0869 | 0.3728 | 0.9399 |
| UCSF | hCV7917138 | 2.1676 | 1.2793 | 1.0412 | 1.5718 | 6.4455 | 1.2368 | 0.0842 | 0.9956 | 1.5364 | 1.0486 | 1.4587 |
| CCF | | | | | | | | | | | | |
| VSR | hCV7917138 | 3.2454 | 1.0272 | 0.8116 | 1.3 | 4.742 | 1.1509 | 0.0975 | 0.8953 | 1.4796 | 0.9507 | 1.3933 |
| UCSF | hCV8147903 | 1.0914 | 0.8028 | 0.6521 | 0.9885 | 6.0203 | 0.8113 | 0.0854 | 0.6512 | 1.0109 | 0.6863 | 0.9591 |
| CCF | | | | | | 9.34E-02 | | | | | | |
| VSR | hCV8147903 | 1.1213 | 0.886 | 0.7007 | 1.1204 | 3.0613 | 0.85 | 0.0968 | 0.6625 | 1.0905 | 0.7032 | 1.0275 |
| UCSF | hCV8754449 | 1.425 | 0.8091 | 0.6607 | 0.9907 | 4.2677 | 0.8909 | 0.0798 | 0.7253 | 1.0943 | 0.7618 | 1.0418 |
| CCF | | | | | | 2.16E-01 | | | | | | |
| | | | | | | 1.18E-01 | | | | | | |
| VSR | hCV8754449 | 0.6495 | 0.9676 | 0.7676 | 1.2199 | 13.591 | 0.7922 | 0.0955 | 0.6195 | 1.013 | 0.6571 | 0.9552 |
| UCSF | hCV8820007 | 1.0857 | 1.0262 | 0.8379 | 1.2569 | 2.9617 | 0.9289 | 0.0813 | 0.7535 | 1.1452 | 0.7922 | 1.0893 |
| CCF | | | | | | 1.12E-03 | | | | | | |
| | | | | | | 2.27E-01 | | | | | | |
| VSR | hCV8820007 | 0.9033 | 0.8364 | 0.662 | 1.0567 | 7.1036 | 0.7818 | 0.0931 | 0.6152 | 0.9937 | 0.6515 | 0.9383 |
| UCSF | hCV8942032 | 2.4618 | 1.2231 | 0.9811 | 1.5249 | 3.5479 | 1.1992 | 0.0965 | 0.9353 | 1.5375 | 0.9925 | 1.4488 |
| CCF | | | | | | 2.87E-02 | | | | | | |
| | | | | | | 1.70E-01 | | | | | | |
| VSR | hCV8942032 | 2.7931 | 1.2768 | 0.9839 | 1.6567 | 3.9974 | 1.26 | 0.1132 | 0.9414 | 1.6865 | 1.0093 | 1.5729 |
| | | | | | | 1.36E-01 | | | | | | |

TABLE 20

| hCV # | rs # | Gene | OUTCOME | ADJUST | MODE | GENO-TYPE |
|---|---|---|---|---|---|---|
| hCV1958451 | rs2985822 | MIER1 | EO_STK | AGE MALE DIAB HTN | GEN | GT |
| hCV1958451 | rs2985822 | MIER1 | EO_STK | AGE MALE DIAB HTN | DOM | GT or GG |
| hCV1958451 | rs2985822 | MIER1 | EO_STK |  | GEN | GT |
| hCV1958451 | rs2985822 | MIER1 | EO_STK | AGE MALE DIAB HTN | GEN | GG |
| hCV1958451 | rs2985822 | MIER1 | LACUNAR_STK |  | GEN | GT |
| hCV27494483 | rs3748743 | SLC22A15 | CE_STK |  | GEN | TC |
| hCV27494483 | rs3748743 | SLC22A15 | CE_STK |  | DOM | TC or TT |
| hCV27494483 | rs3748743 | SLC22A15 | CE_STK |  | ADD | T |
| hCV27494483 | rs3748743 | SLC22A15 | ISCHEMIC_STK |  | DOM | TC or TT |
| hCV27494483 | rs3748743 | SLC22A15 | ISCHEMIC_STK |  | ADD | T |
| hCV27494483 | rs3748743 | SLC22A15 | ISCHEMIC_STK |  | GEN | TC |
| hCV27504565 | rs3219489 | MUTYH | ATHERO_STK | AGE MALE DIAB HTN | GEN | CG |
| hCV27504565 | rs3219489 | MUTYH | ATHERO_STK | AGE MALE DIAB HTN | DOM | CG or CC |
| hCV27504565 | rs3219489 | MUTYH | ATHERO_STK | AGE MALE DIAB HTN | GEN | CC |
| hCV27504565 | rs3219489 | MUTYH | ATHERO_STK |  | GEN | CG |
| hCV27504565 | rs3219489 | MUTYH | ATHERO_STK |  | DOM | CG or CC |
| hCV27504565 | rs3219489 | MUTYH | ATHERO_STK |  | GEN | CC |
| hCV27504565 | rs3219489 | MUTYH | ISCHEMIC_STK |  | GEN | CG |
| hCV27504565 | rs3219489 | MUTYH | NOHD_STK |  | GEN | CG |
| hCV27504565 | rs3219489 | MUTYH | NOHD_STK | AGE MALE DIAB HTN | GEN | CG |
| hCV27504565 | rs3219489 | MUTYH | NONCE_STK | AGE MALE DIAB HTN | GEN | CG |
| hCV27504565 | rs3219489 | MUTYH | NONCE_STK |  | GEN | CG |
| hCV27504565 | rs3219489 | MUTYH | RECURRENT_STK | AGE MALE DIAB HTN | GEN | CG |
| hCV27504565 | rs3219489 | MUTYH | RECURRENT_STK | AGE MALE DIAB HTN | DOM | CG or CC |
| hCV8754449 | rs781226 | TESK2 | ATHERO_STK | AGE MALE DIAB HTN | GEN | CT |
| hCV8754449 | rs781226 | TESK2 | ATHERO_STK | AGE MALE DIAB HTN | DOM | CT or CC |
| hCV8754449 | rs781226 | TESK2 | ATHERO_STK |  | GEN | CT |
| hCV8754449 | rs781226 | TESK2 | ATHERO_STK |  | DOM | CT or CC |
| hCV8754449 | rs781226 | TESK2 | ATHERO_STK |  | GEN | CC |
| hCV8754449 | rs781226 | TESK2 | ATHERO_STK | AGE MALE DIAB HTN | GEN | CC |
| hCV8754449 | rs781226 | TESK2 | RECURRENT_STK | AGE MALE DIAB HTN | GEN | CT |
| hCV8754449 | rs781226 | TESK2 | RECURRENT_STK | AGE MALE DIAB HTN | DOM | CT or CC |
| hCV2091644 | rs1010 | VAMP8 | CE_STK |  | REC | CC |
| hCV8820007 | rs938390 |  | ATHERO_STK |  | GEN | TA |
| hCV8820007 | rs938390 |  | ISCHEMIC_STK |  | GEN | TA |
| hCV8820007 | rs938390 |  | ISCHEMIC_STK | AGE MALE DIAB HTN | GEN | TA |
| hCV8820007 | rs938390 |  | NOHD_STK |  | GEN | TA |
| hCV8820007 | rs938390 |  | NOHD_STK | AGE MALE DIAB HTN | GEN | TA |
| hCV8820007 | rs938390 |  | NOHD_STK | AGE MALE DIAB HTN | DOM | TA or TT |
| hCV8820007 | rs938390 |  | NOHD_STK |  | DOM | TA or TT |
| hCV11354788 | rs12644625 | LOC729065 | ATHERO_STK | AGE MALE DIAB HTN | ADD | T |

TABLE 20-continued

| | | | | | | |
|---|---|---|---|---|---|---|
| hCV11354788 | rs12644625 | LOC729065 | ATHERO_STK | AGE MALE DIAB HTN | DOM | TC or TT |
| hCV11354788 | rs12644625 | LOC729065 | ATHERO_STK | AGE MALE DIAB HTN | GEN | TC |
| hCV11354788 | rs12644625 | LOC729065 | ATHERO_STK | | DOM | TC or TT |
| hCV11354788 | rs12644625 | LOC729065 | ATHERO_STK | | GEN | TC |
| hCV11354788 | rs12644625 | LOC729065 | ATHERO_STK | | ADD | T |
| hCV11354788 | rs12644625 | LOC729065 | CE_STK | | ADD | T |
| hCV11354788 | rs12644625 | LOC729065 | CE_STK | | DOM | TC or TT |
| hCV11354788 | rs12644625 | LOC729065 | CE_STK | AGE MALE DIAB HTN | ADD | T |
| hCV11354788 | rs12644625 | LOC729065 | CE_STK | AGE MALE DIAB HTN | DOM | TC or TT |
| hCV11354788 | rs12644625 | LOC729065 | CE_STK | | GEN | TC |
| hCV11354788 | rs12644625 | LOC729065 | CE_STK | AGE MALE DIAB HTN | GEN | TC |
| hCV11354788 | rs12644625 | LOC729065 | CE_STK | | GEN | TT |
| hCV11354788 | rs12644625 | LOC729065 | CE_STK | | REC | TT |
| hCV11354788 | rs12644625 | LOC729065 | CE_STK | AGE MALE DIAB HTN | GEN | TT |
| hCV11354788 | rs12644625 | LOC729065 | EO_STK | AGE MALE DIAB HTN | ADD | T |
| hCV11354788 | rs12644625 | LOC729065 | EO_STK | | DOM | TC or TT |
| hCV11354788 | rs12644625 | LOC729065 | EO_STK | | ADD | T |
| hCV11354788 | rs12644625 | LOC729065 | EO_STK | AGE MALE DIAB HTN | DOM | TC or TT |
| hCV11354788 | rs12644625 | LOC729065 | EO_STK | | GEN | TC |
| hCV11354788 | rs12644625 | LOC729065 | EO_STK | AGE MALE DIAB HTN | GEN | TC |
| hCV11354788 | rs12644625 | LOC729065 | ISCHEMIC_STK | | DOM | TC or TT |
| hCV11354788 | rs12644625 | LOC729065 | ISCHEMIC_STK | | ADD | T |
| hCV11354788 | rs12644625 | LOC729065 | ISCHEMIC_STK | | GEN | TC |
| hCV11354788 | rs12644625 | LOC729065 | ISCHEMIC_STK | AGE MALE DIAB HTN | ADD | T |
| hCV11354788 | rs12644625 | LOC729065 | ISCHEMIC_STK | AGE MALE DIAB HTN | DOM | TC or TT |
| hCV11354788 | rs12644625 | LOC729065 | ISCHEMIC_STK | AGE MALE DIAB HTN | GEN | TC |
| hCV11354788 | rs12644625 | LOC729065 | NOHD_STK | | ADD | T |
| hCV11354788 | rs12644625 | LOC729065 | NOHD_STK | | DOM | TC or TT |
| hCV11354788 | rs12644625 | LOC729065 | NOHD_STK | | GEN | TC |
| hCV11354788 | rs12644625 | LOC729065 | NOHD_STK | AGE MALE DIAB HTN | ADD | T |
| hCV11354788 | rs12644625 | LOC729065 | NOHD_STK | AGE MALE DIAB HTN | DOM | TC or TT |
| hCV11354788 | rs12644625 | LOC729065 | NOHD_STK | AGE MALE DIAB HTN | GEN | TC |
| hCV11354788 | rs12644625 | LOC729065 | NONCE_STK | | GEN | TC |
| hCV11354788 | rs12644625 | LOC729065 | NONCE_STK | | DOM | TC or TT |
| hCV11354788 | rs12644625 | LOC729065 | NONCE_STK | AGE MALE DIAB HTN | DOM | TC or TT |
| hCV11354788 | rs12644625 | LOC729065 | RECURRENT_STK | AGE MALE DIAB HTN | GEN | TC |
| hCV11354788 | rs12644625 | LOC729065 | RECURRENT_STK | AGE MALE DIAB HTN | DOM | TC or TT |
| hCV11354788 | rs12644625 | LOC729065 | RECURRENT_STK | AGE MALE DIAB HTN | ADD | T |
| hCV11354788 | rs12644625 | LOC729065 | RECURRENT_STK | | DOM | TC or TT |
| hCV11354788 | rs12644625 | LOC729065 | RECURRENT_STK | | GEN | TC |
| hCV11354788 | rs12644625 | LOC729065 | RECURRENT_STK | | ADD | T |
| hCV16158671 | rs2200733 | | ATHERO_STK | AGE MALE DIAB HTN | ADD | T |
| hCV16158671 | rs2200733 | | ATHERO_STK | AGE MALE DIAB HTN | DOM | TC or TT |
| hCV16158671 | rs2200733 | | ATHERO_STK | | DOM | TC or TT |
| hCV16158671 | rs2200733 | | ATHERO_STK | | ADD | T |

TABLE 20-continued

| | | | | | | |
|---|---|---|---|---|---|---|
| hCV16158671 | rs2200733 | | ATHERO_STK | | GEN | TC |
| hCV16158671 | rs2200733 | | ATHERO_STK | AGE MALE DIAB HTN | GEN | TC |
| hCV16158671 | rs2200733 | | CE_STK | | ADD | T |
| hCV16158671 | rs2200733 | | CE_STK | | DOM | TC or TT |
| hCV16158671 | rs2200733 | | CE_STK | | GEN | TC |
| hCV16158671 | rs2200733 | | CE_STK | AGE MALE DIAB HTN | ADD | T |
| hCV16158671 | rs2200733 | | CE_STK | AGE MALE DIAB HTN | DOM | TC or TT |
| hCV16158671 | rs2200733 | | CE_STK | AGE MALE DIAB HTN | GEN | TC |
| hCV16158671 | rs2200733 | | CE_STK | | GEN | TT |
| hCV16158671 | rs2200733 | | CE_STK | | REC | TT |
| hCV16158671 | rs2200733 | | CE_STK | AGE MALE DIAB HTN | GEN | TT |
| hCV16158671 | rs2200733 | | EO_STK | | DOM | TC or TT |
| hCV16158671 | rs2200733 | | EO_STK | | ADD | T |
| hCV16158671 | rs2200733 | | EO_STK | AGE MALE DIAB HTN | ADD | T |
| hCV16158671 | rs2200733 | | EO_STK | | GEN | TC |
| hCV16158671 | rs2200733 | | EO_STK | AGE MALE DIAB HTN | DOM | TC or TT |
| hCV16158671 | rs2200733 | | EO_STK | AGE MALE DIAB HTN | GEN | TC |
| hCV16158671 | rs2200733 | | ISCHEMIC_STK | | DOM | TC or TT |
| hCV16158671 | rs2200733 | | ISCHEMIC_STK | | ADD | T |
| hCV16158671 | rs2200733 | | ISCHEMIC_STK | | GEN | TC |
| hCV16158671 | rs2200733 | | ISCHEMIC_STK | AGE MALE DIAB HTN | ADD | T |
| hCV16158671 | rs2200733 | | ISCHEMIC_STK | AGE MALE DIAB HTN | DOM | TC or TT |
| hCV16158671 | rs2200733 | | ISCHEMIC_STK | AGE MALE DIAB HTN | GEN | TC |
| hCV16158671 | rs2200733 | | NOHD_STK | | ADD | T |
| hCV16158671 | rs2200733 | | NOHD_STK | | DOM | TC or TT |
| hCV16158671 | rs2200733 | | NOHD_STK | | GEN | TC |
| hCV16158671 | rs2200733 | | NOHD_STK | AGE MALE DIAB HTN | ADD | T |
| hCV16158671 | rs2200733 | | NOHD_STK | AGE MALE DIAB HTN | DOM | TC or TT |
| hCV16158671 | rs2200733 | | NOHD_STK | AGE MALE DIAB HTN | GEN | TC |
| hCV16158671 | rs2200733 | | NOHD_STK | AGE MALE DIAB HTN | GEN | TT |
| hCV16158671 | rs2200733 | | NONCE_STK | | DOM | TC or TT |
| hCV16158671 | rs2200733 | | NONCE_STK | | GEN | TC |
| hCV16158671 | rs2200733 | | NONCE_STK | | ADD | T |
| hCV16158671 | rs2200733 | | NONCE_STK | AGE MALE DIAB HTN | ADD | T |
| hCV16158671 | rs2200733 | | NONCE_STK | AGE MALE DIAB HTN | DOM | TC or TT |
| hCV16158671 | rs2200733 | | RECURRENT_STK | AGE MALE DIAB HTN | GEN | TC |
| hCV16158671 | rs2200733 | | RECURRENT_STK | AGE MALE DIAB HTN | DOM | TC or TT |
| hCV16158671 | rs2200733 | | RECURRENT_STK | AGE MALE DIAB HTN | ADD | T |
| hCV16158671 | rs2200733 | | RECURRENT_STK | | DOM | TC or TT |
| hCV16158671 | rs2200733 | | RECURRENT_STK | | GEN | TC |
| hCV16158671 | rs2200733 | | RECURRENT_STK | | ADD | T |
| hCV16336 | rs362277 | HD | ATHERO_STK | | REC | CC |
| hCV16336 | rs362277 | HD | ATHERO_STK | | ADD | C |
| hCV16336 | rs362277 | HD | ATHERO_STK | AGE MALE DIAB HTN | REC | CC |
| hCV16336 | rs362277 | HD | CE_STK | | ADD | C |
| hCV16336 | rs362277 | HD | CE_STK | | REC | CC |

TABLE 20-continued

| | | | | | | |
|---|---|---|---|---|---|---|
| hCV16336 | rs362277 | HD | CE_STK | AGE MALE DIAB HTN | ADD | C |
| hCV16336 | rs362277 | HD | CE_STK | AGE MALE DIAB HTN | REC | CC |
| hCV16336 | rs362277 | HD | CE_STK | | GEN | CC |
| hCV16336 | rs362277 | HD | EO_STK | AGE MALE DIAB HTN | REC | CC |
| hCV16336 | rs362277 | HD | EO_STK | AGE MALE DIAB HTN | ADD | C |
| hCV16336 | rs362277 | HD | EO_STK | | REC | CC |
| hCV16336 | rs362277 | HD | EO_STK | | ADD | C |
| hCV16336 | rs362277 | HD | ISCHEMIC_STK | | ADD | C |
| hCV16336 | rs362277 | HD | ISCHEMIC_STK | | REC | CC |
| hCV16336 | rs362277 | HD | ISCHEMIC_STK | AGE MALE DIAB HTN | ADD | C |
| hCV16336 | rs362277 | HD | ISCHEMIC_STK | AGE MALE DIAB HTN | REC | CC |
| hCV16336 | rs362277 | HD | NOHD_STK | | ADD | C |
| hCV16336 | rs362277 | HD | NOHD_STK | | REC | CC |
| hCV16336 | rs362277 | HD | NONCE_STK | | REC | CC |
| hCV16336 | rs362277 | HD | NONCE_STK | | ADD | C |
| hCV16336 | rs362277 | HD | NONCE_STK | AGE MALE DIAB HTN | REC | CC |
| hCV16336 | rs362277 | HD | NONCE_STK | AGE MALE DIAB HTN | ADD | C |
| hCV26478797 | rs2015018 | CHSY-2 | CE_STK | | REC | GG |
| hCV11425801 | rs3805953 | PEX6 | ATHERO_STK | AGE MALE DIAB HTN | GEN | CT |
| hCV11425801 | rs3805953 | PEX6 | ATHERO_STK | AGE MALE DIAB HTN | DOM | CT or CC |
| hCV11425801 | rs3805953 | PEX6 | ATHERO_STK | | GEN | CT |
| hCV11425801 | rs3805953 | PEX6 | ATHERO_STK | | DOM | CT or CC |
| hCV11425801 | rs3805953 | PEX6 | ATHERO_STK | | ADD | C |
| hCV11425801 | rs3805953 | PEX6 | ATHERO_STK | | GEN | CC |
| hCV11425801 | rs3805953 | PEX6 | ATHERO_STK | AGE MALE DIAB HTN | ADD | C |
| hCV11425801 | rs3805953 | PEX6 | EO_STK | | GEN | CT |
| hCV11425801 | rs3805953 | PEX6 | EO_STK | AGE MALE DIAB HTN | GEN | CT |
| hCV11425801 | rs3805953 | PEX6 | EO_STK | | DOM | CT or CC |
| hCV11425801 | rs3805953 | PEX6 | EO_STK | AGE MALE DIAB HTN | DOM | CT or CC |
| hCV11425801 | rs3805953 | PEX6 | ISCHEMIC_STK | AGE MALE DIAB HTN | GEN | CT |
| hCV11425801 | rs3805953 | PEX6 | ISCHEMIC_STK | AGE MALE DIAB HTN | DOM | CT or CC |
| hCV11425801 | rs3805953 | PEX6 | ISCHEMIC_STK | | GEN | CT |
| hCV11425801 | rs3805953 | PEX6 | ISCHEMIC_STK | | DOM | CT or CC |
| hCV11425801 | rs3805953 | PEX6 | ISCHEMIC_STK | | ADD | C |
| hCV11425801 | rs3805953 | PEX6 | LACUNAR_STK | AGE MALE DIAB HTN | GEN | CT |
| hCV11425801 | rs3805953 | PEX6 | LACUNAR_STK | AGE MALE DIAB HTN | DOM | CT or CC |
| hCV11425801 | rs3805953 | PEX6 | LACUNAR_STK | | GEN | CT |
| hCV11425801 | rs3805953 | PEX6 | NOHD_STK | AGE MALE DIAB HTN | GEN | CT |
| hCV11425801 | rs3805953 | PEX6 | NOHD_STK | AGE MALE DIAB HTN | DOM | CT or CC |
| hCV11425801 | rs3805953 | PEX6 | NOHD_STK | | DOM | CT or CC |
| hCV11425801 | rs3805953 | PEX6 | NOHD_STK | | GEN | CT |
| hCV11425801 | rs3805953 | PEX6 | NOHD_STK | | ADD | C |
| hCV11425801 | rs3805953 | PEX6 | NOHD_STK | | GEN | CC |
| hCV11425801 | rs3805953 | PEX6 | NONCE_STK | AGE MALE DIAB HTN | DOM | CT or CC |
| hCV11425801 | rs3805953 | PEX6 | NONCE_STK | | GEN | CT |
| hCV11425801 | rs3805953 | PEX6 | NONCE_STK | | DOM | CT or CC |

TABLE 20-continued

| | | | | | | |
|---|---|---|---|---|---|---|
| hCV11425801 | rs3805953 | PEX6 | NONCE_STK | | ADD | C |
| hCV11425801 | rs3805953 | PEX6 | NONCE_STK | | GEN | CC |
| hCV11425801 | rs3805953 | PEX6 | RECURRENT_STK | AGE MALE DIAB HTN | GEN | CT |
| hCV11425801 | rs3805953 | PEX6 | RECURRENT_STK | | GEN | CT |
| hCV11425842 | rs10948059 | GNMT | ATHERO_STK | AGE MALE DIAB HTN | DOM | CT or CC |
| hCV11425842 | rs10948059 | GNMT | ATHERO_STK | AGE MALE DIAB HTN | GEN | CT |
| hCV11425842 | rs10948059 | GNMT | ATHERO_STK | | DOM | CT or CC |
| hCV11425842 | rs10948059 | GNMT | ATHERO_STK | AGE MALE DIAB HTN | GEN | CC |
| hCV11425842 | rs10948059 | GNMT | ATHERO_STK | | GEN | CT |
| hCV11425842 | rs10948059 | GNMT | EO_STK | | GEN | CT |
| hCV11425842 | rs10948059 | GNMT | EO_STK | | DOM | CT or CC |
| hCV11425842 | rs10948059 | GNMT | EO_STK | AGE MALE DIAB HTN | GEN | CT |
| hCV11425842 | rs10948059 | GNMT | EO_STK | AGE MALE DIAB HTN | DOM | CT or CC |
| hCV11425842 | rs10948059 | GNMT | EO_STK | | GEN | CC |
| hCV11425842 | rs10948059 | GNMT | ISCHEMIC_STK | AGE MALE DIAB HTN | GEN | CT |
| hCV11425842 | rs10948059 | GNMT | ISCHEMIC_STK | AGE MALE DIAB HTN | DOM | CT or CC |
| hCV11425842 | rs10948059 | GNMT | NONCE_STK | AGE MALE DIAB HTN | GEN | CT |
| hCV11425842 | rs10948059 | GNMT | NONCE_STK | AGE MALE DIAB HTN | DOM | CT or CC |
| hCV1209800 | rs35067690 | CLIC5 | CE_STK | | REC | GG |
| hCV1209800 | rs35067690 | CLIC5 | CE_STK | | ADD | G |
| hCV16134786 | rs2857595 | | EO_STK | | ADD | A |
| hCV16134786 | rs2857595 | | EO_STK | | GEN | AA |
| hCV16134786 | rs2857595 | | EO_STK | | REC | AA |
| hCV16134786 | rs2857595 | | EO_STK | | DOM | AG or AA |
| hCV16134786 | rs2857595 | | LACUNAR_STK | | GEN | AA |
| hCV16134786 | rs2857595 | | LACUNAR_STK | | REC | AA |
| hCV16134786 | rs2857595 | | LACUNAR_STK | | ADD | A |
| hCV16134786 | rs2857595 | | NONCE_STK | | ADD | A |
| hCV16134786 | rs2857595 | | NONCE_STK | | GEN | AA |
| hCV25651109 | rs35690712 | SLC39A7 | ISCHEMIC_STK | | GEN | GG |
| hCV25651109 | rs35690712 | SLC39A7 | ISCHEMIC_STK | | DOM | GC or GG |
| hCV25651109 | rs35690712 | SLC39A7 | ISCHEMIC_STK | | GEN | GC |
| hCV25651109 | rs35690712 | SLC39A7 | NOHD_STK | | GEN | GC |
| hCV25651109 | rs35690712 | SLC39A7 | NOHD_STK | | DOM | GC or GG |
| hCV25651109 | rs35690712 | SLC39A7 | NOHD_STK | | GEN | GG |
| hCV30308202 | rs9482985 | LAMA2 | RECURRENT_STK | | ADD | G |
| hCV30308202 | rs9482985 | LAMA2 | RECURRENT_STK | AGE MALE DIAB HTN | GEN | GG |
| hCV30308202 | rs9482985 | LAMA2 | RECURRENT_STK | AGE MALE DIAB HTN | DOM | GC or GG |
| hCV30308202 | rs9482985 | LAMA2 | RECURRENT_STK | | REC | GG |
| hCV30308202 | rs9482985 | LAMA2 | RECURRENT_STK | AGE MALE DIAB HTN | GEN | GC |
| hCV30308202 | rs9482985 | LAMA2 | RECURRENT_STK | | GEN | GG |
| hCV3082219 | rs1884833 | RFXDC1 | EO_STK | | ADD | A |
| hCV3082219 | rs1884833 | RFXDC1 | LACUNAR_STK | | ADD | A |
| hCV3082219 | rs1884833 | RFXDC1 | LACUNAR_STK | | DOM | AG or AA |
| hCV3082219 | rs1884833 | RFXDC1 | LACUNAR_STK | | GEN | AG |
| hCV3082219 | rs1884833 | RFXDC1 | NONCE_STK | | ADD | A |

TABLE 20-continued

| | | | | | | |
|---|---|---|---|---|---|---|
| hCV3082219 | rs1884833 | RFXDC1 | NONCE_STK | | DOM | AG or AA |
| hCV3082219 | rs1884833 | RFXDC1 | NONCE_STK | | GEN | AG |
| hCV8942032 | rs1264352 | DDR1 | EO_STK | | DOM | CG or CC |
| hCV8942032 | rs1264352 | DDR1 | EO_STK | | GEN | CG |
| hCV8942032 | rs1264352 | DDR1 | EO_STK | | ADD | C |
| hCV8942032 | rs1264352 | DDR1 | EO_STK | AGE MALE DIAB HTN | GEN | CG |
| hCV8942032 | rs1264352 | DDR1 | EO_STK | AGE MALE DIAB HTN | DOM | CG or CC |
| hCV8942032 | rs1264352 | DDR1 | EO_STK | AGE MALE DIAB HTN | ADD | C |
| hCV8942032 | rs1264352 | DDR1 | ISCHEMIC_STK | AGE MALE DIAB HTN | GEN | CG |
| hCV8942032 | rs1264352 | DDR1 | ISCHEMIC_STK | AGE MALE DIAB HTN | DOM | CG or CC |
| hCV8942032 | rs1264352 | DDR1 | ISCHEMIC_STK | AGE MALE DIAB HTN | ADD | C |
| hCV8942032 | rs1264352 | DDR1 | ISCHEMIC_STK | | GEN | CG |
| hCV8942032 | rs1264352 | DDR1 | ISCHEMIC_STK | | DOM | CG or CC |
| hCV8942032 | rs1264352 | DDR1 | LACUNAR_STK | AGE MALE DIAB HTN | DOM | CG or CC |
| hCV8942032 | rs1264352 | DDR1 | LACUNAR_STK | AGE MALE DIAB HTN | ADD | C |
| hCV8942032 | rs1264352 | DDR1 | LACUNAR_STK | AGE MALE DIAB HTN | GEN | CG |
| hCV8942032 | rs1264352 | DDR1 | LACUNAR_STK | | DOM | CG or CC |
| hCV8942032 | rs1264352 | DDR1 | LACUNAR_STK | | ADD | C |
| hCV8942032 | rs1264352 | DDR1 | LACUNAR_STK | | GEN | CG |
| hCV8942032 | rs1264352 | DDR1 | NOHD_STK | AGE MALE DIAB HTN | GEN | CG |
| hCV8942032 | rs1264352 | DDR1 | NOHD_STK | AGE MALE DIAB HTN | DOM | CG or CC |
| hCV8942032 | rs1264352 | DDR1 | NOHD_STK | | GEN | CG |
| hCV8942032 | rs1264352 | DDR1 | NONCE_STK | AGE MALE DIAB HTN | GEN | CG |
| hCV8942032 | rs1264352 | DDR1 | NONCE_STK | AGE MALE DIAB HTN | DOM | CG or CC |
| hCV8942032 | rs1264352 | DDR1 | NONCE_STK | | GEN | CG |
| hCV8942032 | rs1264352 | DDR1 | NONCE_STK | AGE MALE DIAB HTN | ADD | C |
| hCV8942032 | rs1264352 | DDR1 | NONCE_STK | | DOM | CG or CC |
| hCV8942032 | rs1264352 | DDR1 | RECURRENT_STK | AGE MALE DIAB HTN | DOM | CG or CC |
| hCV8942032 | rs1264352 | DDR1 | RECURRENT_STK | AGE MALE DIAB HTN | GEN | CG |
| hCV8942032 | rs1264352 | DDR1 | RECURRENT_STK | AGE MALE DIAB HTN | ADD | C |
| hCV8942032 | rs1264352 | DDR1 | RECURRENT_STK | | GEN | CG |
| hCV8942032 | rs1264352 | DDR1 | RECURRENT_STK | | DOM | CG or CC |
| hCV8942032 | rs1264352 | DDR1 | RECURRENT_STK | | ADD | C |
| hCV25596936 | rs6967117 | EPHA1 | ATHERO_STK | | GEN | TC |
| hCV25596936 | rs6967117 | EPHA1 | ATHERO_STK | | DOM | TC or TT |
| hCV25596936 | rs6967117 | EPHA1 | ISCHEMIC_STK | | GEN | TC |
| hCV25596936 | rs6967117 | EPHA1 | LACUNAR_STK | | GEN | TC |
| hCV25596936 | rs6967117 | EPHA1 | NOHD_STK | | GEN | TC |
| hCV25596936 | rs6967117 | EPHA1 | NONCE_STK | | GEN | TC |
| hCV25596936 | rs6967117 | EPHA1 | NONCE_STK | | DOM | TC or TT |
| hCV25596936 | rs6967117 | EPHA1 | NONCE_STK | | ADD | T |
| hCV27511436 | rs3750145 | FZD1 | ATHERO_STK | | GEN | TC |

TABLE 20-continued

| | | | | | | |
|---|---|---|---|---|---|---|
| hCV27511436 | rs3750145 | FZD1 | ATHERO_STK | AGE MALE DIAB HTN | GEN | TC |
| hCV27511436 | rs3750145 | FZD1 | ATHERO_STK | | DOM | TC or TT |
| hCV27511436 | rs3750145 | FZD1 | ATHERO_STK | | GEN | TT |
| hCV27511436 | rs3750145 | FZD1 | ATHERO_STK | AGE MALE DIAB HTN | DOM | TC or TT |
| hCV27511436 | rs3750145 | FZD1 | ATHERO_STK | AGE MALE DIAB HTN | GEN | TT |
| hCV27511436 | rs3750145 | FZD1 | CE STK | | GEN | TC |
| hCV27511436 | rs3750145 | FZD1 | CE STK | AGE MALE DIAB HTN | GEN | TC |
| hCV27511436 | rs3750145 | FZD1 | CE_STK | AGE MALE DIAB HTN | DOM | TC or TT |
| hCV27511436 | rs3750145 | FZD1 | CE STK | AGE MALE DIAB HTN | GEN | TT |
| hCV27511436 | rs3750145 | FZD1 | CE STK | | DOM | TC or TT |
| hCV27511436 | rs3750145 | FZD1 | EO_STK | | GEN | TC |
| hCV27511436 | rs3750145 | FZD1 | EO_STK | | DOM | TC or TT |
| hCV27511436 | rs3750145 | FZD1 | EO_STK | AGE MALE DIAB HTN | GEN | TC |
| hCV27511436 | rs3750145 | FZD1 | EO_STK | | GEN | TT |
| hCV27511436 | rs3750145 | FZD1 | EO_STK | AGE MALE DIAB HTN | DOM | TC or TT |
| hCV27511436 | rs3750145 | FZD1 | EO_STK | AGE MALE DIAB HTN | GEN | TT |
| hCV27511436 | rs3750145 | FZD1 | ISCHEMIC_STK | AGE MALE DIAB HTN | GEN | TC |
| hCV27511436 | rs3750145 | FZD1 | ISCHEMIC_STK | | DOM | TC or TT |
| hCV27511436 | rs3750145 | FZD1 | ISCHEMIC_STK | AGE MALE DIAB HTN | DOM | TC or TT |
| hCV27511436 | rs3750145 | FZD1 | ISCHEMIC_STK | AGE MALE DIAB HTN | GEN | TT |
| hCV27511436 | rs3750145 | FZD1 | ISCHEMIC_STK | | GEN | TT |
| hCV27511436 | rs3750145 | FZD1 | LACUNAR_STK | AGE MALE DIAB HTN | GEN | TC |
| hCV27511436 | rs3750145 | FZD1 | LACUNAR_STK | | GEN | TC |
| hCV27511436 | rs3750145 | FZD1 | LACUNAR_STK | AGE MALE DIAB HTN | DOM | TC or TT |
| hCV27511436 | rs3750145 | FZD1 | LACUNAR_STK | AGE MALE DIAB HTN | GEN | TT |
| hCV27511436 | rs3750145 | FZD1 | LACUNAR_STK | | DOM | TC or TT |
| hCV27511436 | rs3750145 | FZD1 | LACUNAR_STK | | GEN | TT |
| hCV27511436 | rs3750145 | FZD1 | NOHD_STK | | GEN | TC |
| hCV27511436 | rs3750145 | FZD1 | NOHD_STK | AGE MALE DIAB HTN | GEN | TC |
| hCV27511436 | rs3750145 | FZD1 | NOHD_STK | | DOM | TC or TT |
| hCV27511436 | rs3750145 | FZD1 | NOHD_STK | AGE MALE DIAB HTN | DOM | TC or TT |
| hCV27511436 | rs3750145 | FZD1 | NOHD_STK | AGE MALE DIAB HTN | GEN | TT |
| hCV27511436 | rs3750145 | FZD1 | NOHD_STK | | GEN | TT |
| hCV27511436 | rs3750145 | FZD1 | NONCE_STK | AGE MALE DIAB HTN | GEN | TC |
| hCV27511436 | rs3750145 | FZD1 | NONCE_STK | | DOM | TC or TT |
| hCV27511436 | rs3750145 | FZD1 | NONCE_STK | | GEN | TT |
| hCV27511436 | rs3750145 | FZD1 | NONCE_STK | AGE MALE DIAB HTN | DOM | TC or TT |
| hCV27511436 | rs3750145 | FZD1 | NONCE_STK | AGE MALE DIAB HTN | GEN | TT |
| hCV29401764 | rs7793552 | LOC646588 | ATHERO_STK | AGE MALE DIAB HTN | GEN | CT |
| hCV15857769 | rs2924914 | | ATHERO_STK | | ADD | T |
| hCV15857769 | rs2924914 | | ATHERO_STK | | DOM | TC or TT |
| hCV15857769 | rs2924914 | | ATHERO_STK | | GEN | TC |
| hCV15857769 | rs2924914 | | ATHERO_STK | AGE MALE DIAB HTN | GEN | TT |
| hCV15857769 | rs2924914 | | ATHERO_STK | | GEN | TT |

TABLE 20-continued

| | | | | | | |
|---|---|---|---|---|---|---|
| hCV15857769 | rs2924914 | | CE_STK | | GEN | TC |
| hCV15857769 | rs2924914 | | CE_STK | | DOM | TC or TT |
| hCV15857769 | rs2924914 | | ISCHEMIC_STK | | GEN | TC |
| hCV15857769 | rs2924914 | | ISCHEMIC_STK | | DOM | TC or TT |
| hCV15857769 | rs2924914 | | ISCHEMIC_STK | | ADD | T |
| hCV15857769 | rs2924914 | | NOHD_STK | | GEN | TC |
| hCV15857769 | rs2924914 | | NOHD_STK | | DOM | TC or TT |
| hCV15857769 | rs2924914 | | NONCE_STK | | DOM | TC or TT |
| hCV15857769 | rs2924914 | | NONCE_STK | | GEN | TC |
| hCV15857769 | rs2924914 | | NONCE_STK | | ADD | T |
| hCV15857769 | rs2924914 | | RECURRENT_STK | | GEN | TC |
| hCV15857769 | rs2924914 | | RECURRENT_STK | | DOM | TC or TT |
| hCV15857769 | rs2924914 | | RECURRENT_STK | AGE MALE DIAB HTN | GEN | TC |
| hCV15857769 | rs2924914 | | RECURRENT_STK | AGE MALE DIAB HTN | DOM | TC or TT |
| hCV15857769 | rs2924914 | | RECURRENT_STK | | ADD | T |
| hCV29539757 | rs10110659 | KCNQ3 | NONCE_STK | | GEN | CA |
| hCV1348610 | rs3739636 | C9orf46 | ISCHEMIC_STK | AGE MALE DIAB HTN | GEN | AG |
| hCV1348610 | rs3739636 | C9orf46 | ISCHEMIC_STK | AGE MALE DIAB HTN | DOM | AG or AA |
| hCV1348610 | rs3739636 | C9orf46 | NOHD_STK | AGE MALE DIAB HTN | GEN | AG |
| hCV1348610 | rs3739636 | C9orf46 | NONCE_STK | AGE MALE DIAB HTN | GEN | AG |
| hCV26505812 | rs10757274 | C9P21 | ATHERO_STK | AGE MALE DIAB HTN | REC | GG |
| hCV26505812 | rs10757274 | C9P21 | NONCE_STK | AGE MALE DIAB HTN | REC | GG |
| hCV2169762 | rs1804689 | HPS1 | CE_STK | | GEN | TG |
| hCV2169762 | rs1804689 | HPS1 | CE_STK | | DOM | TG or TT |
| hCV2169762 | rs1804689 | HPS1 | CE_STK | | ADD | T |
| hCV2169762 | rs1804689 | HPS1 | CE_STK | AGE MALE DIAB HTN | DOM | TG or TT |
| hCV2169762 | rs1804689 | HPS1 | CE_STK | AGE MALE DIAB HTN | GEN | TG |
| hCV2169762 | rs1804689 | HPS1 | CE_STK | AGE MALE DIAB HTN | ADD | T |
| hCV2169762 | rs1804689 | HPS1 | EO_STK | AGE MALE DIAB HTN | REC | TT |
| hCV2169762 | rs1804689 | HPS1 | ISCHEMIC_STK | AGE MALE DIAB HTN | ADD | T |
| hCV2169762 | rs1804689 | HPS1 | ISCHEMIC_STK | | DOM | TG or TT |
| hCV2169762 | rs1804689 | HPS1 | ISCHEMIC_STK | AGE MALE DIAB HTN | DOM | TG or TT |
| hCV2169762 | rs1804689 | HPS1 | ISCHEMIC_STK | | GEN | TG |
| hCV2169762 | rs1804689 | HPS1 | ISCHEMIC_STK | AGE MALE DIAB HTN | GEN | TT |
| hCV2169762 | rs1804689 | HPS1 | ISCHEMIC_STK | | ADD | T |
| hCV2169762 | rs1804689 | HPS1 | ISCHEMIC_STK | AGE MALE DIAB HTN | GEN | TG |
| hCV2169762 | rs1804689 | HPS1 | ISCHEMIC_STK | AGE MALE DIAB HTN | REC | TT |
| hCV2169762 | rs1804689 | HPS1 | LACUNAR_STK | AGE MALE DIAB HTN | DOM | TG or TT |
| hCV2169762 | rs1804689 | HPS1 | NOHD_STK | | DOM | TG or TT |
| hCV2169762 | rs1804689 | HPS1 | NOHD_STK | | GEN | TG |
| hCV2169762 | rs1804689 | HPS1 | NOHD_STK | | ADD | T |
| hCV2169762 | rs1804689 | HPS1 | NOHD_STK | AGE MALE DIAB HTN | ADD | T |
| hCV2169762 | rs1804689 | HPS1 | NOHD_STK | AGE MALE DIAB HTN | DOM | TG or TT |
| hCV2169762 | rs1804689 | HPS1 | NOHD_STK | AGE MALE DIAB HTN | GEN | TG |
| hCV2169762 | rs1804689 | HPS1 | NOHD_STK | AGE MALE DIAB HTN | GEN | TT |

TABLE 20-continued

| | | | | | | |
|---|---|---|---|---|---|---|
| hCV2169762 | rs1804689 | HPS1 | NOHD_STK | | GEN | TT |
| hCV2169762 | rs1804689 | HPS1 | NONCE_STK | AGE MALE DIAB HTN | GEN | TT |
| hCV2169762 | rs1804689 | HPS1 | NONCE_STK | AGE MALE DIAB HTN | ADD | T |
| hCV2169762 | rs1804689 | HPS1 | NONCE_STK | AGE MALE DIAB HTN | REC | TT |
| hCV27830265 | rs12762303 | ALOX5 | ATHERO_STK | | GEN | GG |
| hCV27830265 | rs12762303 | ALOX5 | ATHERO_STK | | REC | GG |
| hCV27830265 | rs12762303 | ALOX5 | ATHERO_STK | AGE MALE DIAB HTN | ADD | G |
| hCV27830265 | rs12762303 | ALOX5 | ATHERO_STK | | ADD | G |
| hCV27830265 | rs12762303 | ALOX5 | ATHERO_STK | AGE MALE DIAB HTN | GEN | GG |
| hCV27830265 | rs12762303 | ALOX5 | ATHERO_STK | AGE MALE DIAB HTN | REC | GG |
| hCV27830265 | rs12762303 | ALOX5 | ATHERO_STK | AGE MALE DIAB HTN | DOM | GA or GG |
| hCV27830265 | rs12762303 | ALOX5 | EO_STK | AGE MALE DIAB HTN | ADD | G |
| hCV27830265 | rs12762303 | ALOX5 | EO_STK | AGE MALE DIAB HTN | DOM | GA or GG |
| hCV27830265 | rs12762303 | ALOX5 | EO_STK | AGE MALE DIAB HTN | GEN | GA |
| hCV27830265 | rs12762303 | ALOX5 | ISCHEMIC_STK | | GEN | GG |
| hCV27830265 | rs12762303 | ALOX5 | ISCHEMIC_STK | | REC | GG |
| hCV27830265 | rs12762303 | ALOX5 | ISCHEMIC_STK | AGE MALE DIAB HTN | ADD | G |
| hCV27830265 | rs12762303 | ALOX5 | ISCHEMIC_STK | AGE MALE DIAB HTN | GEN | GG |
| hCV27830265 | rs12762303 | ALOX5 | ISCHEMIC_STK | AGE MALE DIAB HTN | REC | GG |
| hCV27830265 | rs12762303 | ALOX5 | ISCHEMIC_STK | | ADD | G |
| hCV27830265 | rs12762303 | ALOX5 | LACUNAR_STK | AGE MALE DIAB HTN | ADD | G |
| hCV27830265 | rs12762303 | ALOX5 | LACUNAR_STK | AGE MALE DIAB HTN | DOM | GA or GG |
| hCV27830265 | rs12762303 | ALOX5 | NOHD_STK | | GEN | GG |
| hCV27830265 | rs12762303 | ALOX5 | NOHD_STK | | REC | GG |
| hCV27830265 | rs12762303 | ALOX5 | NOHD_STK | AGE MALE DIAB HTN | ADD | G |
| hCV27830265 | rs12762303 | ALOX5 | NONCE_STK | AGE MALE DIAB HTN | ADD | G |
| hCV27830265 | rs12762303 | ALOX5 | NONCE_STK | | GEN | GG |
| hCV27830265 | rs12762303 | ALOX5 | NONCE_STK | | ADD | G |
| hCV27830265 | rs12762303 | ALOX5 | NONCE_STK | | REC | GG |
| hCV27830265 | rs12762303 | ALOX5 | NONCE_STK | AGE MALE DIAB HTN | DOM | GA or GG |
| hCV27830265 | rs12762303 | ALOX5 | NONCE_STK | AGE MALE DIAB HTN | GEN | GA |
| hCV27830265 | rs12762303 | ALOX5 | NONCE_STK | | DOM | GA or GG |
| hCV27830265 | rs12762303 | ALOX5 | NONCE_STK | AGE MALE DIAB HTN | GEN | GG |
| hCV27830265 | rs12762303 | ALOX5 | RECURRENT_STK | | REC | GG |
| hCV27830265 | rs12762303 | ALOX5 | RECURRENT_STK | | GEN | GG |
| hCV27830265 | rs12762303 | ALOX5 | RECURRENT_STK | AGE MALE DIAB HTN | REC | GG |
| hCV27830265 | rs12762303 | ALOX5 | RECURRENT_STK | AGE MALE DIAB HTN | GEN | GG |
| hCV1053082 | rs544115 | NEU3 | ATHERO_STK | AGE MALE DIAB HTN | DOM | CT or CC |
| hCV1053082 | rs544115 | NEU3 | ATHERO_STK | AGE MALE DIAB HTN | GEN | CC |
| hCV1053082 | rs544115 | NEU3 | ATHERO_STK | AGE MALE DIAB HTN | GEN | CT |

TABLE 20-continued

| | | | | | | |
|---|---|---|---|---|---|---|
| hCV1053082 | rs544115 | NEU3 | CE_STK | AGE MALE DIAB HTN | GEN | CC |
| hCV1053082 | rs544115 | NEU3 | CE_STK | AGE MALE DIAB HTN | DOM | CT or CC |
| hCV1053082 | rs544115 | NEU3 | CE_STK | | ADD | C |
| hCV1053082 | rs544115 | NEU3 | CE_STK | AGE MALE DIAB HTN | GEN | CT |
| hCV1053082 | rs544115 | NEU3 | CE_STK | | REC | CC |
| hCV1053082 | rs544115 | NEU3 | EO_STK | | DOM | CT or CC |
| hCV1053082 | rs544115 | NEU3 | EO_STK | | GEN | CC |
| hCV1053082 | rs544115 | NEU3 | EO_STK | | GEN | CT |
| hCV1053082 | rs544115 | NEU3 | EO_STK | | ADD | C |
| hCV1053082 | rs544115 | NEU3 | EO_STK | AGE MALE DIAB HTN | GEN | CC |
| hCV1053082 | rs544115 | NEU3 | EO_STK | AGE MALE DIAB HTN | REC | CC |
| hCV1053082 | rs544115 | NEU3 | ISCHEMIC_STK | AGE MALE DIAB HTN | DOM | CT or CC |
| hCV1053082 | rs544115 | NEU3 | ISCHEMIC_STK | AGE MALE DIAB HTN | GEN | CC |
| hCV1053082 | rs544115 | NEU3 | ISCHEMIC_STK | AGE MALE DIAB HTN | GEN | CT |
| hCV1053082 | rs544115 | NEU3 | ISCHEMIC_STK | | GEN | CC |
| hCV1053082 | rs544115 | NEU3 | ISCHEMIC_STK | | DOM | CT or CC |
| hCV1053082 | rs544115 | NEU3 | ISCHEMIC_STK | | GEN | CT |
| hCV1053082 | rs544115 | NEU3 | ISCHEMIC_STK | | ADD | C |
| hCV1053082 | rs544115 | NEU3 | NOHD_STK | AGE MALE DIAB HTN | DOM | CT or CC |
| hCV1053082 | rs544115 | NEU3 | NOHD_STK | AGE MALE DIAB HTN | GEN | CT |
| hCV1053082 | rs544115 | NEU3 | NOHD_STK | AGE MALE DIAB HTN | GEN | CC |
| hCV1053082 | rs544115 | NEU3 | NOHD_STK | | GEN | CC |
| hCV1053082 | rs544115 | NEU3 | NOHD_STK | | DOM | CT or CC |
| hCV1053082 | rs544115 | NEU3 | NOHD_STK | | GEN | CT |
| hCV1053082 | rs544115 | NEU3 | NONCE_STK | AGE MALE DIAB HTN | DOM | CT or CC |
| hCV1053082 | rs544115 | NEU3 | NONCE_STK | AGE MALE DIAB HTN | GEN | CT |
| hCV1053082 | rs544115 | NEU3 | NONCE_STK | AGE MALE DIAB HTN | GEN | CC |
| hCV1053082 | rs544115 | NEU3 | NONCE_STK | | DOM | CT or CC |
| hCV1053082 | rs544115 | NEU3 | NONCE_STK | | GEN | CC |
| hCV1053082 | rs544115 | NEU3 | NONCE_STK | | GEN | CT |
| hCV1452085 | rs12223005 | TRIM22 | ISCHEMIC_STK | AGE MALE DIAB HTN | GEN | CA |
| hCV1452085 | rs12223005 | TRIM22 | LACUNAR_STK | AGE MALE DIAB HTN | GEN | CA |
| hCV1452085 | rs12223005 | TRIM22 | NOHD_STK | AGE MALE DIAB HTN | GEN | CA |
| hCV1452085 | rs12223005 | TRIM22 | NOHD_STK | AGE MALE DIAB HTN | DOM | CA or CC |
| hCV1452085 | rs12223005 | TRIM22 | NOHD_STK | AGE MALE DIAB HTN | GEN | CC |
| hCV1452085 | rs12223005 | TRIM22 | NONCE_STK | AGE MALE DIAB HTN | GEN | CA |
| hCV1452085 | rs12223005 | TRIM22 | RECURRENT_STK | AGE MALE DIAB HTN | GEN | CA |
| hCV302629 | rs9284183 | UBAC2 | EO_STK | | GEN | GA |
| hCV11474611 | rs3814843 | CALM1 | ATHERO_STK | | GEN | GT |
| hCV11474611 | rs3814843 | CALM1 | CE_STK | AGE MALE DIAB HTN | GEN | GG |
| hCV11474611 | rs3814843 | CALM1 | CE_STK | AGE MALE DIAB HTN | REC | GG |
| hCV1262973 | rs229653 | PLEKHG3 | CE_STK | | GEN | AG |
| hCV27892569 | rs4903741 | NRXN3 | CE_STK | | GEN | CC |
| hCV27892569 | rs4903741 | NRXN3 | CE_STK | | REC | CC |
| hCV27892569 | rs4903741 | NRXN3 | CE_STK | | ADD | C |
| hCV27892569 | rs4903741 | NRXN3 | NOHD_STK | | ADD | C |
| hCV27077072 | rs8060368 | | RECURRENT_STK | | ADD | C |

TABLE 20-continued

| hCV# | | | | | | |
|---|---|---|---|---|---|---|
| hCV27077072 | rs8060368 | | RECURRENT_STK | | REC | CC |
| hCV27077072 | rs8060368 | | RECURRENT_STK | AGE MALE DIAB HTN | GEN | CC |
| hCV32160712 | rs11079160 | | CE_STK | | GEN | TT |
| hCV32160712 | rs11079160 | | CE_STK | | REC | TT |
| hCV32160712 | rs11079160 | | CE_STK | | ADD | T |
| hCV32160712 | rs11079160 | | EO_STK | AGE MALE DIAB HTN | REC | TT |
| hCV32160712 | rs11079160 | | EO_STK | AGE MALE DIAB HTN | GEN | TT |
| hCV32160712 | rs11079160 | | ISCHEMIC_STK | | GEN | TT |
| hCV32160712 | rs11079160 | | ISCHEMIC_STK | | REC | TT |
| hCV1619596 | rs1048621 | SDCBP2 | CE_STK | AGE MALE DIAB HTN | GEN | AG |
| hCV1619596 | rs1048621 | SDCBP2 | CE_STK | AGE MALE DIAB HTN | DOM | AG or AA |
| hCV1619596 | rs1048621 | SDCBP2 | CE_STK | | ADD | A |
| hCV1619596 | rs1048621 | SDCBP2 | EO_STK | | DOM | AG or AA |
| hCV1619596 | rs1048621 | SDCBP2 | EO_STK | | GEN | AG |
| hCV1619596 | rs1048621 | SDCBP2 | EO_STK | | ADD | A |
| hCV1619596 | rs1048621 | SDCBP2 | EO_STK | AGE MALE DIAB HTN | DOM | AG or AA |
| hCV1619596 | rs1048621 | SDCBP2 | EO_STK | AGE MALE DIAB HTN | GEN | AG |
| hCV1619596 | rs1048621 | SDCBP2 | ISCHEMIC_STK | AGE MALE DIAB HTN | GEN | AG |
| hCV1619596 | rs1048621 | SDCBP2 | ISCHEMIC_STK | AGE MALE DIAB HTN | DOM | AG or AA |
| hCV1619596 | rs1048621 | SDCBP2 | ISCHEMIC_STK | | ADD | A |
| hCV2358247 | rs415989 | WFDC3 | RECURRENT_STK | | DOM | GA or GG |
| hCV2358247 | rs415989 | WFDC3 | RECURRENT_STK | | GEN | GA |
| hCV2358247 | rs415989 | WFDC3 | RECURRENT_STK | | ADD | G |
| hCV29537898 | rs6073804 | | NOHD_STK | | GEN | TC |
| hCV29537898 | rs6073804 | | NOHD_STK | | DOM | TC or TT |
| hCV29537898 | rs6073804 | | RECURRENT_STK | | DOM | TC or TT |
| hCV29537898 | rs6073804 | | RECURRENT_STK | | ADD | T |
| hCV29537898 | rs6073804 | | RECURRENT_STK | | GEN | TC |
| hCV1723718 | rs12481805 | UMODL1 | EO_STK | AGE MALE DIAB HTN | REC | AA |
| hCV1723718 | rs12481805 | UMODL1 | LACUNAR_STK | | REC | AA |
| hCV1723718 | rs12481805 | UMODL1 | LACUNAR_STK | | GEN | AA |

| hCV # | Odds Ratio | 95% Lower CL | 95% Upper CL | ProbChi Sq (2-sided p-value) | PVALUE_2DF |
|---|---|---|---|---|---|
| hCV1958451 | 1.753 | 0.99 | 3.106 | 0.0543 | 0.15583 |
| hCV1958451 | 1.676 | 0.974 | 2.884 | 0.0623 | . |
| hCV1958451 | 1.565 | 0.952 | 2.573 | 0.0775 | 0.15311 |
| hCV1958451 | 1.628 | 0.935 | 2.835 | 0.0852 | 0.15583 |
| hCV1958451 | 1.932 | 0.987 | 3.781 | 0.0546 | 0.06739 |
| hCV27494483 | 1.575 | 1.084 | 2.287 | 0.0171 | 0.05794 |
| hCV27494483 | 1.564 | 1.081 | 2.263 | 0.0176 | . |
| hCV27494483 | 1.522 | 1.065 | 2.175 | 0.0211 | . |
| hCV27494483 | 1.307 | 0.967 | 1.765 | 0.0814 | . |
| hCV27494483 | 1.291 | 0.966 | 1.725 | 0.0847 | . |
| hCV27494483 | 1.306 | 0.963 | 1.771 | 0.0859 | 0.21896 |
| hCV27504565 | 2.619 | 1.242 | 5.524 | 0.0115 | 0.04076 |
| hCV27504565 | 2.434 | 1.184 | 5.002 | 0.0155 | . |
| hCV27504565 | 2.336 | 1.127 | 4.841 | 0.0225 | 0.04076 |
| hCV27504565 | 1.922 | 1.077 | 3.43 | 0.027 | 0.08635 |
| hCV27504565 | 1.858 | 1.06 | 3.256 | 0.0306 | . |
| hCV27504565 | 1.821 | 1.032 | 3.212 | 0.0385 | 0.08635 |
| hCV27504565 | 1.416 | 0.957 | 2.095 | 0.0819 | 0.13029 |
| hCV27504565 | 1.527 | 0.985 | 2.369 | 0.0585 | 0.11469 |
| hCV27504565 | 1.706 | 0.952 | 3.055 | 0.0725 | 0.18169 |
| hCV27504565 | 1.811 | 0.973 | 3.371 | 0.061 | 0.10231 |

TABLE 20-continued

| | | | | | |
|---|---|---|---|---|---|
| hCV27504565 | 1.487 | 0.943 | 2.346 | 0.0877 | 0.12763 |
| hCV27504565 | 2.79 | 0.968 | 8.046 | 0.0575 | 0.15677 |
| hCV27504565 | 2.47 | 0.893 | 6.833 | 0.0817 | . |
| hCV8754449 | 2.155 | 1.043 | 4.452 | 0.0381 | 0.11587 |
| hCV8754449 | 2.021 | 1.004 | 4.065 | 0.0486 | . |
| hCV8754449 | 1.768 | 1.002 | 3.119 | 0.049 | 0.1425 |
| hCV8754449 | 1.724 | 0.995 | 2.986 | 0.0521 | . |
| hCV8754449 | 1.698 | 0.974 | 2.96 | 0.0619 | 0.1425 |
| hCV8754449 | 1.949 | 0.96 | 3.955 | 0.0647 | 0.11587 |
| hCV8754449 | 2.615 | 0.909 | 7.524 | 0.0747 | 0.20413 |
| hCV8754449 | 2.421 | 0.876 | 6.693 | 0.0883 | . |
| hCV2091644 | 1.275 | 0.956 | 1.699 | 0.0984 | . |
| hCV8820007 | 1.597 | 0.953 | 2.678 | 0.0757 | 0.18574 |
| hCV8820007 | 1.387 | 0.953 | 2.02 | 0.0876 | 0.11797 |
| hCV8820007 | 1.511 | 0.927 | 2.463 | 0.0975 | 0.21063 |
| hCV8820007 | 1.624 | 1.065 | 2.478 | 0.0243 | 0.01745 |
| hCV8820007 | 1.751 | 1.027 | 2.984 | 0.0396 | 0.07825 |
| hCV8820007 | 1.543 | 0.929 | 2.564 | 0.094 | . |
| hCV8820007 | 1.404 | 0.937 | 2.102 | 0.0998 | . |
| hCV11354788 | 1.379 | 1.016 | 1.871 | 0.0394 | . |
| hCV11354788 | 1.419 | 1.012 | 1.99 | 0.0423 | . |
| hCV11354788 | 1.397 | 0.987 | 1.977 | 0.0592 | 0.11826 |
| hCV11354788 | 1.274 | 0.99 | 1.639 | 0.0597 | . |
| hCV11354788 | 1.275 | 0.984 | 1.653 | 0.066 | 0.16972 |
| hCV11354788 | 1.231 | 0.982 | 1.542 | 0.0711 | . |
| hCV11354788 | 1.501 | 1.205 | 1.869 | 0.0003 | . |
| hCV11354788 | 1.56 | 1.216 | 2.002 | 0.0005 | . |
| hCV11354788 | 1.633 | 1.215 | 2.196 | 0.0011 | . |
| hCV11354788 | 1.712 | 1.227 | 2.39 | 0.0016 | . |
| hCV11354788 | 1.51 | 1.166 | 1.956 | 0.0018 | 0.00137 |
| hCV11354788 | 1.652 | 1.17 | 2.332 | 0.0043 | 0.00498 |
| hCV11354788 | 2.198 | 1.061 | 4.556 | 0.0341 | 0.00137 |
| hCV11354788 | 1.996 | 0.966 | 4.125 | 0.0619 | . |
| hCV11354788 | 2.533 | 0.921 | 6.962 | 0.0716 | 0.00498 |
| hCV11354788 | 1.432 | 1.068 | 1.922 | 0.0165 | . |
| hCV11354788 | 1.413 | 1.06 | 1.883 | 0.0184 | . |
| hCV11354788 | 1.365 | 1.053 | 1.768 | 0.0186 | . |
| hCV11354788 | 1.466 | 1.057 | 2.032 | 0.0217 | . |
| hCV11354788 | 1.396 | 1.038 | 1.876 | 0.0273 | 0.05898 |
| hCV11354788 | 1.423 | 1.017 | 1.991 | 0.0396 | 0.0564 |
| hCV11354788 | 1.356 | 1.113 | 1.652 | 0.0025 | . |
| hCV11354788 | 1.309 | 1.097 | 1.563 | 0.0029 | . |
| hCV11354788 | 1.346 | 1.099 | 1.65 | 0.0041 | 0.0099 |
| hCV11354788 | 1.367 | 1.077 | 1.735 | 0.0102 | . |
| hCV11354788 | 1.404 | 1.077 | 1.831 | 0.0122 | . |
| hCV11354788 | 1.376 | 1.047 | 1.809 | 0.022 | 0.03661 |
| hCV11354788 | 1.31 | 1.083 | 1.585 | 0.0053 | . |
| hCV11354788 | 1.345 | 1.086 | 1.666 | 0.0065 | . |
| hCV11354788 | 1.321 | 1.059 | 1.647 | 0.0135 | 0.02034 |
| hCV11354788 | 1.354 | 1.052 | 1.743 | 0.0188 | . |
| hCV11354788 | 1.375 | 1.036 | 1.825 | 0.0275 | . |
| hCV11354788 | 1.332 | 0.995 | 1.784 | 0.0544 | 0.06231 |
| hCV11354788 | 1.248 | 0.99 | 1.573 | 0.0613 | 0.17362 |
| hCV11354788 | 1.233 | 0.984 | 1.545 | 0.0692 | . |
| hCV11354788 | 1.295 | 0.953 | 1.758 | 0.0982 | . |
| hCV11354788 | 2.096 | 1.252 | 3.509 | 0.0049 | 0.01709 |
| hCV11354788 | 1.962 | 1.187 | 3.243 | 0.0086 | . |
| hCV11354788 | 1.701 | 1.072 | 2.7 | 0.0241 | . |
| hCV11354788 | 1.383 | 0.979 | 1.955 | 0.066 | . |
| hCV11354788 | 1.382 | 0.968 | 1.973 | 0.075 | 0.1844 |
| hCV11354788 | 1.321 | 0.972 | 1.796 | 0.0752 | . |
| hCV16158671 | 1.415 | 1.045 | 1.915 | 0.0248 | . |
| hCV16158671 | 1.442 | 1.028 | 2.023 | 0.0339 | . |
| hCV16158671 | 1.304 | 1.013 | 1.679 | 0.039 | . |
| hCV16158671 | 1.257 | 1.005 | 1.573 | 0.0456 | . |
| hCV16158671 | 1.302 | 1.003 | 1.69 | 0.047 | 0.11865 |
| hCV16158671 | 1.397 | 0.986 | 1.98 | 0.06 | 0.07966 |
| hCV16158671 | 1.509 | 1.213 | 1.879 | 0.0002 | . |
| hCV16158671 | 1.585 | 1.235 | 2.035 | 0.0003 | . |
| hCV16158671 | 1.543 | 1.191 | 1.999 | 0.001 | 0.00106 |
| hCV16158671 | 1.631 | 1.216 | 2.189 | 0.0011 | . |
| hCV16158671 | 1.733 | 1.241 | 2.42 | 0.0012 | . |
| hCV16158671 | 1.684 | 1.192 | 2.381 | 0.0032 | 0.00458 |
| hCV16158671 | 2.083 | 1.015 | 4.275 | 0.0454 | 0.00106 |
| hCV16158671 | 1.883 | 0.92 | 3.853 | 0.0832 | . |
| hCV16158671 | 2.319 | 0.869 | 6.191 | 0.093 | 0.00458 |
| hCV16158671 | 1.426 | 1.069 | 1.901 | 0.0156 | . |
| hCV16158671 | 1.364 | 1.055 | 1.763 | 0.0178 | . |
| hCV16158671 | 1.409 | 1.052 | 1.887 | 0.0215 | . |
| hCV16158671 | 1.415 | 1.051 | 1.905 | 0.022 | 0.05284 |

TABLE 20-continued

| | | | | | |
|---|---|---|---|---|---|
| hCV16158671 | 1.448 | 1.044 | 2.008 | 0.0267 | . |
| hCV16158671 | 1.409 | 1.006 | 1.975 | 0.0461 | 0.07117 |
| hCV16158671 | 1.376 | 1.13 | 1.677 | 0.0015 | . |
| hCV16158671 | 1.324 | 1.11 | 1.579 | 0.0018 | . |
| hCV16158671 | 1.365 | 1.113 | 1.674 | 0.0028 | 0.00631 |
| hCV16158671 | 1.375 | 1.085 | 1.742 | 0.0083 | . |
| hCV16158671 | 1.413 | 1.083 | 1.843 | 0.0109 | . |
| hCV16158671 | 1.378 | 1.047 | 1.813 | 0.0222 | 0.03074 |
| hCV16158671 | 1.327 | 1.099 | 1.603 | 0.0032 | . |
| hCV16158671 | 1.366 | 1.103 | 1.691 | 0.0042 | . |
| hCV16158671 | 1.337 | 1.072 | 1.668 | 0.0101 | 0.01299 |
| hCV16158671 | 1.366 | 1.063 | 1.754 | 0.0147 | . |
| hCV16158671 | 1.384 | 1.042 | 1.838 | 0.0247 | . |
| hCV16158671 | 1.33 | 0.992 | 1.783 | 0.0569 | 0.04871 |
| hCV16158671 | 2.103 | 0.891 | 4.961 | 0.0896 | 0.04871 |
| hCV16158671 | 1.251 | 0.998 | 1.568 | 0.0518 | . |
| hCV16158671 | 1.259 | 0.998 | 1.588 | 0.0525 | 0.14733 |
| hCV16158671 | 1.206 | 0.985 | 1.475 | 0.0696 | . |
| hCV16158671 | 1.274 | 0.967 | 1.679 | 0.0852 | . |
| hCV16158671 | 1.297 | 0.954 | 1.761 | 0.0967 | . |
| hCV16158671 | 2.087 | 1.24 | 3.512 | 0.0056 | 0.01904 |
| hCV16158671 | 1.943 | 1.171 | 3.225 | 0.0102 | . |
| hCV16158671 | 1.671 | 1.053 | 2.652 | 0.0294 | . |
| hCV16158671 | 1.375 | 0.971 | 1.948 | 0.0728 | . |
| hCV16158671 | 1.38 | 0.964 | 1.975 | 0.0786 | 0.19939 |
| hCV16158671 | 1.307 | 0.961 | 1.776 | 0.0879 | . |
| hCV16336 | 1.377 | 1.032 | 1.837 | 0.0298 | . |
| hCV16336 | 1.315 | 1.013 | 1.707 | 0.0399 | . |
| hCV16336 | 1.39 | 0.96 | 2.013 | 0.0812 | . |
| hCV16336 | 1.523 | 1.147 | 2.022 | 0.0036 | . |
| hCV16336 | 1.525 | 1.126 | 2.066 | 0.0065 | . |
| hCV16336 | 1.49 | 1.033 | 2.148 | 0.0328 | . |
| hCV16336 | 1.52 | 1.028 | 2.247 | 0.036 | . |
| hCV16336 | 3.625 | 0.825 | 15.926 | 0.0881 | 0.01511 |
| hCV16336 | 1.659 | 1.156 | 2.381 | 0.0061 | . |
| hCV16336 | 1.559 | 1.11 | 2.188 | 0.0103 | . |
| hCV16336 | 1.389 | 1.014 | 1.904 | 0.0407 | . |
| hCV16336 | 1.355 | 1.01 | 1.819 | 0.0427 | . |
| hCV16336 | 1.379 | 1.127 | 1.686 | 0.0018 | . |
| hCV16336 | 1.41 | 1.131 | 1.758 | 0.0023 | . |
| hCV16336 | 1.377 | 1.052 | 1.803 | 0.0198 | . |
| hCV16336 | 1.417 | 1.056 | 1.901 | 0.0203 | . |
| hCV16336 | 1.227 | 0.99 | 1.521 | 0.0619 | . |
| hCV16336 | 1.248 | 0.986 | 1.581 | 0.0658 | . |
| hCV16336 | 1.345 | 1.046 | 1.73 | 0.0211 | . |
| hCV16336 | 1.3 | 1.035 | 1.633 | 0.0244 | . |
| hCV16336 | 1.39 | 0.999 | 1.935 | 0.0508 | . |
| hCV16336 | 1.346 | 0.997 | 1.816 | 0.0521 | . |
| hCV26478797 | 1.205 | 0.965 | 1.505 | 0.099 | . |
| hCV11425801 | 1.99 | 1.402 | 2.824 | 0.0001 | 0.0005 |
| hCV11425801 | 1.726 | 1.251 | 2.38 | 0.0009 | . |
| hCV11425801 | 1.539 | 1.183 | 2.002 | 0.0013 | 0.00531 |
| hCV11425801 | 1.481 | 1.159 | 1.892 | 0.0017 | . |
| hCV11425801 | 1.179 | 1.019 | 1.363 | 0.0271 | . |
| hCV11425801 | 1.385 | 1.028 | 1.865 | 0.0323 | 0.00531 |
| hCV11425801 | 1.18 | 0.974 | 1.429 | 0.0913 | . |
| hCV11425801 | 1.639 | 1.226 | 2.192 | 0.0009 | 0.00345 |
| hCV11425801 | 1.718 | 1.229 | 2.4 | 0.0015 | 0.00399 |
| hCV11425801 | 1.484 | 1.135 | 1.939 | 0.0038 | . |
| hCV11425801 | 1.483 | 1.092 | 2.015 | 0.0116 | . |
| hCV11425801 | 1.617 | 1.235 | 2.116 | 0.0005 | 0.00176 |
| hCV11425801 | 1.453 | 1.135 | 1.86 | 0.003 | . |
| hCV11425801 | 1.321 | 1.082 | 1.612 | 0.0062 | 0.02335 |
| hCV11425801 | 1.276 | 1.062 | 1.534 | 0.0094 | . |
| hCV11425801 | 1.104 | 0.985 | 1.236 | 0.0889 | . |
| hCV11425801 | 1.826 | 1.186 | 2.811 | 0.0063 | 0.01078 |
| hCV11425801 | 1.51 | 1.014 | 2.25 | 0.0427 | . |
| hCV11425801 | 1.368 | 0.973 | 1.923 | 0.0715 | 0.11508 |
| hCV11425801 | 1.641 | 1.229 | 2.19 | 0.0008 | 0.00304 |
| hCV11425801 | 1.472 | 1.13 | 1.916 | 0.0041 | . |
| hCV11425801 | 1.276 | 1.043 | 1.559 | 0.0176 | . |
| hCV11425801 | 1.295 | 1.041 | 1.61 | 0.0201 | 0.05622 |
| hCV11425801 | 1.12 | 0.991 | 1.266 | 0.07 | . |
| hCV11425801 | 1.244 | 0.973 | 1.591 | 0.0821 | 0.05622 |
| hCV11425801 | 1.689 | 1.268 | 2.251 | 0.0003 | . |
| hCV11425801 | 1.48 | 1.176 | 1.862 | 0.0008 | 0.00363 |
| hCV11425801 | 1.393 | 1.125 | 1.725 | 0.0023 | . |
| hCV11425801 | 1.126 | 0.989 | 1.282 | 0.0732 | . |
| hCV11425801 | 1.249 | 0.96 | 1.625 | 0.0971 | 0.00363 |
| hCV11425801 | 1.636 | 0.988 | 2.71 | 0.0556 | 0.12066 |

TABLE 20-continued

| | | | | | |
|---|---|---|---|---|---|
| hCV11425801 | 1.368 | 0.951 | 1.967 | 0.091 | 0.22257 |
| hCV11425842 | 1.483 | 1.042 | 2.111 | 0.0286 | . |
| hCV11425842 | 1.508 | 1.036 | 2.195 | 0.032 | 0.08825 |
| hCV11425842 | 1.281 | 0.979 | 1.676 | 0.0707 | . |
| hCV11425842 | 1.445 | 0.961 | 2.172 | 0.077 | 0.08825 |
| hCV11425842 | 1.292 | 0.972 | 1.717 | 0.0777 | 0.19224 |
| hCV11425842 | 1.44 | 1.056 | 1.965 | 0.0214 | 0.06697 |
| hCV11425842 | 1.4 | 1.047 | 1.871 | 0.0232 | . |
| hCV11425842 | 1.497 | 1.048 | 2.138 | 0.0267 | 0.08575 |
| hCV11425842 | 1.418 | 1.016 | 1.978 | 0.0399 | . |
| hCV11425842 | 1.338 | 0.953 | 1.878 | 0.0927 | 0.06697 |
| hCV11425842 | 1.334 | 0.998 | 1.785 | 0.0518 | 0.1427 |
| hCV11425842 | 1.309 | 0.997 | 1.719 | 0.0525 | . |
| hCV11425842 | 1.435 | 1.028 | 2.005 | 0.0341 | 0.10566 |
| hCV11425842 | 1.379 | 1.008 | 1.886 | 0.0444 | . |
| hCV1209800 | 1.54 | 0.995 | 2.384 | 0.0529 | . |
| hCV1209800 | 1.497 | 0.985 | 2.277 | 0.059 | . |
| hCV16134786 | 1.287 | 1.044 | 1.587 | 0.018 | . |
| hCV16134786 | 1.967 | 1.08 | 3.581 | 0.0269 | 0.0477 |
| hCV16134786 | 1.845 | 1.02 | 3.336 | 0.0428 | . |
| hCV16134786 | 1.283 | 0.999 | 1.65 | 0.0513 | . |
| hCV16134786 | 2.149 | 1.196 | 3.86 | 0.0105 | 0.0372 |
| hCV16134786 | 2.114 | 1.189 | 3.76 | 0.0108 | . |
| hCV16134786 | 1.243 | 0.98 | 1.578 | 0.073 | . |
| hCV16134786 | 1.158 | 0.984 | 1.363 | 0.0777 | . |
| hCV16134786 | 1.501 | 0.953 | 2.365 | 0.0799 | 0.16516 |
| hCV25651109 | 8.255 | 1.015 | 67.158 | 0.0484 | 0.13989 |
| hCV25651109 | 8.232 | 1.012 | 66.954 | 0.0487 | . |
| hCV25651109 | 7.978 | 0.963 | 66.101 | 0.0542 | 0.13989 |
| hCV25651109 | 6.169 | 0.743 | 51.25 | 0.0921 | 0.2415 |
| hCV25651109 | 5.892 | 0.724 | 47.938 | 0.0973 | . |
| hCV25651109 | 5.866 | 0.721 | 47.736 | 0.0981 | 0.2415 |
| hCV30308202 | 1.354 | 1.016 | 1.803 | 0.0384 | . |
| hCV30308202 | 3.706 | 1.016 | 13.521 | 0.0473 | 0.12903 |
| hCV30308202 | 3.537 | 0.978 | 12.795 | 0.0542 | . |
| hCV30308202 | 1.349 | 0.975 | 1.868 | 0.0712 | . |
| hCV30308202 | 3.204 | 0.854 | 12.028 | 0.0845 | 0.12903 |
| hCV30308202 | 2.419 | 0.856 | 6.839 | 0.0956 | 0.11116 |
| hCV3082219 | 1.273 | 0.982 | 1.65 | 0.0681 | . |
| hCV3082219 | 1.399 | 1.049 | 1.867 | 0.0225 | . |
| hCV3082219 | 1.424 | 1.035 | 1.959 | 0.03 | . |
| hCV3082219 | 1.391 | 1.003 | 1.93 | 0.0483 | 0.07365 |
| hCV3082219 | 1.213 | 0.991 | 1.485 | 0.0608 | . |
| hCV3082219 | 1.227 | 0.984 | 1.529 | 0.0688 | . |
| hCV3082219 | 1.214 | 0.969 | 1.52 | 0.0917 | 0.17242 |
| hCV8942032 | 1.484 | 1.127 | 1.954 | 0.0049 | . |
| hCV8942032 | 1.488 | 1.12 | 1.978 | 0.0062 | 0.01912 |
| hCV8942032 | 1.394 | 1.092 | 1.78 | 0.0077 | . |
| hCV8942032 | 1.513 | 1.09 | 2.101 | 0.0134 | 0.04543 |
| hCV8942032 | 1.486 | 1.083 | 2.038 | 0.0142 | . |
| hCV8942032 | 1.37 | 1.037 | 1.81 | 0.0265 | . |
| hCV8942032 | 1.383 | 1.056 | 1.811 | 0.0183 | 0.061 |
| hCV8942032 | 1.341 | 1.035 | 1.737 | 0.0262 | . |
| hCV8942032 | 1.241 | 0.991 | 1.554 | 0.0604 | . |
| hCV8942032 | 1.208 | 0.988 | 1.476 | 0.0658 | 0.17422 |
| hCV8942032 | 1.178 | 0.972 | 1.428 | 0.0949 | . |
| hCV8942032 | 1.803 | 1.207 | 2.694 | 0.004 | . |
| hCV8942032 | 1.64 | 1.165 | 2.307 | 0.0046 | . |
| hCV8942032 | 1.77 | 1.166 | 2.689 | 0.0074 | 0.01502 |
| hCV8942032 | 1.418 | 1.036 | 1.942 | 0.0294 | . |
| hCV8942032 | 1.328 | 1.023 | 1.725 | 0.0333 | . |
| hCV8942032 | 1.405 | 1.01 | 1.954 | 0.0435 | 0.09148 |
| hCV8942032 | 1.358 | 1.021 | 1.807 | 0.0355 | 0.09951 |
| hCV8942032 | 1.309 | 0.994 | 1.723 | 0.0554 | . |
| hCV8942032 | 1.218 | 0.98 | 1.513 | 0.0749 | 0.10394 |
| hCV8942032 | 1.419 | 1.047 | 1.923 | 0.0242 | 0.07825 |
| hCV8942032 | 1.377 | 1.027 | 1.845 | 0.0323 | . |
| hCV8942032 | 1.244 | 0.992 | 1.559 | 0.0585 | 0.1603 |
| hCV8942032 | 1.269 | 0.983 | 1.637 | 0.0672 | . |
| hCV8942032 | 1.211 | 0.975 | 1.504 | 0.0833 | . |
| hCV8942032 | 1.953 | 1.219 | 3.129 | 0.0054 | . |
| hCV8942032 | 1.965 | 1.206 | 3.201 | 0.0067 | 0.02072 |
| hCV8942032 | 1.728 | 1.15 | 2.594 | 0.0084 | . |
| hCV8942032 | 1.415 | 1.001 | 2.001 | 0.0494 | 0.14433 |
| hCV8942032 | 1.384 | 0.992 | 1.931 | 0.0561 | . |
| hCV8942032 | 1.269 | 0.959 | 1.68 | 0.0956 | . |
| hCV25596936 | 1.432 | 1.071 | 1.913 | 0.0153 | 0.03518 |
| hCV25596936 | 1.345 | 1.017 | 1.779 | 0.038 | . |
| hCV25596936 | 1.263 | 0.997 | 1.601 | 0.0533 | 0.04107 |
| hCV25596936 | 1.433 | 0.981 | 2.092 | 0.0627 | 0.15123 |

TABLE 20-continued

| | | | | | |
|---|---|---|---|---|---|
| hCV25596936 | 1.302 | 1.01 | 1.679 | 0.0419 | 0.06504 |
| hCV25596936 | 1.438 | 1.108 | 1.865 | 0.0063 | 0.01473 |
| hCV25596936 | 1.352 | 1.052 | 1.736 | 0.0183 | . |
| hCV25596936 | 1.224 | 0.981 | 1.526 | 0.0731 | . |
| hCV27511436 | 2.706 | 1.389 | 5.271 | 0.0034 | 0.00764 |
| hCV27511436 | 2.877 | 1.272 | 6.508 | 0.0111 | 0.03448 |
| hCV27511436 | 2.231 | 1.18 | 4.22 | 0.0136 | . |
| hCV27511436 | 2.105 | 1.11 | 3.993 | 0.0227 | 0.00764 |
| hCV27511436 | 2.397 | 1.108 | 5.184 | 0.0263 | . |
| hCV27511436 | 2.271 | 1.046 | 4.93 | 0.0381 | 0.03448 |
| hCV27511436 | 2.392 | 1.294 | 4.422 | 0.0054 | 0.00015 |
| hCV27511436 | 3.084 | 1.383 | 6.875 | 0.0059 | 0.00609 |
| hCV27511436 | 2.257 | 1.055 | 4.828 | 0.0359 | . |
| hCV27511436 | 2.025 | 0.943 | 4.352 | 0.0705 | 0.00609 |
| hCV27511436 | 1.647 | 0.917 | 2.958 | 0.0946 | . |
| hCV27511436 | 5.062 | 2.211 | 11.593 | 0.0001 | 0.00053 |
| hCV27511436 | 4.226 | 1.901 | 9.394 | 0.0004 | . |
| hCV27511436 | 4.83 | 1.964 | 11.882 | 0.0006 | 0.00223 |
| hCV27511436 | 3.983 | 1.786 | 8.882 | 0.0007 | 0.00053 |
| hCV27511436 | 3.916 | 1.653 | 9.279 | 0.0019 | . |
| hCV27511436 | 3.668 | 1.542 | 8.725 | 0.0033 | 0.00223 |
| hCV27511436 | 3.449 | 1.798 | 6.618 | 0.0002 | 0.00063 |
| hCV27511436 | 2.217 | 1.397 | 3.521 | 0.0007 | . |
| hCV27511436 | 2.78 | 1.498 | 5.158 | 0.0012 | . |
| hCV27511436 | 2.59 | 1.392 | 4.82 | 0.0027 | 0.00063 |
| hCV27511436 | 2.033 | 1.277 | 3.236 | 0.0028 | 0.00001 |
| hCV27511436 | 12.63 | 2.356 | 67.742 | 0.0031 | 0.00773 |
| hCV27511436 | 8.049 | 1.905 | 34.008 | 0.0046 | 0.00667 |
| hCV27511436 | 9.88 | 1.896 | 51.473 | 0.0065 | . |
| hCV27511436 | 9.1 | 1.743 | 47.499 | 0.0088 | 0.00773 |
| hCV27511436 | 6.318 | 1.528 | 26.128 | 0.0109 | . |
| hCV27511436 | 5.858 | 1.413 | 24.288 | 0.0148 | 0.00667 |
| hCV27511436 | 2.83 | 1.661 | 4.824 | 0.0001 | 0.00002 |
| hCV27511436 | 3.231 | 1.612 | 6.479 | 0.001 | 0.00243 |
| hCV27511436 | 2.088 | 1.258 | 3.467 | 0.0044 | . |
| hCV27511436 | 2.586 | 1.334 | 5.012 | 0.0049 | . |
| hCV27511436 | 2.4 | 1.235 | 4.665 | 0.0098 | 0.00243 |
| hCV27511436 | 1.891 | 1.135 | 3.149 | 0.0144 | 0.00002 |
| hCV27511436 | 3.955 | 1.807 | 8.657 | 0.0006 | 0.00244 |
| hCV27511436 | 2.827 | 1.555 | 5.142 | 0.0007 | . |
| hCV27511436 | 2.657 | 1.457 | 4.843 | 0.0014 | 0.00023 |
| hCV27511436 | 3.312 | 1.571 | 6.985 | 0.0017 | . |
| hCV27511436 | 3.137 | 1.483 | 6.636 | 0.0028 | 0.00244 |
| hCV29401764 | 1.633 | 0.952 | 2.798 | 0.0746 | 0.17293 |
| hCV15857769 | 1.187 | 1.011 | 1.394 | 0.0361 | . |
| hCV15857769 | 1.255 | 1.011 | 1.557 | 0.0391 | . |
| hCV15857769 | 1.23 | 0.979 | 1.545 | 0.0756 | 0.1026 |
| hCV15857769 | 1.532 | 0.946 | 2.48 | 0.0827 | 0.21882 |
| hCV15857769 | 1.36 | 0.947 | 1.952 | 0.096 | 0.1026 |
| hCV15857769 | 1.295 | 1.029 | 1.63 | 0.0275 | 0.0333 |
| hCV15857769 | 1.209 | 0.97 | 1.507 | 0.0919 | . |
| hCV15857769 | 1.252 | 1.05 | 1.493 | 0.0124 | 0.04329 |
| hCV15857769 | 1.219 | 1.031 | 1.441 | 0.0203 | . |
| hCV15857769 | 1.117 | 0.983 | 1.27 | 0.0904 | . |
| hCV15857769 | 1.263 | 1.043 | 1.53 | 0.0167 | 0.05587 |
| hCV15857769 | 1.228 | 1.024 | 1.474 | 0.0271 | . |
| hCV15857769 | 1.226 | 1.013 | 1.483 | 0.0365 | . |
| hCV15857769 | 1.224 | 1.001 | 1.497 | 0.0489 | 0.11225 |
| hCV15857769 | 1.149 | 0.996 | 1.327 | 0.057 | . |
| hCV15857769 | 1.788 | 1.299 | 2.463 | 0.0004 | 0.00102 |
| hCV15857769 | 1.641 | 1.203 | 2.238 | 0.0018 | . |
| hCV15857769 | 1.733 | 1.112 | 2.701 | 0.0151 | 0.04261 |
| hCV15857769 | 1.596 | 1.042 | 2.443 | 0.0315 | . |
| hCV15857769 | 1.259 | 1.003 | 1.58 | 0.0471 | . |
| hCV29539757 | 1.401 | 0.977 | 2.009 | 0.0671 | 0.0978 |
| hCV1348610 | 1.307 | 1.014 | 1.685 | 0.0389 | 0.11763 |
| hCV1348610 | 1.262 | 0.993 | 1.602 | 0.0567 | . |
| hCV1348610 | 1.285 | 0.981 | 1.683 | 0.0688 | 0.15881 |
| hCV1348610 | 1.283 | 0.96 | 1.714 | 0.0923 | 0.22581 |
| hCV26505812 | 1.363 | 0.956 | 1.943 | 0.0866 | . |
| hCV26505812 | 1.32 | 0.959 | 1.818 | 0.0886 | . |
| hCV2169762 | 1.479 | 1.172 | 1.866 | 0.001 | 0.00436 |
| hCV2169762 | 1.422 | 1.139 | 1.774 | 0.0018 | . |
| hCV2169762 | 1.216 | 1.033 | 1.433 | 0.0189 | . |
| hCV2169762 | 1.401 | 1.046 | 1.876 | 0.0237 | . |
| hCV2169762 | 1.41 | 1.038 | 1.916 | 0.0281 | 0.07665 |
| hCV2169762 | 1.25 | 1.003 | 1.559 | 0.0473 | . |
| hCV2169762 | 1.493 | 0.946 | 2.357 | 0.0852 | . |
| hCV2169762 | 1.246 | 1.052 | 1.476 | 0.0108 | . |
| hCV2169762 | 1.233 | 1.043 | 1.456 | 0.014 | . |

TABLE 20-continued

| | | | | | |
|---|---|---|---|---|---|
| hCV2169762 | 1.31 | 1.046 | 1.641 | 0.0187 | . |
| hCV2169762 | 1.236 | 1.035 | 1.476 | 0.0192 | 0.04864 |
| hCV2169762 | 1.536 | 1.045 | 2.259 | 0.0291 | 0.03859 |
| hCV2169762 | 1.148 | 1.014 | 1.301 | 0.0296 | . |
| hCV2169762 | 1.258 | 0.991 | 1.597 | 0.0589 | 0.03859 |
| hCV2169762 | 1.382 | 0.955 | 2 | 0.0861 | . |
| hCV2169762 | 1.362 | 0.949 | 1.955 | 0.0934 | . |
| hCV2169762 | 1.35 | 1.125 | 1.619 | 0.0012 | . |
| hCV2169762 | 1.354 | 1.116 | 1.642 | 0.0021 | 0.00545 |
| hCV2169762 | 1.218 | 1.064 | 1.395 | 0.0042 | . |
| hCV2169762 | 1.281 | 1.069 | 1.534 | 0.0073 | . |
| hCV2169762 | 1.386 | 1.089 | 1.763 | 0.0079 | . |
| hCV2169762 | 1.347 | 1.044 | 1.737 | 0.0221 | 0.02354 |
| hCV2169762 | 1.553 | 1.031 | 2.34 | 0.035 | 0.02354 |
| hCV2169762 | 1.335 | 0.985 | 1.809 | 0.063 | 0.00545 |
| hCV2169762 | 1.497 | 0.971 | 2.308 | 0.0677 | 0.17878 |
| hCV2169762 | 1.188 | 0.981 | 1.438 | 0.0774 | . |
| hCV2169762 | 1.422 | 0.939 | 2.153 | 0.0966 | . |
| hCV27830265 | 2.437 | 1.292 | 4.596 | 0.0059 | 0.01855 |
| hCV27830265 | 2.354 | 1.254 | 4.421 | 0.0077 | . |
| hCV27830265 | 1.051 | 0.0204 | 1.38 | 1.812 | . |
| hCV27830265 | 1.256 | 1.027 | 1.535 | 0.0262 | . |
| hCV27830265 | 2.705 | 1.09 | 6.711 | 0.0318 | 0.04449 |
| hCV27830265 | 2.508 | 1.018 | 6.179 | 0.0456 | . |
| hCV27830265 | 1.356 | 0.997 | 1.845 | 0.0522 | . |
| hCV27830265 | 1.294 | 0.988 | 1.697 | 0.0616 | . |
| hCV27830265 | 1.322 | 0.979 | 1.786 | 0.0687 | . |
| hCV27830265 | 1.302 | 0.956 | 1.772 | 0.0938 | 0.17365 |
| hCV27830265 | 1.909 | 1.098 | 3.32 | 0.0219 | 0.06853 |
| hCV27830265 | 1.88 | 1.084 | 3.26 | 0.0246 | . |
| hCV27830265 | 1.231 | 0.99 | 1.53 | 0.0618 | . |
| hCV27830265 | 2.011 | 0.94 | 4.304 | 0.0719 | 0.12112 |
| hCV27830265 | 1.923 | 0.902 | 4.099 | 0.0903 | . |
| hCV27830265 | 1.146 | 0.977 | 1.344 | 0.0941 | . |
| hCV27830265 | 1.391 | 0.982 | 1.972 | 0.0632 | . |
| hCV27830265 | 1.408 | 0.958 | 2.069 | 0.082 | . |
| hCV27830265 | 1.889 | 1.048 | 3.404 | 0.0342 | 0.10105 |
| hCV27830265 | 1.859 | 1.035 | 3.339 | 0.0381 | . |
| hCV27830265 | 1.246 | 0.988 | 1.571 | 0.0637 | . |
| hCV27830265 | 1.376 | 1.074 | 1.761 | 0.0114 | . |
| hCV27830265 | 2.132 | 1.172 | 3.878 | 0.0132 | 0.02459 |
| hCV27830265 | 1.248 | 1.042 | 1.493 | 0.0158 | . |
| hCV27830265 | 2.037 | 1.124 | 3.693 | 0.019 | . |
| hCV27830265 | 1.386 | 1.051 | 1.83 | 0.021 | . |
| hCV27830265 | 1.335 | 1.004 | 1.775 | 0.0472 | 0.03807 |
| hCV27830265 | 1.221 | 0.996 | 1.497 | 0.0553 | . |
| hCV27830265 | 2.187 | 0.939 | 5.093 | 0.0697 | 0.03807 |
| hCV27830265 | 3.032 | 1.42 | 6.474 | 0.0042 | . |
| hCV27830265 | 2.907 | 1.354 | 6.243 | 0.0062 | 0.01156 |
| hCV27830265 | 4.128 | 1.238 | 13.766 | 0.021 | . |
| hCV27830265 | 4.048 | 1.205 | 13.592 | 0.0237 | 0.06695 |
| hCV1053082 | 2.424 | 1.101 | 5.338 | 0.028 | . |
| hCV1053082 | 2.412 | 1.089 | 5.342 | 0.03 | 0.08891 |
| hCV1053082 | 2.452 | 1.079 | 5.571 | 0.0322 | 0.08891 |
| hCV1053082 | 2.519 | 1.057 | 6.004 | 0.0372 | 0.11133 |
| hCV1053082 | 2.464 | 1.039 | 5.844 | 0.0406 | . |
| hCV1053082 | 1.228 | 1.001 | 1.508 | 0.0494 | . |
| hCV1053082 | 2.339 | 0.958 | 5.715 | 0.0622 | 0.11133 |
| hCV1053082 | 1.233 | 0.972 | 1.564 | 0.084 | . |
| hCV1053082 | 2.443 | 1.139 | 5.24 | 0.0218 | . |
| hCV1053082 | 2.453 | 1.139 | 5.282 | 0.0219 | 0.07158 |
| hCV1053082 | 2.419 | 1.101 | 5.313 | 0.0278 | 0.07158 |
| hCV1053082 | 1.306 | 1.002 | 1.703 | 0.0483 | . |
| hCV1053082 | 2.182 | 0.894 | 5.324 | 0.0865 | 0.11774 |
| hCV1053082 | 1.297 | 0.959 | 1.752 | 0.0909 | . |
| hCV1053082 | 2.441 | 1.274 | 4.675 | 0.0071 | . |
| hCV1053082 | 2.438 | 1.267 | 4.689 | 0.0076 | 0.02673 |
| hCV1053082 | 2.449 | 1.249 | 4.801 | 0.0091 | 0.02673 |
| hCV1053082 | 1.695 | 1.052 | 2.732 | 0.0302 | 0.08337 |
| hCV1053082 | 1.658 | 1.032 | 2.664 | 0.0365 | . |
| hCV1053082 | 1.577 | 0.965 | 2.576 | 0.0691 | 0.08337 |
| hCV1053082 | 1.152 | 0.989 | 1.343 | 0.0698 | . |
| hCV1053082 | 2.225 | 1.109 | 4.465 | 0.0244 | . |
| hCV1053082 | 2.282 | 1.109 | 4.692 | 0.025 | 0.07672 |
| hCV1053082 | 2.202 | 1.092 | 4.438 | 0.0274 | 0.07672 |
| hCV1053082 | 1.715 | 1.006 | 2.924 | 0.0475 | 0.13875 |
| hCV1053082 | 1.695 | 0.998 | 2.88 | 0.0509 | . |
| hCV1053082 | 1.651 | 0.955 | 2.855 | 0.0727 | 0.13875 |
| hCV1053082 | 2.388 | 1.164 | 4.897 | 0.0175 | . |
| hCV1053082 | 2.451 | 1.164 | 5.163 | 0.0183 | 0.05761 |

TABLE 20-continued

| | | | | | |
|---|---|---|---|---|---|
| hCV1053082 | 2.36 | 1.145 | 4.866 | 0.02 | 0.05761 |
| hCV1053082 | 1.684 | 0.963 | 2.945 | 0.0673 | . |
| hCV1053082 | 1.69 | 0.963 | 2.966 | 0.0674 | 0.18668 |
| hCV1053082 | 1.672 | 0.939 | 2.977 | 0.0808 | 0.18668 |
| hCV1452085 | 2.844 | 0.95 | 8.517 | 0.0617 | 0.07446 |
| hCV1452085 | 8.604 | 0.863 | 85.766 | 0.0666 | 0.00063 |
| hCV1452085 | 4.953 | 1.405 | 17.456 | 0.0128 | 0.01831 |
| hCV1452085 | 3.875 | 1.132 | 13.267 | 0.031 | . |
| hCV1452085 | 3.687 | 1.075 | 12.65 | 0.038 | 0.01831 |
| hCV1452085 | 2.892 | 0.881 | 9.491 | 0.0798 | 0.03384 |
| hCV1452085 | 12.05 | 0.995 | 145.92 | 0.0505 | 0.02942 |
| hCV302629 | 1.268 | 0.982 | 1.638 | 0.0684 | 0.16605 |
| hCV11474611 | 1.408 | 0.962 | 2.061 | 0.0785 | 0.15447 |
| hCV11474611 | 7.206 | 0.691 | 75.167 | 0.0988 | 0.25264 |
| hCV11474611 | 7.176 | 0.688 | 74.834 | 0.0995 | . |
| hCV1262973 | 1.33 | 0.99 | 1.789 | 0.0586 | 0.03312 |
| hCV27892569 | 1.569 | 1.022 | 2.409 | 0.0394 | 0.11153 |
| hCV27892569 | 1.514 | 0.996 | 2.303 | 0.0525 | . |
| hCV27892569 | 1.184 | 0.993 | 1.412 | 0.06 | . |
| hCV27892569 | 1.139 | 0.982 | 1.32 | 0.0847 | . |
| hCV27077072 | 1.253 | 0.99 | 1.587 | 0.0605 | . |
| hCV27077072 | 1.308 | 0.967 | 1.77 | 0.0816 | . |
| hCV27077072 | 1.952 | 0.901 | 4.23 | 0.0899 | 0.22584 |
| hCV32160712 | 1.93 | 1.061 | 3.512 | 0.0313 | 0.0843 |
| hCV32160712 | 1.872 | 1.034 | 3.391 | 0.0385 | . |
| hCV32160712 | 1.213 | 0.988 | 1.489 | 0.0648 | . |
| hCV32160712 | 2.382 | 1.026 | 5.532 | 0.0435 | . |
| hCV32160712 | 2.361 | 1.011 | 5.513 | 0.047 | 0.12823 |
| hCV32160712 | 1.563 | 0.953 | 2.565 | 0.0772 | 0.1756 |
| hCV32160712 | 1.529 | 0.935 | 2.502 | 0.0907 | . |
| hCV1619596 | 1.412 | 1.038 | 1.92 | 0.0281 | 0.08963 |
| hCV1619596 | 1.362 | 1.017 | 1.823 | 0.0382 | . |
| hCV1619596 | 1.168 | 0.982 | 1.389 | 0.0794 | . |
| hCV1619596 | 1.314 | 1.03 | 1.677 | 0.0281 | . |
| hCV1619596 | 1.33 | 1.029 | 1.719 | 0.0292 | 0.08594 |
| hCV1619596 | 1.205 | 0.993 | 1.461 | 0.0586 | . |
| hCV1619596 | 1.295 | 0.979 | 1.713 | 0.0699 | . |
| hCV1619596 | 1.298 | 0.967 | 1.741 | 0.0822 | 0.1932 |
| hCV1619596 | 1.271 | 1.001 | 1.612 | 0.0486 | 0.14298 |
| hCV1619596 | 1.239 | 0.989 | 1.554 | 0.0629 | . |
| hCV1619596 | 1.125 | 0.985 | 1.284 | 0.0826 | . |
| hCV2358247 | 1.521 | 0.989 | 2.34 | 0.0561 | . |
| hCV2358247 | 1.527 | 0.987 | 2.363 | 0.0574 | 0.16029 |
| hCV2358247 | 1.468 | 0.978 | 2.204 | 0.0636 | . |
| hCV29537898 | 1.303 | 1.011 | 1.679 | 0.0406 | 0.06312 |
| hCV29537898 | 1.258 | 0.98 | 1.614 | 0.0712 | . |
| hCV29537898 | 1.866 | 1.288 | 2.703 | 0.001 | . |
| hCV29537898 | 1.749 | 1.25 | 2.448 | 0.0011 | . |
| hCV29537898 | 1.848 | 1.264 | 2.701 | 0.0015 | 0.00417 |
| hCV1723718 | 1.543 | 0.928 | 2.565 | 0.0944 | . |
| hCV1723718 | 1.773 | 1.119 | 2.809 | 0.0147 | . |
| hCV1723718 | 1.632 | 1.011 | 2.633 | 0.045 | 0.02572 |

TABLE 21

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV11548152 | rs11580249 | | EO_STK | AGE MALE DIAB HTN | GEN | TG | 1.231 | 0.899 | 1.686 | 0.1947 | 0.43131 |
| hCV1958451 | rs2985822 | MIER1 | EO_STK | | DOM | GT or GG | 1.409 | 0.879 | 2.258 | 0.1545 | — |
| hCV1958451 | rs2985822 | MIER1 | ISCHEMIC_STK | | GEN | GT | 1.279 | 0.909 | 1.8 | 0.1576 | 0.08689 |
| hCV1958451 | rs2985822 | MIER1 | LACUNAR_STK | | DOM | GT or GG | 1.638 | 0.857 | 3.131 | 0.1351 | — |
| hCV1958451 | rs2985822 | MIER1 | LACUNAR_STK | AGE MALE DIAB HTN | GEN | GT | 1.734 | 0.753 | 3.995 | 0.196 | 0.39776 |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVALUE_2DF |
|---|---|---|---|---|---|---|---|---|---|---|---|
| hCV1958451 | rs2985822 | MIER1 | NOHD_STK | | GEN | GT | 1.284 | 0.887 | 1.859 | 0.1849 | 0.03579 |
| hCV1958451 | rs2985822 | MIER1 | NONCE_STK | | GEN | GT | 1.361 | 0.915 | 2.024 | 0.1281 | 0.13834 |
| hCV27494483 | rs3748743 | SLC22A15 | CE_STK | AGE MALE DIAB HTN | GEN | TC | 1.433 | 0.867 | 2.366 | 0.1602 | 0.27105 |
| hCV27504565 | rs3219489 | MUTYH | ISCHEMIC_STK | | DOM | CG or CC | 1.305 | 0.896 | 1.901 | 0.1656 | — |
| hCV27504565 | rs3219489 | MUTYH | NOHD_STK | | GEN | CC | 1.339 | 0.872 | 2.055 | 0.1821 | 0.11469 |
| hCV27504565 | rs3219489 | MUTYH | NOHD_STK | | DOM | CG or CC | 1.407 | 0.922 | 2.146 | 0.1129 | — |
| hCV27504565 | rs3219489 | MUTYH | NOHD_STK | AGE MALE DIAB HTN | GEN | CC | 1.519 | 0.859 | 2.683 | 0.1503 | 0.18169 |
| hCV27504565 | rs3219489 | MUTYH | NOHD_STK | AGE MALE DIAB HTN | DOM | CG or CC | 1.587 | 0.906 | 2.782 | 0.1066 | — |
| hCV27504565 | rs3219489 | MUTYH | NONCE_STK | | DOM | CG or CC | 1.351 | 0.871 | 2.095 | 0.1786 | — |
| hCV27504565 | rs3219489 | MUTYH | NONCE_STK | AGE MALE DIAB HTN | DOM | CG or CC | 1.593 | 0.877 | 2.895 | 0.1265 | — |
| hCV27504565 | rs3219489 | MUTYH | RECURRENT_STK | AGE MALE DIAB HTN | GEN | CC | 2.313 | 0.826 | 6.477 | 0.1106 | 0.15677 |
| hCV31227848 | rs11809423 | HIVEP3 | ATHERO_STK | | GEN | TC | 1.404 | 0.927 | 2.128 | 0.1094 | 0.06604 |
| hCV31227848 | rs11809423 | HIVEP3 | NOHD_STK | | GEN | TC | 1.284 | 0.889 | 1.853 | 0.1822 | 0.0563 |
| hCV31227848 | rs11809423 | HIVEP3 | NONCE_STK | | GEN | TC | 1.327 | 0.908 | 1.939 | 0.1434 | 0.12332 |
| hCV454333 | rs10916581 | NVL | RECURRENT_STK | | GEN | CT | 5.03 | 0.664 | 38.1 | 0.1179 | 0.09083 |
| hCV454333 | rs10916581 | NVL | RECURRENT_STK | | GEN | CC | 3.778 | 0.504 | 28.32 | 0.1959 | 0.09083 |
| hCV454333 | rs10916581 | NVL | RECURRENT_STK | | DOM | CT or CC | 4.101 | 0.548 | 30.66 | 0.1692 | — |
| hCV8754449 | rs781226 | TESK2 | NOHD_STK | | GEN | CT | 1.375 | 0.894 | 2.114 | 0.1474 | 0.25013 |
| hCV8754449 | rs781226 | TESK2 | NOHD_STK | AGE MALE DIAB HTN | GEN | CT | 1.508 | 0.856 | 2.656 | 0.1552 | 0.34108 |
| hCV8754449 | rs781226 | TESK2 | NONCE_STK | AGE MALE DIAB HTN | GEN | CT | 1.536 | 0.841 | 2.803 | 0.1625 | 0.25117 |
| hCV8754449 | rs781226 | TESK2 | RECURRENT_STK | AGE MALE DIAB HTN | GEN | CC | 2.321 | 0.83 | 6.495 | 0.1087 | 0.20413 |
| hCV2091644 | rs1010 | VAMP8 | CE_STK | | GEN | CC | 1.287 | 0.933 | 1.776 | 0.1236 | 0.25285 |
| hCV2091644 | rs1010 | VAMP8 | CE_STK | | ADD | C | 1.114 | 0.952 | 1.305 | 0.1788 | — |
| hCV2091644 | rs1010 | VAMP8 | EO_STK | AGE MALE DIAB HTN | GEN | CT | 1.238 | 0.912 | 1.682 | 0.1714 | 0.34826 |
| hCV2091644 | rs1010 | VAMP8 | ISCHEMIC_STK | | GEN | CC | 1.189 | 0.927 | 1.524 | 0.1731 | 0.28614 |
| hCV2091644 | rs1010 | VAMP8 | ISCHEMIC_STK | | REC | CC | 1.198 | 0.957 | 1.499 | 0.115 | — |
| hCV2091644 | rs1010 | VAMP8 | RECURRENT_STK | AGE MALE DIAB HTN | GEN | CT | 1.385 | 0.865 | 2.216 | 0.1753 | 0.3581 |
| hCV7425232 | rs3900940 | MYH15 | EO_STK | AGE MALE DIAB HTN | DOM | CT or CC | 1.208 | 0.913 | 1.596 | 0.1853 | — |
| hCV8820007 | rs938390 | | ATHERO_STK | | GEN | TT | 1.428 | 0.865 | 2.359 | 0.1639 | 0.18574 |
| hCV8820007 | rs938390 | | ATHERO_STK | | DOM | TA or TT | 1.486 | 0.906 | 2.437 | 0.1171 | — |
| hCV8820007 | rs938390 | | ATHERO_STK | AGE MALE DIAB HTN | GEN | TA | 1.603 | 0.846 | 3.038 | 0.1475 | 0.28036 |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVALUE_2DF |
|---|---|---|---|---|---|---|---|---|---|---|---|
| hCV8820007 | rs938390 | | CE_STK | | GEN | TA | 1.389 | 0.846 | 2.282 | 0.194 | 0.14033 |
| hCV8820007 | rs938390 | | EO_STK | | GEN | TA | 1.523 | 0.889 | 2.609 | 0.1254 | 0.30388 |
| hCV8820007 | rs938390 | | EO_STK | | DOM | TA or TT | 1.432 | 0.862 | 2.379 | 0.1661 | — |
| hCV8820007 | rs938390 | | EO_STK | AGE MALE DIAB HTN | GEN | TA | 1.659 | 0.904 | 3.046 | 0.1025 | 0.25362 |
| hCV8820007 | rs938390 | | EO_STK | AGE MALE DIAB HTN | GEN | TT | 1.463 | 0.818 | 2.616 | 0.1998 | 0.25362 |
| hCV8820007 | rs938390 | | EO_STK | AGE MALE DIAB HTN | DOM | TA or TT | 1.525 | 0.861 | 2.704 | 0.1482 | — |
| hCV8820007 | rs938390 | | ISCHEMIC_STK | AGE MALE DIAB HTN | DOM | TA or TT | 1.382 | 0.871 | 2.194 | 0.1698 | — |
| hCV8820007 | rs938390 | | NOHD_STK | AGE MALE DIAB HTN | GEN | TT | 1.434 | 0.856 | 2.403 | 0.1711 | 0.07825 |
| hCV8820007 | rs938390 | | NONCE_STK | | GEN | TA | 1.386 | 0.897 | 2.142 | 0.1412 | 0.28065 |
| hCV8820007 | rs938390 | | NONCE_STK | AGE MALE DIAB HTN | GEN | TA | 1.555 | 0.891 | 2.713 | 0.1203 | 0.27256 |
| hCV8820007 | rs938390 | | NONCE_STK | AGE MALE DIAB HTN | DOM | TA or TT | 1.431 | 0.845 | 2.423 | 0.1829 | — |
| hCV8820007 | rs938390 | | RECURRENT_STK | | GEN | TA | 1.702 | 0.812 | 3.567 | 0.1592 | 0.19862 |
| hCV11354788 | rs12644625 | LOC729065 | CE_STK | AGE MALE DIAB HTN | REC | TT | 2.249 | 0.823 | 6.145 | 0.1141 | — |
| hCV11354788 | rs12644625 | LOC729065 | EO_STK | AGE MALE DIAB HTN | GEN | TT | 2.129 | 0.727 | 6.236 | 0.1683 | 0.0564 |
| hCV11354788 | rs12644625 | LOC729065 | ISCHEMIC_STK | AGE MALE DIAB HTN | GEN | TT | 1.8 | 0.759 | 4.269 | 0.1821 | 0.03661 |
| hCV11354788 | rs12644625 | LOC729065 | NOHD_STK | | GEN | TT | 1.651 | 0.849 | 3.213 | 0.1397 | 0.02034 |
| hCV11354788 | rs12644625 | LOC729065 | NOHD_STK | | REC | TT | 1.552 | 0.799 | 3.015 | 0.1942 | — |
| hCV11354788 | rs12644625 | LOC729065 | NOHD_STK | AGE MALE DIAB HTN | GEN | TT | 1.985 | 0.81 | 4.86 | 0.1337 | 0.06231 |
| hCV11354788 | rs12644625 | LOC729065 | NOHD_STK | AGE MALE DIAB HTN | REC | TT | 1.86 | 0.761 | 4.543 | 0.1733 | — |
| hCV11354788 | rs12644625 | LOC729065 | NONCE_STK | | ADD | T | 1.186 | 0.967 | 1.454 | 0.1013 | — |
| hCV11354788 | rs12644625 | LOC729065 | NONCE_STK | AGE MALE DIAB HTN | GEN | TC | 1.288 | 0.941 | 1.763 | 0.1139 | 0.25236 |
| hCV11354788 | rs12644625 | LOC729065 | NONCE_STK | AGE MALE DIAB HTN | ADD | T | 1.261 | 0.955 | 1.666 | 0.102 | — |
| hCV15854171 | rs2231137 | ABCG2 | CE_STK | | ADD | C | 1.357 | 0.865 | 2.129 | 0.184 | — |
| hCV16158671 | rs2200733 | | ATHERO_STK | AGE MALE DIAB HTN | GEN | TT | 2.133 | 0.724 | 6.287 | 0.1696 | 0.07966 |
| hCV16158671 | rs2200733 | | CE_STK | AGE MALE DIAB HTN | REC | TT | 2.054 | 0.774 | 5.452 | 0.1483 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV16158671 | rs2200733 | | EO_STK | AGE MALE DIAB HTN | GEN | TT | 1.982 | 0.7 | 5.614 | 0.1976 | 0.07117 |
| hCV16158671 | rs2200733 | | ISCHEMIC_STK | | GEN | TT | 1.506 | 0.815 | 2.783 | 0.1916 | 0.00631 |
| hCV16158671 | rs2200733 | | ISCHEMIC_STK | AGE MALE DIAB HTN | GEN | TT | 1.874 | 0.819 | 4.292 | 0.1372 | 0.03074 |
| hCV16158671 | rs2200733 | | ISCHEMIC_STK | AGE MALE DIAB HTN | REC | TT | 1.743 | 0.763 | 3.982 | 0.1873 | — |
| hCV16158671 | rs2200733 | | NOHD_STK | | GEN | TT | 1.705 | 0.898 | 3.238 | 0.1031 | 0.01299 |
| hCV16158671 | rs2200733 | | NOHD_STK | | REC | TT | 1.599 | 0.844 | 3.032 | 0.1501 | — |
| hCV16158671 | rs2200733 | | NOHD_STK | AGE MALE DIAB HTN | REC | TT | 1.973 | 0.839 | 4.643 | 0.1195 | — |
| hCV16158671 | rs2200733 | | NONCE_STK | AGE MALE DIAB HTN | GEN | TC | 1.275 | 0.93 | 1.747 | 0.1316 | 0.22725 |
| hCV16336 | rs362277 | HD | ATHERO_STK | AGE MALE DIAB HTN | ADD | C | 1.321 | 0.946 | 1.844 | 0.102 | — |
| hCV16336 | rs362277 | HD | CE_STK | | DOM | CT or CC | 3.411 | 0.777 | 14.97 | 0.104 | — |
| hCV16336 | rs362277 | HD | ISCHEMIC_STK | | GEN | CC | 1.847 | 0.825 | 4.133 | 0.1354 | 0.00758 |
| hCV16336 | rs362277 | HD | ISCHEMIC_STK | | DOM | CT or CC | 1.751 | 0.783 | 3.914 | 0.1725 | — |
| hCV16336 | rs362277 | HD | LACUNAR_STK | AGE MALE DIAB HTN | ADD | C | 1.368 | 0.892 | 2.097 | 0.1507 | — |
| hCV16336 | rs362277 | HD | LACUNAR_STK | AGE MALE DIAB HTN | REC | CC | 1.389 | 0.873 | 2.211 | 0.1656 | — |
| hCV31137507 | rs7660668 | CLOCK | LACUNAR_STK | | GEN | CG | 1.274 | 0.945 | 1.716 | 0.112 | 0.22027 |
| hCV31137507 | rs7660668 | CLOCK | LACUNAR_STK | | DOM | CG or CC | 1.21 | 0.909 | 1.612 | 0.1921 | — |
| hCV26478797 | rs2015018 | CHSY-2 | CE_STK | | ADD | G | 1.134 | 0.951 | 1.352 | 0.1602 | — |
| hCV26478797 | rs2015018 | CHSY-2 | CE_STK | AGE MALE DIAB HTN | REC | GG | 1.233 | 0.921 | 1.649 | 0.1593 | — |
| hCV26478797 | rs2015018 | CHSY-2 | NOHD_STK | | REC | GG | 1.132 | 0.944 | 1.358 | 0.1816 | — |
| hCV26478797 | rs2015018 | CHSY-2 | RECURRENT_STK | | GEN | GA | 1.613 | 0.804 | 3.238 | 0.1787 | 0.30867 |
| hCV26478797 | rs2015018 | CHSY-2 | RECURRENT_STK | | GEN | GG | 1.712 | 0.86 | 3.407 | 0.1255 | 0.30867 |
| hCV26478797 | rs2015018 | CHSY-2 | RECURRENT_STK | | DOM | GA or GG | 1.668 | 0.85 | 3.272 | 0.137 | — |
| hCV11425801 | rs3805953 | PEX6 | ATHERO_STK | AGE MALE DIAB HTN | GEN | CC | 1.372 | 0.929 | 2.025 | 0.1116 | 0.0005 |
| hCV11425801 | rs3805953 | PEX6 | CE_STK | AGE MALE DIAB HTN | GEN | CT | 1.287 | 0.913 | 1.812 | 0.1493 | 0.35182 |
| hCV11425801 | rs3805953 | PEX6 | EO_STK | | GEN | CC | 1.254 | 0.903 | 1.739 | 0.1764 | 0.00345 |
| hCV11425801 | rs3805953 | PEX6 | EO_STK | | ADD | C | 1.133 | 0.961 | 1.335 | 0.1372 | |
| hCV11425801 | rs3805953 | PEX6 | ISCHEMIC_STK | | GEN | CC | 1.202 | 0.958 | 1.508 | 0.1123 | 0.02335 |
| hCV11425801 | rs3805953 | PEX6 | ISCHEMIC_STK | AGE MALE DIAB HTN | ADD | C | 1.116 | 0.959 | 1.3 | 0.1556 | — |
| hCV11425801 | rs3805953 | PEX6 | LACUNAR_STK | | DOM | CT or CC | 1.235 | 0.897 | 1.7 | 0.1959 | — |
| hCV11425801 | rs3805953 | PEX6 | NOHD_STK | AGE MALE DIAB HTN | GEN | CC | 1.236 | 0.896 | 1.706 | 0.1968 | 0.00304 |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV11425801 | rs3805953 | PEX6 | NOHD_STK | AGE MALE DIAB HTN | ADD | C | 1.124 | 0.958 | 1.32 | 0.1525 | — |
| hCV11425801 | rs3805953 | PEX6 | NONCE_STK | AGE MALE DIAB HTN | GEN | CC | 1.276 | 0.898 | 1.813 | 0.1732 | 0.00005 |
| hCV11425801 | rs3805953 | PEX6 | NONCE_STK | AGE MALE DIAB HTN | ADD | C | 1.147 | 0.963 | 1.365 | 0.1237 | — |
| hCV11425801 | rs3805953 | PEX6 | RECURRENT_STK |  | DOM | CT or CC | 1.28 | 0.912 | 1.798 | 0.1535 | — |
| hCV11425801 | rs3805953 | PEX6 | RECURRENT_STK | AGE MALE DIAB HTN | DOM | CT or CC | 1.403 | 0.885 | 2.225 | 0.1498 | — |
| hCV11425842 | rs10948059 | GNMT | ATHERO_STK |  | GEN | CC | 1.263 | 0.927 | 1.722 | 0.1392 | 0.19224 |
| hCV11425842 | rs10948059 | GNMT | ATHERO_STK |  | ADD | C | 1.109 | 0.953 | 1.29 | 0.1815 | — |
| hCV11425842 | rs10948059 | GNMT | ATHERO_STK | AGE MALE DIAB HTN | ADD | C | 1.178 | 0.964 | 1.439 | 0.1101 | — |
| hCV11425842 | rs10948059 | GNMT | CE_STK | AGE MALE DIAB HTN | DOM | CT or CC | 1.272 | 0.898 | 1.8 | 0.1751 | — |
| hCV11425842 | rs10948059 | GNMT | EO_STK |  | ADD | C | 1.141 | 0.964 | 1.352 | 0.126 | — |
| hCV11425842 | rs10948059 | GNMT | EO_STK | AGE MALE DIAB HTN | GEN | CC | 1.302 | 0.883 | 1.92 | 0.1827 | 0.08575 |
| hCV11425842 | rs10948059 | GNMT | ISCHEMIC_STK | AGE MALE DIAB HTN | GEN | CC | 1.27 | 0.925 | 1.743 | 0.1389 | 0.1427 |
| hCV11425842 | rs10948059 | GNMT | ISCHEMIC_STK | AGE MALE DIAB HTN | ADD | C | 1.113 | 0.951 | 1.303 | 0.1836 | — |
| hCV11425842 | rs10948059 | GNMT | NOHD_STK | AGE MALE DIAB HTN | GEN | CT | 1.279 | 0.938 | 1.745 | 0.1197 | 0.26094 |
| hCV11425842 | rs10948059 | GNMT | NOHD_STK | AGE MALE DIAB HTN | GEN | CC | 1.266 | 0.905 | 1.772 | 0.1686 | 0.26094 |
| hCV11425842 | rs10948059 | GNMT | NOHD_STK | AGE MALE DIAB HTN | DOM | CT or CC | 1.274 | 0.953 | 1.703 | 0.1015 | — |
| hCV11425842 | rs10948059 | GNMT | NONCE_STK |  | GEN | CT | 1.195 | 0.932 | 1.531 | 0.1595 | 0.35697 |
| hCV11425842 | rs10948059 | GNMT | NONCE_STK |  | DOM | CT or CC | 1.184 | 0.938 | 1.495 | 0.1556 | — |
| hCV11425842 | rs10948059 | GNMT | NONCE_STK | AGE MALE DIAB HTN | GEN | CC | 1.294 | 0.9 | 1.861 | 0.1646 | 0.10566 |
| hCV16134786 | rs2857595 |  | EO_STK |  | GEN | AG | 1.207 | 0.929 | 1.568 | 0.1593 | 0.0477 |
| hCV16134786 | rs2857595 |  | EO_STK | AGE MALE DIAB HTN | ADD | A | 1.185 | 0.934 | 1.504 | 0.1629 | — |
| hCV16134786 | rs2857595 |  | ISCHEMIC_STK |  | GEN | AA | 1.406 | 0.933 | 2.119 | 0.103 | 0.26366 |
| hCV16134786 | rs2857595 |  | ISCHEMIC_STK |  | REC | AA | 1.392 | 0.928 | 2.088 | 0.1098 | — |
| hCV16134786 | rs2857595 |  | ISCHEMIC_STK | AGE MALE DIAB HTN | ADD | A | 1.154 | 0.949 | 1.402 | 0.1516 | — |
| hCV16134786 | rs2857595 |  | LACUNAR_STK | AGE MALE DIAB HTN | GEN | AA | 1.77 | 0.809 | 3.873 | 0.153 | 0.27205 |

TABLE 21-continued

| hCV # | rs # | Gene | OUTCOME | AD-JUST | MODE | GENO-TYPE | Odds Ratio | 95% Lower CL | 95% Upper CL | ProbChi Sq (2-sided p-value) | PVAL-UE_2DF |
|---|---|---|---|---|---|---|---|---|---|---|---|
| hCV16134786 | rs2857595 | | LACUNAR_STK | AGE MALE DIAB HTN | ADD | A | 1.272 | 0.943 | 1.717 | 0.1157 | — |
| hCV16134786 | rs2857595 | | LACUNAR_STK | AGE MALE DIAB HTN | DOM | AG or AA | 1.287 | 0.889 | 1.863 | 0.182 | — |
| hCV16134786 | rs2857595 | | NONCE_STK | | DOM | AG or AA | 1.151 | 0.947 | 1.399 | 0.1584 | — |
| hCV16134786 | rs2857595 | | NONCE_STK | | REC | AA | 1.448 | 0.924 | 2.268 | 0.1062 | — |
| hCV25651109 | rs35690712 | SLC39A7 | EO_STK | | GEN | GC | 5.189 | 0.556 | 48.4 | 0.1484 | 0.34485 |
| hCV25651109 | rs35690712 | SLC39A7 | EO_STK | | GEN | GG | 4.668 | 0.52 | 41.92 | 0.1689 | 0.34485 |
| hCV25651109 | rs35690712 | SLC39A7 | EO_STK | | DOM | GC or GG | 4.709 | 0.525 | 42.28 | 0.1664 | — |
| hCV25651109 | rs35690712 | SLC39A7 | ISCHEMIC_STK | AGE MALE DIAB HTN | GEN | GC | 4.69 | 0.505 | 43.57 | 0.1742 | 0.39506 |
| hCV25651109 | rs35690712 | SLC39A7 | ISCHEMIC_STK | AGE MALE DIAB HTN | GEN | GG | 4.372 | 0.486 | 39.35 | 0.1882 | 0.39506 |
| hCV25651109 | rs35690712 | SLC39A7 | ISCHEMIC_STK | AGE MALE DIAB HTN | DOM | GC or GG | 4.398 | 0.489 | 39.56 | 0.1864 | — |
| hCV25651109 | rs35690712 | SLC39A7 | NONCE_STK | | GEN | GC | 4.525 | 0.542 | 37.77 | 0.1632 | 0.26183 |
| hCV25651109 | rs35690712 | SLC39A7 | NONCE_STK | | GEN | GG | 5.073 | 0.623 | 41.3 | 0.129 | 0.26183 |
| hCV25651109 | rs35690712 | SLC39A7 | NONCE_STK | | ADD | G | 1.239 | 0.895 | 1.713 | 0.1962 | — |
| hCV25651109 | rs35690712 | SLC39A7 | NONCE_STK | | DOM | GC or GG | 5.026 | 0.618 | 40.91 | 0.1312 | — |
| hCV30308202 | rs9482985 | LAMA2 | CE_STK | | ADD | G | 1.168 | 0.958 | 1.423 | 0.1237 | — |
| hCV30308202 | rs9482985 | LAMA2 | CE_STK | | REC | GG | 1.179 | 0.936 | 1.484 | 0.1621 | — |
| hCV30308202 | rs9482985 | LAMA2 | CE_STK | AGE MALE DIAB HTN | GEN | GC | 1.724 | 0.779 | 3.815 | 0.1792 | 0.26508 |
| hCV30308202 | rs9482985 | LAMA2 | CE_STK | AGE MALE DIAB HTN | GEN | GG | 1.878 | 0.867 | 4.07 | 0.1103 | 0.26508 |
| hCV30308202 | rs9482985 | LAMA2 | CE_STK | AGE MALE DIAB HTN | ADD | G | 1.19 | 0.92 | 1.54 | 0.1851 | — |
| hCV30308202 | rs9482985 | LAMA2 | CE_STK | AGE MALE DIAB HTN | DOM | GC or GG | 1.825 | 0.848 | 3.929 | 0.124 | — |
| hCV30308202 | rs9482985 | LAMA2 | RECURRENT_STK | | DOM | GC or GG | 2.236 | 0.795 | 6.289 | 0.1272 | — |
| hCV30308202 | rs9482985 | LAMA2 | RECURRENT_STK | AGE MALE DIAB HTN | ADD | G | 1.379 | 0.94 | 2.022 | 0.1002 | — |
| hCV3082219 | rs1884833 | RFXDC1 | EO_STK | | GEN | AG | 1.217 | 0.909 | 1.628 | 0.1874 | 0.16147 |
| hCV3082219 | rs1884833 | RFXDC1 | EO_STK | | GEN | AA | 2.194 | 0.766 | 6.286 | 0.1434 | 0.16147 |
| hCV3082219 | rs1884833 | RFXDC1 | EO_STK | | DOM | AG or AA | 1.262 | 0.949 | 1.677 | 0.1091 | — |
| hCV3082219 | rs1884833 | RFXDC1 | EO_STK | | REC | AA | 2.096 | 0.733 | 5.993 | 0.1672 | — |
| hCV3082219 | rs1884833 | RFXDC1 | LACUNAR_STK | | GEN | AA | 2.024 | 0.703 | 5.824 | 0.1911 | 0.07365 |
| hCV3082219 | rs1884833 | RFXDC1 | LACUNAR_STK | AGE MALE DIAB HTN | GEN | AA | 2.876 | 0.735 | 11.26 | 0.1292 | 0.25425 |
| hCV3082219 | rs1884833 | RFXDC1 | LACUNAR_STK | AGE MALE DIAB HTN | ADD | A | 1.288 | 0.89 | 1.865 | 0.18 | — |
| hCV3082219 | rs1884833 | RFXDC1 | LACUNAR_STK | AGE MALE DIAB HTN | REC | AA | 2.755 | 0.706 | 10.75 | 0.1444 | — |
| hCV3082219 | rs1884833 | RFXDC1 | NOHD_STK | | GEN | AA | 1.762 | 0.835 | 3.717 | 0.137 | 0.20951 |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV3082219 | rs1884833 | RFXDC1 | NOHD_STK | | ADD | A | 1.171 | 0.965 | 1.421 | 0.11 | — |
| hCV3082219 | rs1884833 | RFXDC1 | NOHD_STK | | DOM | AG or AA | 1.158 | 0.935 | 1.432 | 0.1783 | — |
| hCV3082219 | rs1884833 | RFXDC1 | NOHD_STK | | REC | AA | 1.715 | 0.814 | 3.612 | 0.1557 | — |
| hCV3082219 | rs1884833 | RFXDC1 | NOHD_STK | AGE MALE DIAB HTN | GEN | AA | 1.98 | 0.711 | 5.513 | 0.1912 | 0.41847 |
| hCV3082219 | rs1884833 | RFXDC1 | NOHD_STK | AGE MALE DIAB HTN | REC | AA | 1.961 | 0.706 | 5.45 | 0.1964 | — |
| hCV8942032 | rs1264352 | DDR1 | ATHERO_STK | AGE MALE DIAB HTN | GEN | CG | 1.315 | 0.937 | 1.846 | 0.1128 | 0.23534 |
| hCV8942032 | rs1264352 | DDR1 | ATHERO_STK | AGE MALE DIAB HTN | DOM | CG or CC | 1.257 | 0.906 | 1.744 | 0.1707 | — |
| hCV8942032 | rs1264352 | DDR1 | CE_STK | AGE MALE DIAB HTN | GEN | CG | 1.299 | 0.916 | 1.842 | 0.1424 | 0.29178 |
| hCV8942032 | rs1264352 | DDR1 | CE_STK | AGE MALE DIAB HTN | ADD | C | 1.251 | 0.938 | 1.669 | 0.1269 | — |
| hCV8942032 | rs1264352 | DDR1 | CE_STK | AGE MALE DIAB HTN | DOM | CG or CC | 1.307 | 0.935 | 1.826 | 0.1175 | — |
| hCV8942032 | rs1264352 | DDR1 | ISCHEMIC_STK | | ADD | C | 1.119 | 0.948 | 1.321 | 0.1832 | — |
| hCV8942032 | rs1264352 | DDR1 | LACUNAR_STK | AGE MALE DIAB HTN | GEN | CC | 2.104 | 0.743 | 5.961 | 0.1614 | 0.01502 |
| hCV8942032 | rs1264352 | DDR1 | NOHD_STK | | DOM | CG or CC | 1.16 | 0.942 | 1.43 | 0.163 | — |
| hCV8942032 | rs1264352 | DDR1 | NOHD_STK | AGE MALE DIAB HTN | ADD | C | 1.211 | 0.951 | 1.541 | 0.1206 | — |
| hCV8942032 | rs1264352 | DDR1 | NONCE_STK | | ADD | C | 1.142 | 0.948 | 1.375 | 0.1628 | — |
| hCV25596936 | rs6967117 | EPHA1 | ATHERO_STK | | ADD | T | 1.215 | 0.95 | 1.552 | 0.1207 | — |
| hCV25596936 | rs6967117 | EPHA1 | ISCHEMIC_STK | | DOM | TC or TT | 1.181 | 0.941 | 1.482 | 0.1522 | — |
| hCV25596936 | rs6967117 | EPHA1 | LACUNAR_STK | | DOM | TC or TT | 1.352 | 0.937 | 1.951 | 0.1065 | — |
| hCV25596936 | rs6967117 | EPHA1 | NOHD_STK | | DOM | TC or TT | 1.226 | 0.961 | 1.566 | 0.1014 | — |
| hCV29401764 | rs7793552 | LOC646588 | ATHERO_STK | AGE MALE DIAB HTN | DOM | CT or CC | 1.501 | 0.896 | 2.513 | 0.123 | — |
| hCV15857769 | rs2924914 | | ATHERO_STK | AGE MALE DIAB HTN | ADD | T | 1.193 | 0.963 | 1.479 | 0.1061 | — |
| hCV15857769 | rs2924914 | | ATHERO_STK | AGE MALE DIAB HTN | REC | TT | 1.456 | 0.92 | 2.305 | 0.1089 | — |
| hCV15857769 | rs2924914 | | NOHD_STK | | ADD | T | 1.12 | 0.975 | 1.287 | 0.1103 | — |
| hCV15857769 | rs2924914 | | RECURRENT_STK | AGE MALE DIAB HTN | ADD | T | 1.255 | 0.909 | 1.731 | 0.167 | — |
| hCV29539757 | rs10110659 | KCNQ3 | ATHERO_STK | | GEN | CA | 1.362 | 0.902 | 2.058 | 0.1417 | 0.31708 |
| hCV29539757 | rs10110659 | KCNQ3 | ATHERO_STK | | DOM | CA or CC | 1.297 | 0.875 | 1.925 | 0.1957 | — |
| hCV29539757 | rs10110659 | KCNQ3 | LACUNAR_STK | | GEN | CA | 1.453 | 0.843 | 2.504 | 0.1789 | 0.08401 |
| hCV29539757 | rs10110659 | KCNQ3 | NONCE_STK | | DOM | CA or CC | 1.283 | 0.909 | 1.81 | 0.1572 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV1348610 | rs3739636 | C9orf46 | ATHERO_STK | AGE MALE DIAB HTN | GEN | AG | 1.304 | 0.945 | 1.799 | 0.1062 | 0.25491 |
| hCV1348610 | rs3739636 | C9orf46 | ATHERO_STK | AGE MALE DIAB HTN | DOM | AG or AA | 1.242 | 0.918 | 1.682 | 0.1605 | — |
| hCV1348610 | rs3739636 | C9orf46 | CE_STK | AGE MALE DIAB HTN | GEN | AG | 1.24 | 0.895 | 1.719 | 0.1962 | 0.39368 |
| hCV1348610 | rs3739636 | C9orf46 | CE_STK | AGE MALE DIAB HTN | DOM | AG or AA | 1.238 | 0.911 | 1.682 | 0.1722 | — |
| hCV1348610 | rs3739636 | C9orf46 | NOHD_STK | AGE MALE DIAB HTN | DOM | AG or AA | 1.217 | 0.944 | 1.569 | 0.1306 | — |
| hCV1348610 | rs3739636 | C9orf46 | NONCE_STK | AGE MALE DIAB HTN | DOM | AG or AA | 1.226 | 0.933 | 1.61 | 0.144 | — |
| hCV1754669 | rs2383206 | C9P21 | ATHERO_STK | AGE MALE DIAB HTN | REC | GG | 1.277 | 0.913 | 1.784 | 0.1528 | — |
| hCV1754669 | rs2383206 | C9P21 | NONCE_STK | AGE MALE DIAB HTN | REC | GG | 1.227 | 0.906 | 1.662 | 0.187 | — |
| hCV26505812 | rs10757274 | C9P21 | ISCHEMIC_STK | AGE MALE DIAB HTN | REC | GG | 1.207 | 0.912 | 1.599 | 0.1887 | — |
| hCV26505812 | rs10757274 | C9P21 | NOHD_STK | AGE MALE DIAB HTN | REC | GG | 1.238 | 0.918 | 1.669 | 0.1611 | — |
| hCV26505812 | rs10757274 | C9P21 | NONCE_STK | AGE MALE DIAB HTN | GEN | GG | 1.297 | 0.893 | 1.884 | 0.1714 | 0.23096 |
| hCV15752716 | rs2296436 | HPS1 | CE_STK | | ADD | T | 1.242 | 0.914 | 1.686 | 0.1656 | — |
| hCV15752716 | rs2296436 | HPS1 | CE_STK | | REC | TT | 1.284 | 0.928 | 1.778 | 0.1311 | — |
| hCV2169762 | rs1804689 | HPS1 | ATHERO_STK | | GEN | TT | 1.293 | 0.914 | 1.829 | 0.1461 | 0.33606 |
| hCV2169762 | rs1804689 | HPS1 | ATHERO_STK | | REC | TT | 1.282 | 0.92 | 1.787 | 0.1422 | — |
| hCV2169762 | rs1804689 | HPS1 | ATHERO_STK | AGE MALE DIAB HTN | GEN | TT | 1.446 | 0.902 | 2.316 | 0.1255 | 0.27749 |
| hCV2169762 | rs1804689 | HPS1 | ATHERO_STK | AGE MALE DIAB HTN | REC | TT | 1.447 | 0.92 | 2.276 | 0.1093 | — |
| hCV2169762 | rs1804689 | HPS1 | EO_STK | AGE MALE DIAB HTN | GEN | TT | 1.49 | 0.926 | 2.397 | 0.1003 | 0.2272 |
| hCV2169762 | rs1804689 | HPS1 | ISCHEMIC_STK | | GEN | TT | 1.22 | 0.921 | 1.617 | 0.1658 | 0.04864 |
| hCV2169762 | rs1804689 | HPS1 | LACUNAR_STK | | GEN | TG | 1.273 | 0.941 | 1.721 | 0.1172 | 0.29125 |
| hCV2169762 | rs1804689 | HPS1 | LACUNAR_STK | | DOM | TG or TT | 1.235 | 0.927 | 1.644 | 0.1491 | — |
| hCV2169762 | rs1804689 | HPS1 | LACUNAR_STK | AGE MALE DIAB HTN | GEN | TG | 1.345 | 0.919 | 1.97 | 0.1275 | 0.23974 |
| hCV2169762 | rs1804689 | HPS1 | LACUNAR_STK | AGE MALE DIAB HTN | ADD | T | 1.246 | 0.953 | 1.63 | 0.1085 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV2169762 | rs1804689 | HPS1 | NOHD_STK | AGE MALE DIAB HTN | REC | TT | 1.351 | 0.914 | 1.999 | 0.1317 | — |
| hCV2169762 | rs1804689 | HPS1 | NONCE_STK |  | GEN | TT | 1.229 | 0.897 | 1.683 | 0.1999 | 0.37015 |
| hCV2169762 | rs1804689 | HPS1 | NONCE_STK |  | ADD | T | 1.106 | 0.961 | 1.272 | 0.1591 | — |
| hCV2169762 | rs1804689 | HPS1 | NONCE_STK | AGE MALE DIAB HTN | DOM | TG or TT | 1.193 | 0.923 | 1.541 | 0.1783 | — |
| hCV27830265 | rs12762303 | ALOX5 | ATHERO_STK |  | DOM | GA or GG | 1.204 | 0.956 | 1.515 | 0.1143 | — |
| hCV27830265 | rs12762303 | ALOX5 | ATHERO_STK | AGE MALE DIAB HTN | GEN | GA | 1.275 | 0.928 | 1.752 | 0.1331 | 0.04449 |
| hCV27830265 | rs12762303 | ALOX5 | CE_STK |  | GEN | GG | 1.591 | 0.788 | 3.212 | 0.1954 | 0.27948 |
| hCV27830265 | rs12762303 | ALOX5 | CE_STK |  | REC | GG | 1.637 | 0.813 | 3.293 | 0.1673 | — |
| hCV27830265 | rs12762303 | ALOX5 | CE_STK | AGE MALE DIAB HTN | REC | GG | 1.967 | 0.73 | 5.302 | 0.1811 | — |
| hCV27830265 | rs12762303 | ALOX5 | EO_STK |  | GEN | GG | 1.724 | 0.758 | 3.92 | 0.1937 | 0.27237 |
| hCV27830265 | rs12762303 | ALOX5 | EO_STK |  | ADD | G | 1.201 | 0.951 | 1.517 | 0.1236 | — |
| hCV27830265 | rs12762303 | ALOX5 | EO_STK |  | DOM | GA or GG | 1.194 | 0.919 | 1.551 | 0.1835 | — |
| hCV27830265 | rs12762303 | ALOX5 | ISCHEMIC_STK | AGE MALE DIAB HTN | DOM | GA or GG | 1.211 | 0.948 | 1.547 | 0.1246 | — |
| hCV27830265 | rs12762303 | ALOX5 | LACUNAR_STK |  | GEN | GA | 1.242 | 0.911 | 1.692 | 0.1704 | 0.30411 |
| hCV27830265 | rs12762303 | ALOX5 | LACUNAR_STK |  | ADD | G | 1.237 | 0.944 | 1.621 | 0.1228 | — |
| hCV27830265 | rs12762303 | ALOX5 | LACUNAR_STK |  | DOM | GA or GG | 1.258 | 0.93 | 1.701 | 0.1365 | — |
| hCV27830265 | rs12762303 | ALOX5 | LACUNAR_STK | AGE MALE DIAB HTN | GEN | GA | 1.371 | 0.924 | 2.032 | 0.1169 | 0.17426 |
| hCV27830265 | rs12762303 | ALOX5 | NOHD_STK |  | ADD | G | 1.146 | 0.963 | 1.364 | 0.1236 | — |
| hCV27830265 | rs12762303 | ALOX5 | NOHD_STK | AGE MALE DIAB HTN | GEN | GA | 1.204 | 0.92 | 1.575 | 0.1757 | 0.16102 |
| hCV27830265 | rs12762303 | ALOX5 | NOHD_STK | AGE MALE DIAB HTN | GEN | GG | 1.82 | 0.823 | 4.024 | 0.1389 | 0.16102 |
| hCV27830265 | rs12762303 | ALOX5 | NOHD_STK | AGE MALE DIAB HTN | DOM | GA or GG | 1.244 | 0.958 | 1.615 | 0.1015 | — |
| hCV27830265 | rs12762303 | ALOX5 | NOHD_STK | AGE MALE DIAB HTN | REC | GG | 1.722 | 0.783 | 3.787 | 0.1768 | — |
| hCV27830265 | rs12762303 | ALOX5 | NONCE_STK |  | GEN | GA | 1.16 | 0.94 | 1.432 | 0.166 | 0.02459 |
| hCV27830265 | rs12762303 | ALOX5 | NONCE_STK | AGE MALE DIAB HTN | REC | GG | 1.999 | 0.864 | 4.627 | 0.1056 | — |
| hCV1053082 | rs544115 | NEU3 | ATHERO_STK |  | GEN | CC | 1.629 | 0.864 | 3.07 | 0.1313 | 0.29853 |
| hCV1053082 | rs544115 | NEU3 | ATHERO_STK |  | ADD | C | 1.139 | 0.935 | 1.387 | 0.1971 | — |
| hCV1053082 | rs544115 | NEU3 | ATHERO_STK |  | DOM | CT or CC | 1.597 | 0.851 | 2.997 | 0.1454 | — |
| hCV1053082 | rs544115 | NEU3 | CE_STK |  | GEN | CC | 1.702 | 0.885 | 3.27 | 0.1107 | 0.13598 |
| hCV1053082 | rs544115 | NEU3 | CE_STK |  | DOM | CT or CC | 1.618 | 0.845 | 3.097 | 0.1466 | — |
| hCV1053082 | rs544115 | NEU3 | CE_STK | AGE MALE DIAB HTN | ADD | C | 1.237 | 0.945 | 1.619 | 0.1224 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV1053082 | rs544115 | NEU3 | EO_STK | | ADD | C | 1.172 | 0.933 | 1.471 | 0.172 | — |
| hCV1053082 | rs544115 | NEU3 | EO_STK | AGE MALE DIAB HTN | DOM | CT or CC | 2.054 | 0.846 | 4.982 | 0.1115 | — |
| hCV1053082 | rs544115 | NEU3 | ISCHEMIC_STK | | REC | CC | 1.125 | 0.942 | 1.344 | 0.1924 | — |
| hCV1053082 | rs544115 | NEU3 | ISCHEMIC_STK | AGE MALE DIAB HTN | ADD | C | 1.164 | 0.943 | 1.436 | 0.1567 | — |
| hCV1053082 | rs544115 | NEU3 | LACUNAR_STK | | GEN | CT | 2.025 | 0.775 | 5.292 | 0.1499 | 0.33773 |
| hCV1053082 | rs544115 | NEU3 | LACUNAR_STK | | DOM | CT or CC | 1.895 | 0.742 | 4.839 | 0.1815 | — |
| hCV1053082 | rs544115 | NEU3 | LACUNAR_STK | AGE MALE DIAB HTN | GEN | CT | 2.148 | 0.723 | 6.38 | 0.1685 | 0.38668 |
| hCV1053082 | rs544115 | NEU3 | LACUNAR_STK | AGE MALE DIAB HTN | DOM | CT or CC | 2.036 | 0.708 | 5.851 | 0.1868 | — |
| hCV1053082 | rs544115 | NEU3 | NOHD_STK | | ADD | C | 1.128 | 0.954 | 1.333 | 0.1577 | — |
| hCV1452085 | rs12223005 | TRIM22 | CE_STK | | GEN | CA | 3.193 | 0.705 | 14.47 | 0.1321 | 0.27397 |
| hCV1452085 | rs12223005 | TRIM22 | CE_STK | | GEN | CC | 2.843 | 0.638 | 12.66 | 0.1703 | 0.27397 |
| hCV1452085 | rs12223005 | TRIM22 | CE_STK | | DOM | CA or CC | 2.902 | 0.652 | 12.91 | 0.1619 | — |
| hCV1452085 | rs12223005 | TRIM22 | CE_STK | AGE MALE DIAB HTN | GEN | CA | 4.133 | 0.74 | 23.07 | 0.1058 | 0.25417 |
| hCV1452085 | rs12223005 | TRIM22 | CE_STK | AGE MALE DIAB HTN | GEN | CC | 3.631 | 0.67 | 19.68 | 0.1347 | 0.25417 |
| hCV1452085 | rs12223005 | TRIM22 | CE_STK | AGE MALE DIAB HTN | DOM | CA or CC | 3.711 | 0.686 | 20.07 | 0.1279 | — |
| hCV1452085 | rs12223005 | TRIM22 | EO_STK | | GEN | CA | 2.362 | 0.762 | 7.322 | 0.1364 | 0.26957 |
| hCV1452085 | rs12223005 | TRIM22 | EO_STK | | DOM | CA or CC | 2.075 | 0.691 | 6.232 | 0.1935 | — |
| hCV1452085 | rs12223005 | TRIM22 | ISCHEMIC_STK | | GEN | CA | 1.97 | 0.824 | 4.714 | 0.1275 | 0.08218 |
| hCV1452085 | rs12223005 | TRIM22 | ISCHEMIC_STK | AGE MALE DIAB HTN | GEN | CC | 2.207 | 0.757 | 6.44 | 0.1472 | 0.07446 |
| hCV1452085 | rs12223005 | TRIM22 | ISCHEMIC_STK | AGE MALE DIAB HTN | DOM | CA or CC | 2.31 | 0.793 | 6.727 | 0.1247 | — |
| hCV1452085 | rs12223005 | TRIM22 | LACUNAR_STK | | GEN | CA | 4.431 | 0.568 | 34.58 | 0.1556 | 0.00441 |
| hCV1452085 | rs12223005 | TRIM22 | LACUNAR_STK | AGE MALE DIAB HTN | DOM | CA or CC | 4.519 | 0.471 | 43.37 | 0.1911 | — |
| hCV1452085 | rs12223005 | TRIM22 | NOHD_STK | | GEN | CA | 2.418 | 0.843 | 6.932 | 0.1004 | 0.16487 |
| hCV1452085 | rs12223005 | TRIM22 | NOHD_STK | | GEN | CC | 2.082 | 0.739 | 5.866 | 0.1655 | 0.16487 |
| hCV1452085 | rs12223005 | TRIM22 | NOHD_STK | | DOM | CA or CC | 2.138 | 0.759 | 6.02 | 0.1502 | — |
| hCV1452085 | rs12223005 | TRIM22 | RECURRENT_STK | AGE MALE DIAB HTN | GEN | CC | 6.513 | 0.564 | 75.15 | 0.1332 | 0.02942 |
| hCV1452085 | rs12223005 | TRIM22 | RECURRENT_STK | AGE MALE DIAB HTN | DOM | CA or CC | 7.075 | 0.618 | 80.97 | 0.1157 | — |
| hCV302629 | rs9284183 | UBAC2 | EO_STK | | DOM | GA or GG | 1.217 | 0.954 | 1.553 | 0.1137 | — |
| hCV302629 | rs9284183 | UBAC2 | EO_STK | AGE MALE DIAB HTN | GEN | GA | 1.219 | 0.91 | 1.633 | 0.1853 | 0.37831 |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV302629 | rs9284183 | UBAC2 | EO_STK | AGE MALE DIAB HTN | ADD | G | 1.156 | 0.927 | 1.442 | 0.1987 | — |
| hCV302629 | rs9284183 | UBAC2 | EO_STK | AGE MALE DIAB HTN | DOM | GA or GG | 1.219 | 0.923 | 1.611 | 0.1632 | — |
| hCV11474611 | rs3814843 | CALM1 | ATHERO_STK | | DOM | GT or GG | 1.345 | 0.925 | 1.956 | 0.1207 | — |
| hCV11474611 | rs3814843 | CALM1 | ISCHEMIC_STK | | GEN | GT | 1.282 | 0.939 | 1.748 | 0.1173 | 0.13174 |
| hCV11474611 | rs3814843 | CALM1 | ISCHEMIC_STK | | DOM | GT or GG | 1.222 | 0.902 | 1.656 | 0.1959 | — |
| hCV11474611 | rs3814843 | CALM1 | NOHD_STK | | GEN | GT | 1.32 | 0.946 | 1.842 | 0.1021 | 0.1136 |
| hCV11474611 | rs3814843 | CALM1 | NOHD_STK | | DOM | GT or GG | 1.251 | 0.902 | 1.735 | 0.1789 | — |
| hCV11474611 | rs3814843 | CALM1 | NONCE_STK | | GEN | GT | 1.328 | 0.939 | 1.877 | 0.1082 | 0.1417 |
| hCV11474611 | rs3814843 | CALM1 | NONCE_STK | | DOM | GT or GG | 1.261 | 0.898 | 1.772 | 0.1806 | — |
| hCV11474611 | rs3814843 | CALM1 | RECURRENT_STK | | GEN | GT | 1.526 | 0.916 | 2.544 | 0.1047 | 0.2681 |
| hCV11474611 | rs3814843 | CALM1 | RECURRENT_STK | | DOM | GT or GG | 1.429 | 0.86 | 2.374 | 0.168 | — |
| hCV1262973 | rs229653 | PLEKHG3 | ISCHEMIC_STK | | GEN | AG | 1.186 | 0.939 | 1.499 | 0.1523 | 0.00405 |
| hCV1262973 | rs229653 | PLEKHG3 | RECURRENT_STK | | GEN | AG | 1.33 | 0.893 | 1.982 | 0.1605 | 0.3735 |
| hCV27892569 | rs4903741 | NRXN3 | CE_STK | | DOM | CT or CC | 1.171 | 0.936 | 1.466 | 0.1674 | — |
| hCV27892569 | rs4903741 | NRXN3 | LACUNAR_STK | | GEN | CT | 1.273 | 0.943 | 1.719 | 0.1153 | 0.28645 |
| hCV27892569 | rs4903741 | NRXN3 | LACUNAR_STK | | DOM | CT or CC | 1.241 | 0.93 | 1.656 | 0.143 | — |
| hCV27892569 | rs4903741 | NRXN3 | NOHD_STK | | GEN | CC | 1.333 | 0.917 | 1.939 | 0.1323 | 0.22016 |
| hCV27892569 | rs4903741 | NRXN3 | NOHD_STK | | DOM | CT or CC | 1.153 | 0.958 | 1.388 | 0.1327 | — |
| hCV27892569 | rs4903741 | NRXN3 | NOHD_STK | | REC | CC | 1.278 | 0.885 | 1.845 | 0.191 | — |
| hCV27077072 | rs8060368 | | RECURRENT_STK | | GEN | CC | 1.564 | 0.889 | 2.75 | 0.1205 | 0.17139 |
| hCV27077072 | rs8060368 | | RECURRENT_STK | AGE MALE DIAB HTN | ADD | C | 1.308 | 0.947 | 1.806 | 0.1032 | — |
| hCV27077072 | rs8060368 | | RECURRENT_STK | AGE MALE DIAB HTN | DOM | CT or CC | 1.798 | 0.854 | 3.786 | 0.1226 | — |
| hCV2769503 | rs4787956 | | CE_STK | | GEN | GA | 1.171 | 0.924 | 1.484 | 0.1909 | 0.3088 |
| hCV2769503 | rs4787956 | | CE_STK | | ADD | G | 1.131 | 0.961 | 1.331 | 0.1373 | — |
| hCV2769503 | rs4787956 | | CE_STK | | DOM | GA or GG | 1.187 | 0.948 | 1.485 | 0.1354 | — |
| hCV2769503 | rs4787956 | | RECURRENT_STK | | GEN | GA | 1.27 | 0.919 | 1.753 | 0.1471 | 0.27579 |
| hCV31573621 | rs11079818 | SKAP1 | ATHERO_STK | | REC | TT | 1.165 | 0.939 | 1.445 | 0.1653 | — |
| hCV31573621 | rs11079818 | SKAP1 | LACUNAR_STK | AGE MALE DIAB HTN | GEN | TC | 1.614 | 0.78 | 3.341 | 0.1973 | 0.13048 |
| hCV32160712 | rs11079160 | | CE_STK | | DOM | TA or TT | 1.181 | 0.928 | 1.501 | 0.1761 | — |
| hCV32160712 | rs11079160 | | CE_STK | AGE MALE DIAB HTN | GEN | TT | 1.93 | 0.872 | 4.27 | 0.1047 | 0.26509 |
| hCV32160712 | rs11079160 | | CE_STK | AGE MALE DIAB HTN | REC | TT | 1.896 | 0.862 | 4.17 | 0.1116 | — |
| hCV32160712 | rs11079160 | | EO_STK | | GEN | TT | 1.734 | 0.829 | 3.629 | 0.144 | 0.19059 |
| hCV32160712 | rs11079160 | | EO_STK | | REC | TT | 1.8 | 0.864 | 3.751 | 0.1167 | — |
| hCV32160712 | rs11079160 | | ISCHEMIC_STK | | ADD | T | 1.137 | 0.972 | 1.33 | 0.1085 | — |
| hCV32160712 | rs11079160 | | ISCHEMIC_STK | AGE MALE DIAB HTN | GEN | TT | 1.675 | 0.848 | 3.308 | 0.1373 | 0.31696 |
| hCV32160712 | rs11079160 | | ISCHEMIC_STK | AGE MALE DIAB HTN | REC | TT | 1.646 | 0.837 | 3.237 | 0.1488 | — |
| hCV32160712 | rs11079160 | | NOHD_STK | | GEN | TT | 1.509 | 0.886 | 2.57 | 0.1303 | 0.30893 |
| hCV32160712 | rs11079160 | | NOHD_STK | | REC | TT | 1.49 | 0.878 | 2.531 | 0.1396 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV32160712 | rs11079160 | | RECURRENT_STK | | GEN | TT | 1.887 | 0.865 | 4.117 | 0.1107 | 0.28017 |
| hCV32160712 | rs11079160 | | RECURRENT_STK | | REC | TT | 1.87 | 0.863 | 4.056 | 0.1128 | — |
| hCV32160712 | rs11079160 | | RECURRENT_STK | AGE MALE DIAB HTN | GEN | TT | 2.044 | 0.706 | 5.92 | 0.1878 | 0.41924 |
| hCV32160712 | rs11079160 | | RECURRENT_STK | AGE MALE DIAB HTN | REC | TT | 2.029 | 0.706 | 5.827 | 0.1887 | — |
| hCV1408483 | rs17070848 | BCL2 | ATHERO_STK | | GEN | TT | 1.514 | 0.894 | 2.564 | 0.1231 | 0.29337 |
| hCV1408483 | rs17070848 | BCL2 | ATHERO_STK | | REC | TT | 1.487 | 0.882 | 2.505 | 0.1364 | — |
| hCV1619596 | rs1048621 | SDCBP2 | CE_STK | | GEN | AG | 1.176 | 0.932 | 1.483 | 0.1731 | 0.21433 |
| hCV1619596 | rs1048621 | SDCBP2 | CE_STK | | GEN | AA | 1.35 | 0.888 | 2.055 | 0.1607 | 0.21433 |
| hCV1619596 | rs1048621 | SDCBP2 | CE_STK | | DOM | AG or AA | 1.203 | 0.964 | 1.501 | 0.1025 | — |
| hCV1619596 | rs1048621 | SDCBP2 | CE_STK | AGE MALE DIAB HTN | ADD | A | 1.204 | 0.959 | 1.51 | 0.109 | — |
| hCV1619596 | rs1048621 | SDCBP2 | EO_STK | AGE MALE DIAB HTN | ADD | A | 1.202 | 0.965 | 1.497 | 0.101 | — |
| hCV1619596 | rs1048621 | SDCBP2 | ISCHEMIC_STK | | GEN | AG | 1.127 | 0.945 | 1.344 | 0.1838 | 0.22154 |
| hCV1619596 | rs1048621 | SDCBP2 | ISCHEMIC_STK | | GEN | AA | 1.261 | 0.909 | 1.748 | 0.1644 | 0.22154 |
| hCV1619596 | rs1048621 | SDCBP2 | ISCHEMIC_STK | | DOM | AG or AA | 1.148 | 0.97 | 1.357 | 0.1079 | — |
| hCV1619596 | rs1048621 | SDCBP2 | ISCHEMIC_STK | AGE MALE DIAB HTN | ADD | A | 1.139 | 0.954 | 1.36 | 0.1508 | — |
| hCV1619596 | rs1048621 | SDCBP2 | NOHD_STK | | GEN | AA | 1.267 | 0.89 | 1.804 | 0.1884 | 0.27789 |
| hCV1619596 | rs1048621 | SDCBP2 | NOHD_STK | | ADD | A | 1.125 | 0.974 | 1.299 | 0.1095 | — |
| hCV1619596 | rs1048621 | SDCBP2 | NOHD_STK | | DOM | AG or AA | 1.146 | 0.955 | 1.375 | 0.1442 | — |
| hCV1619596 | rs1048621 | SDCBP2 | NOHD_STK | AGE MALE DIAB HTN | GEN | AG | 1.217 | 0.944 | 1.569 | 0.1302 | 0.29766 |
| hCV1619596 | rs1048621 | SDCBP2 | NOHD_STK | AGE MALE DIAB HTN | ADD | A | 1.14 | 0.944 | 1.376 | 0.1722 | — |
| hCV1619596 | rs1048621 | SDCBP2 | NOHD_STK | AGE MALE DIAB HTN | DOM | AG or AA | 1.21 | 0.951 | 1.541 | 0.1208 | — |
| hCV1619596 | rs1048621 | SDCBP2 | RECURRENT_STK | | GEN | AG | 1.23 | 0.896 | 1.689 | 0.1998 | 0.42372 |
| hCV1619596 | rs1048621 | SDCBP2 | RECURRENT_STK | | DOM | AG or AA | 1.224 | 0.904 | 1.658 | 0.1917 | — |
| hCV1619596 | rs1048621 | SDCBP2 | RECURRENT_STK | AGE MALE DIAB HTN | GEN | AG | 1.334 | 0.86 | 2.07 | 0.1987 | 0.41241 |
| hCV29537898 | rs6073804 | | NOHD_STK | | ADD | T | 1.194 | 0.943 | 1.511 | 0.1415 | — |
| hCV29537898 | rs6073804 | | RECURRENT_STK | AGE MALE DIAB HTN | GEN | TT | 5.809 | 0.6 | 56.26 | 0.1288 | 0.23964 |
| hCV29537898 | rs6073804 | | RECURRENT_STK | AGE MALE DIAB HTN | REC | TT | 5.608 | 0.578 | 54.4 | 0.1369 | — |
| hCV1723718 | rs12481805 | UMODL1 | EO_STK | | REC | AA | 1.45 | 0.917 | 2.293 | 0.1118 | — |
| hCV1723718 | rs12481805 | UMODL1 | ISCHEMIC_STK | | REC | AA | 1.254 | 0.922 | 1.706 | 0.1498 | — |
| hCV1723718 | rs12481805 | UMODL1 | LACUNAR_STK | AGE MALE DIAB HTN | REC | AA | 1.545 | 0.838 | 2.848 | 0.1633 | — |
| hCV1723718 | rs12481805 | UMODL1 | NOHD_STK | | REC | AA | 1.316 | 0.947 | 1.829 | 0.1019 | — |
| hCV1723718 | rs12481805 | UMODL1 | NONCE_STK | | REC | AA | 1.33 | 0.945 | 1.872 | 0.1017 | — |

TABLE 21-continued

| hCV # | rs # | Gene | OUTCOME | AD-JUST | MODE | GENO-TYPE | Odds Ratio | 95% Lower CL | 95% Upper CL | ProbChiSq (2-sided p-value) | PVAL-UE_2DF |
|---|---|---|---|---|---|---|---|---|---|---|---|
| hCV1723718 | rs12481805 | UMODL1 | RECURRENT_STK | AGE MALE DIAB HTN | GEN | AG | 1.349 | 0.867 | 2.098 | 0.185 | 0.37072 |
| hCV1723718 | rs12481805 | UMODL1 | RECURRENT_STK | AGE MALE DIAB HTN | ADD | A | 1.239 | 0.897 | 1.711 | 0.1934 | — |
| hCV1723718 | rs12481805 | UMODL1 | RECURRENT_STK | AGE MALE DIAB HTN | DOM | AG or AA | 1.352 | 0.889 | 2.056 | 0.159 | — |

TABLE 22

| hCV # | rs # | Gene Symbol | ENDPT | MODE | STRATA | ADJUST | GENO TYPE | Risk Genotype |
|---|---|---|---|---|---|---|---|---|
| hCV16336 | r5362277 | HD | ENDPT4F1 | GEN | ALL | STATIN | TC | CC |
| hCV16336 | r5362277 | HD | ENDPT4F1 | DOM | ALL | STATIN | TC + TT | CC |
| hCV16336 | r5362277 | HD | ENDPT4F1 | ADD | ALL | STATIN | T | CC |
| hCV32160712 | rs11079160 | | ENDPT4F1 | GEN | ALL | STATIN | TT | TT |
| hCV32160712 | rs11079160 | | ENDPT4F1 | REC | ALL | STATIN | TT | TT |
| hCV32160712 | rs11079160 | | ENDPT4F1 | ADD | ALL | STATIN | T | TT |
| hCV16134786 | r52857595 | | ENDPT4F1 | REC | ALL | | AA | AA |
| hCV1619596 | rs1048621 | SDCBP2 | ENDPT4F1 | GEN | ALL | | AA | AG or AA |
| hCV1619596 | rs1048621 | SDCBP2 | ENDPT4F1 | REC | ALL | | AA | AG or AA |
| hCV32160712 | rs11079160 | | ENDPT4F1 | GEN | ALL | | TT | TT |
| hCV32160712 | rs11079160 | | ENDPT4F1 | DOM | ALL | | TA + TT | TT |
| hCV32160712 | rs11079160 | | ENDPT4F1 | REC | ALL | | TT | TT |
| hCV32160712 | rs11079160 | | ENDPT4F1 | ADD | ALL | | T | TT |

| hCV # | rs # | EVENTS | TOTAL | HR | 95% Lower CL for HR | 95% Upper CL for HR | P-VALUE | 2DF P-VALUE |
|---|---|---|---|---|---|---|---|---|
| hCV16336 | r5362277 | 21 | 491 | 0.7 | 0.444 | 1.115 | 0.1341 | 0.3256 |
| hCV16336 | r5362277 | 23 | 526 | 0.72 | 0.462 | 1.12 | 0.1447 | — |
| hCV16336 | r5362277 | — | — | 0.76 | 0.507 | 1.14 | 0.1848 | — |
| hCV32160712 | rs11079160 | 8 | 83 | 1.88 | 0.914 | 3.853 | 0.0866 | 0.221 |
| hCV32160712 | rs11079160 | 8 | 83 | 1.82 | 0.895 | 3.714 | 0.0981 | — |
| hCV32160712 | rs11079160 | — | — | 1.21 | 0.918 | 1.604 | 0.1746 | — |
| hCV16134786 | r52857595 | 5 | 45 | 1.92 | 0.778 | 4.735 | 0.1569 | — |
| hCV1619596 | rs1048621 | 12 | 115 | 1.69 | 0.894 | 3.195 | 0.1065 | 0.1552 |
| hCV1619596 | rs1048621 | 12 | 115 | 1.78 | 0.97 | 3.274 | 0.0627 | — |
| hCV32160712 | rs11079160 | 6 | 37 | 3.09 | 1.33 | 7.19 | 0.0088 | 0.0281 |
| hCV32160712 | rs11079160 | 34 | 428 | 1.41 | 0.917 | 2.164 | 0.1172 | — |
| hCV32160712 | rs11079160 | 6 | 37 | 2.87 | 1.253 | 6.585 | 0.0126 | — |
| hCV32160712 | rs11079160 | — | — | 1.48 | 1.037 | 2.12 | 0.0308 | — |

TABLE 23

| hCV # | rs # | Gene Symbol | ENDPT | TIMEVAR | MODE | GENO-TYPE | Risk Allele | Risk Genotype | STATIN | EVENTS | TOTAL | HR | 95% Lower CL for HR | 95% Upper CL for HR | P-VALUE | PVAL_INTX |
|---|---|---|---|---|---|---|---|---|---|---|---|---|---|---|---|---|
| hCV27830265 | rs12762303 | ALOX5 | ENDPT4F1 | TIMETO_EP4F1 | GEN | GG | G | GA or GG | Pravastatin | 0 | 23 | 0 | 0 | — | 0.9967 | 0.15026 |
| hCV27830265 | rs12762303 | ALOX5 | ENDPT4F1 | TIMETO_EP4F1 | GEN | GG | G | GA or GG | Placebo | 2 | 42 | ref | — | — | — | 0.15026 |
| hCV27830265 | rs12762303 | ALOX5 | ENDPT4F1 | TIMETO_EP4F1 | GEN | GA | G | GA or GG | Pravastatin | 13 | 376 | 0.47 | 0.239 | 0.906 | 0.0243 | 0.15026 |
| hCV27830265 | rs12762303 | ALOX5 | ENDPT4F1 | TIMETO_EP4F1 | GEN | GA | G | GA or GG | Placebo | 26 | 351 | ref | — | — | — | 0.15026 |
| hCV27830265 | rs12762303 | ALOX5 | ENDPT4F1 | TIMETO_EP4F1 | GEN | AA | G | GA or GG | Pravastatin | 54 | 1005 | 0.84 | 0.584 | 1.212 | 0.3548 | 0.15026 |
| hCV27830265 | rs12762303 | ALOX5 | ENDPT4F1 | TIMETO_EP4F1 | GEN | AA | G | GA or GG | Placebo | 62 | 980 | ref | — | — | — | 0.15026 |
| hCV27830265 | rs12762303 | ALOX5 | ENDPT4F1 | TIMETO_EP4F1 | DOM | GA + GG | G | GA or GG | Pravastatin | 13 | 399 | 0.46 | 0.236 | 0.88 | 0.0192 | 0.10233 |
| hCV27830265 | rs12762303 | ALOX5 | ENDPT4F1 | TIMETO_EP4F1 | DOM | GA + GG | G | GA or GG | Placebo | 28 | 393 | ref | — | — | — | 0.10233 |
| hCV27830265 | rs12762303 | ALOX5 | ENDPT4F1 | TIMETO_EP4F1 | REC | GA + AA | G | GA or GG | Pravastatin | 67 | 1381 | 0.73 | 0.531 | 1.002 | 0.0514 | 0.24445 |
| hCV27830265 | rs12762303 | ALOX5 | ENDPT4F1 | TIMETO_EP4F1 | REC | GA + AA | G | GA or GG | Placebo | 88 | 1331 | ref | — | — | — | 0.24445 |
| hCV27830265 | rs12762303 | ALOX5 | ENDPT4F1 | TIMETO_EP4F1 | GEN | GG | G | GA or GG | Pravastatin | 0 | 23 | 0 | 0 | — | 0.9967 | 0.15067 |
| hCV27830265 | rs12762303 | ALOX5 | ENDPT4F1 | TIMETO_EP4F1 | GEN | GG | G | GA or GG | Placebo | 2 | 42 | ref | — | — | — | 0.15067 |
| hCV27830265 | rs12762303 | ALOX5 | ENDPT4F1 | TIMETO_EP4F1 | GEN | GA | G | GA or GG | Pravastatin | 13 | 375 | 0.47 | 0.24 | 0.911 | 0.0254 | 0.15067 |
| hCV27830265 | rs12762303 | ALOX5 | ENDPT4F1 | TIMETO_EP4F1 | GEN | GA | G | GA or GG | Placebo | 26 | 352 | ref | — | — | — | 0.15067 |
| hCV27830265 | rs12762303 | ALOX5 | ENDPT4F1 | TIMETO_EP4F1 | GEN | AA | G | GA or GG | Pravastatin | 54 | 1002 | 0.85 | 0.587 | 1.218 | 0.3671 | 0.15067 |
| hCV27830265 | rs12762303 | ALOX5 | ENDPT4F1 | EP4F1 | GEN | AA | G | GA or GG | Placebo | 62 | 981 | ref | — | — | — | 0.15067 |
| hCV27830265 | rs12762303 | ALOX5 | ENDPT4F1 | TIMETO_EP4F1 | DOM | GA + GG | G | GA or GG | Pravastatin | 13 | 398 | 0.46 | 0.237 | 0.884 | 0.02 | 0.10281 |
| hCV27830265 | rs12762303 | ALOX5 | ENDPT4F1 | TIMETO_EP4F1 | DOM | GA + GG | G | GA or GG | Placebo | 28 | 394 | ref | — | — | — | 0.10281 |
| hCV27830265 | rs12762303 | ALOX5 | ENDPT4F1 | TIMETO_EP4F1 | REC | GA + AA | G | GA or GG | Pravastatin | 67 | 1377 | 0.73 | 0.533 | 1.007 | 0.0549 | 0.24354 |
| hCV27830265 | rs12762303 | ALOX5 | ENDPT4F1 | TIMETO_EP4F1 | REC | GA + AA | G | GA or GG | Placebo | 88 | 1333 | ref | — | — | — | 0.24354 |
| hCV8942032 | rs1264352 | DDR1 | ENDPT4F1 | TIMETO_EP4F1 | GEN | CC | C | CG or CC | Pravastatin | 1 | 36 | 0.86 | 0.054 | 13.71 | 0.9134 | 0.18029 |
| hCV8942032 | rs1264352 | DDR1 | ENDPT4F1 | TIMETO_EP4F1 | GEN | CC | C | CG or CC | Placebo | 1 | 31 | ref | — | — | — | 0.18029 |
| hCV8942032 | rs1264352 | DDR1 | ENDPT4F1 | TIMETO_EP4F1 | GEN | CG | C | CG or CC | Pravastatin | 9 | 356 | 0.39 | 0.179 | 0.844 | 0.0169 | 0.18029 |
| hCV8942032 | rs1264352 | DDR1 | ENDPT4F1 | TIMETO_EP4F1 | GEN | CG | C | CG or CC | Placebo | 22 | 347 | ref | — | — | — | 0.18029 |
| hCV8942032 | rs1264352 | DDR1 | ENDPT4F1 | TIMETO_EP4F1 | GEN | GG | C | CG or CC | Pravastatin | 57 | 1011 | 0.84 | 0.592 | 1.201 | 0.3442 | 0.18029 |
| hCV8942032 | rs1264352 | DDR1 | ENDPT4F1 | TIMETO_EP4F1 | GEN | GG | C | CG or CC | Placebo | 67 | 997 | ref | — | — | — | 0.18029 |
| hCV8942032 | rs1264352 | DDR1 | ENDPT4F1 | TIMETO_EP4F1 | DOM | CG + CC | C | CG or CC | Pravastatin | 10 | 392 | 0.41 | 0.195 | 0.859 | 0.0182 | 0.07391 |
| hCV8942032 | rs1264352 | DDR1 | ENDPT4F1 | TIMETO_EP4F1 | DOM | CG + CC | C | CG or CC | Placebo | 23 | 378 | ref | — | — | — | 0.07391 |
| hCV8942032 | rs1264352 | DDR1 | ENDPT4F1 | TIMETO_EP4F1 | REC | CG + GG | C | CG or CC | Pravastatin | 66 | 1367 | 0.73 | 0.527 | 0.997 | 0.0479 | 0.92551 |
| hCV8942032 | rs1264352 | DDR1 | ENDPT4F1 | TIMETO_EP4F1 | REC | CG + GG | C | CG or CC | Placebo | 89 | 1344 | ref | — | — | — | 0.92551 |
| hCV16134786 | rs2857595 | | ENDPT4F1 | TIMETO_EP4F1 | GEN | ALL | AA | AA | Pravastatin | 2 | 71 | 0.23 | 0.044 | 1.189 | 0.0794 | 0.27061 |
| hCV16134786 | rs2857595 | | ENDPT4F1 | TIMETO_EP4F1 | GEN | ALL | AA | AA | Placebo | 5 | 45 | ref | — | — | — | 0.27061 |
| hCV16134786 | rs2857595 | | ENDPT4F1 | TIMETO_EP4F1 | GEN | ALL | AG | AA | Pravastatin | 14 | 403 | 0.67 | 0.342 | 1.293 | 0.2295 | 0.27061 |
| hCV16134786 | rs2857595 | | ENDPT4F1 | TIMETO_EP4F1 | GEN | ALL | AG | AA | Placebo | 23 | 442 | ref | — | — | — | 0.27061 |
| hCV16134786 | rs2857595 | | ENDPT4F1 | TIMETO_EP4F1 | GEN | ALL | GG | AA | Pravastatin | 51 | 928 | 0.8 | 0.553 | 1.164 | 0.2463 | 0.27061 |
| hCV16134786 | rs2857595 | | ENDPT4F1 | TIMETO_EP4F1 | GEN | ALL | GG | AA | Placebo | 61 | 887 | ref | — | — | — | 0.27061 |
| hCV16134786 | rs2857595 | | ENDPT4F1 | TIMETO_EP4F1 | DOM | ALL | AG + AA | AA | Pravastatin | 16 | 474 | 0.58 | 0.313 | 1.068 | 0.0803 | 0.35911 |
| hCV16134786 | rs2857595 | | ENDPT4F1 | TIMETO_EP4F1 | DOM | ALL | AG + AA | AA | Placebo | 28 | 487 | ref | — | — | — | 0.35911 |
| hCV16134786 | rs2857595 | | ENDPT4F1 | TIMETO_EP4F1 | REC | ALL | AG + GG | AA | Pravastatin | 65 | 1331 | 0.77 | 0.559 | 1.068 | 0.1182 | 0.12065 |
| hCV16134786 | rs2857595 | | ENDPT4F1 | TIMETO_EP4F1 | REC | ALL | AG + GG | AA | Placebo | 84 | 1329 | ref | — | — | — | 0.12065 |
| hCV1619596 | rs1048621 | SDCBP2 | ENDPT4F1 | TIMETO_EP4F1 | GEN | ALL | AA | AG or AA | Pravastatin | 2 | 108 | 0.16 | 0.037 | 0.734 | 0.018 | 0.05456 |
| hCV1619596 | rs1048621 | SDCBP2 | ENDPT4F1 | TIMETO_EP4F1 | GEN | ALL | AA | AG or AA | Placebo | 12 | 115 | ref | — | — | — | 0.05456 |
| hCV1619596 | rs1048621 | SDCBP2 | ENDPT4F1 | TIMETO_EP4F1 | GEN | ALL | AG | AG or AA | Pravastatin | 29 | 572 | 0.89 | 0.538 | 1.471 | 0.6494 | 0.05456 |
| hCV1619596 | rs1048621 | SDCBP2 | ENDPT4F1 | TIMETO_EP4F1 | GEN | ALL | AG | AG or AA | Placebo | 32 | 559 | ref | — | — | — | 0.05456 |
| hCV1619596 | rs1048621 | SDCBP2 | ENDPT4F1 | TIMETO_EP4F1 | GEN | ALL | GG | AG or AA | Pravastatin | 36 | 719 | 0.77 | 0.498 | 1.197 | 0.2473 | 0.05456 |
| hCV1619596 | rs1048621 | SDCBP2 | ENDPT4F1 | TIMETO_EP4F1 | GEN | ALL | GG | AG or AA | Placebo | 45 | 696 | ref | — | — | — | 0.05456 |

TABLE 23-continued

| hCV # | rs # | Gene Symbol | ENDPT | TIMEVAR | MODE | GENO-TYPE | Risk Allele | Risk Genotype | STATIN | EVENTS | TOTAL | HR | 95% Lower CL for HR | 95% Upper CL for HR | P-VALUE | PVAL_INTX |
|---|---|---|---|---|---|---|---|---|---|---|---|---|---|---|---|---|
| hCV1619596 | rs1048621 | SDCBP2 | ENDPT4F1 | TIMETO_EP4F1 | DOM | ALL | AG + AA | AG or AA | Pravastatin | 31 | 680 | 0.69 | 0.438 | 1.098 | 0.1188 | 0.74301 |
| hCV1619596 | rs1048621 | SDCBP2 | ENDPT4F1 | TIMETO_EP4F1 | DOM | ALL | AG + AA | AG or AA | Placebo | 44 | 674 | ref | — | — | — | 0.74301 |
| hCV1619596 | rs1048621 | SDCBP2 | ENDPT4F1 | TIMETO_EP4F1 | REC | ALL | AG + GG | AG or AA | Pravastatin | 65 | 1291 | 0.82 | 0.59 | 1.142 | 0.2405 | 0.01754 |
| hCV1619596 | rs1048621 | SDCBP2 | ENDPT4F1 | TIMETO_EP4F1 | REC | ALL | AG + GG | AG or AA | Placebo | 77 | 1255 | ref | — | — | — | 0.01754 |
| hCV32160712 | rs11079160 | | ENDPT4F1 | TIMETO_EP4F1 | GEN | ALL | TT | TT | Pravastatin | 2 | 46 | 0.24 | 0.048 | 1.193 | 0.0812 | 0.22268 |
| hCV32160712 | rs11079160 | | ENDPT4F1 | TIMETO_EP4F1 | GEN | ALL | TT | TT | Placebo | 6 | 37 | ref | — | — | — | 0.22268 |
| hCV32160712 | rs11079160 | | ENDPT4F1 | TIMETO_EP4F1 | GEN | ALL | TA | TT | Pravastatin | 17 | 382 | 0.62 | 0.339 | 1.132 | 0.1194 | 0.22268 |
| hCV32160712 | rs11079160 | | ENDPT4F1 | TIMETO_EP4F1 | GEN | ALL | TA | TT | Placebo | 28 | 391 | ref | — | — | — | 0.22268 |
| hCV32160712 | rs11079160 | | ENDPT4F1 | TIMETO_EP4F1 | GEN | ALL | AA | TT | Pravastatin | 48 | 972 | 0.86 | 0.582 | 1.267 | 0.4421 | 0.22268 |
| hCV32160712 | rs11079160 | | ENDPT4F1 | TIMETO_EP4F1 | GEN | ALL | AA | TT | Placebo | 54 | 942 | ref | — | — | — | 0.22268 |
| hCV32160712 | rs11079160 | | ENDPT4F1 | TIMETO_EP4F1 | DOM | ALL | TA + TT | TT | Pravastatin | 19 | 428 | 0.55 | 0.315 | 0.967 | 0.0379 | 0.20087 |
| hCV32160712 | rs11079160 | | ENDPT4F1 | TIMETO_EP4F1 | DOM | ALL | TA + TT | TT | Placebo | 34 | 428 | ref | — | — | — | 0.20087 |
| hCV32160712 | rs11079160 | | ENDPT4F1 | TIMETO_EP4F1 | REC | ALL | TA + AA | TT | Pravastatin | 65 | 1354 | 0.78 | 0.562 | 1.077 | 0.1301 | 0.13978 |
| hCV32160712 | rs11079160 | | ENDPT4F1 | TIMETO_EP4F1 | REC | ALL | TA + AA | TT | Placebo | 82 | 1333 | ref | — | — | — | 0.13978 |

TABLE 24

| hCV # | rs # | Gene/Chrom | ENDPT | MODE | ADJUST | GENOTYPE | EVENTS |
|---|---|---|---|---|---|---|---|
| hCV1305848 | rs6016200 | | ENDPT4F1 | GEN | STATIN | AA | 0 |
| hCV1305848 | rs6016200 | | ENDPT4F1 | GEN | STATIN | AG | 41 |
| hCV1305848 | rs6016200 | | ENDPT4F1 | GEN | STATIN | GG | 115 |
| hCV1305848 | rs6016200 | | ENDPT4F1 | DOM | STATIN | AG + AA | 41 |
| hCV1305848 | rs6016200 | | ENDPT4F1 | DOM | STATIN | GG | 115 |
| hCV1305848 | rs6016200 | | ENDPT4F1 | REC | STATIN | AA | 0 |
| hCV1305848 | rs6016200 | | ENDPT4F1 | REC | STATIN | AG + GG | 156 |
| hCV1305848 | rs6016200 | | ENDPT4F1 | ADD | STATIN | A | — |
| hCV1746715 | rs4750628 | C10orf38 | ENDPT4F1 | GEN | STATIN | AA | 39 |
| hCV1746715 | rs4750628 | C10orf38 | ENDPT4F1 | GEN | STATIN | AG | 89 |
| hCV1746715 | rs4750628 | C10orf38 | ENDPT4F1 | GEN | STATIN | GG | 28 |
| hCV1746715 | rs4750628 | C10orf38 | ENDPT4F1 | DOM | STATIN | AG + AA | 128 |
| hCV1746715 | rs4750628 | C10orf38 | ENDPT4F1 | DOM | STATIN | GG | 28 |
| hCV1746715 | rs4750628 | C10orf38 | ENDPT4F1 | REC | STATIN | AA | 39 |
| hCV1746715 | rs4750628 | C10orf38 | ENDPT4F1 | REC | STATIN | AG + GG | 117 |
| hCV1746715 | rs4750628 | C10orf38 | ENDPT4F1 | ADD | STATIN | A | — |
| hCV29881864 | rs10514542 | | ENDPT4F1 | GEN | STATIN | CC | 20 |
| hCV29881864 | rs10514542 | | ENDPT4F1 | GEN | STATIN | CG | 61 |
| hCV29881864 | rs10514542 | | ENDPT4F1 | GEN | STATIN | GG | 75 |
| hCV29881864 | rs10514542 | | ENDPT4F1 | DOM | STATIN | CG + CC | 81 |
| hCV29881864 | rs10514542 | | ENDPT4F1 | DOM | STATIN | GG | 75 |
| hCV29881864 | rs10514542 | | ENDPT4F1 | REC | STATIN | CC | 20 |
| hCV29881864 | rs10514542 | | ENDPT4F1 | REC | STATIN | CG + GG | 136 |
| hCV29881864 | rs10514542 | | ENDPT4F1 | ADD | STATIN | C | — |
| hDV70959216 | rs17482753 | | ENDPT4F1 | GEN | STATIN | TT | 0 |
| hDV70959216 | rs17482753 | | ENDPT4F1 | GEN | STATIN | TG | 20 |
| hDV70959216 | rs17482753 | | ENDPT4F1 | GEN | STATIN | GG | 136 |
| hDV70959216 | rs17482753 | | ENDPT4F1 | DOM | STATIN | TG + TT | 20 |
| hDV70959216 | rs17482753 | | ENDPT4F1 | DOM | STATIN | GG | 136 |
| hDV70959216 | rs17482753 | | ENDPT4F1 | REC | STATIN | TT | 0 |
| hDV70959216 | rs17482753 | | ENDPT4F1 | REC | STATIN | TG + GG | 156 |
| hDV70959216 | rs17482753 | | ENDPT4F1 | ADD | STATIN | T | — |
| hCV1305848 | rs6016200 | | ENDPT4F1 | GEN | | AA | 0 |
| hCV1305848 | rs6016200 | | ENDPT4F1 | GEN | | AG | 22 |
| hCV1305848 | rs6016200 | | ENDPT4F1 | GEN | | GG | 67 |
| hCV1305848 | rs6016200 | | ENDPT4F1 | DOM | | AG + AA | 22 |
| hCV1305848 | rs6016200 | | ENDPT4F1 | DOM | | GG | 67 |
| hCV1305848 | rs6016200 | | ENDPT4F1 | REC | | AA | 0 |
| hCV1305848 | rs6016200 | | ENDPT4F1 | REC | | AG + GG | 89 |
| hCV1305848 | rs6016200 | | ENDPT4F1 | ADD | | A | — |
| hCV1746715 | rs4750628 | C10orf38 | ENDPT4F1 | GEN | | AA | 21 |
| hCV1746715 | rs4750628 | C10orf38 | ENDPT4F1 | GEN | | AG | 52 |
| hCV1746715 | rs4750628 | C10orf38 | ENDPT4F1 | GEN | | GG | 16 |
| hCV1746715 | rs4750628 | C10orf38 | ENDPT4F1 | DOM | | AG + AA | 73 |
| hCV1746715 | rs4750628 | C10orf38 | ENDPT4F1 | DOM | | GG | 16 |
| hCV1746715 | rs4750628 | C10orf38 | ENDPT4F1 | REC | | AA | 21 |
| hCV1746715 | rs4750628 | C10orf38 | ENDPT4F1 | REC | | AG + GG | 68 |
| hCV1746715 | rs4750628 | C10orf38 | ENDPT4F1 | ADD | | A | — |
| hCV29881864 | rs10514542 | | ENDPT4F1 | GEN | | CC | 14 |
| hCV29881864 | rs10514542 | | ENDPT4F1 | GEN | | CG | 35 |
| hCV29881864 | rs10514542 | | ENDPT4F1 | GEN | | GG | 40 |
| hCV29881864 | rs10514542 | | ENDPT4F1 | DOM | | CG + CC | 49 |
| hCV29881864 | rs10514542 | | ENDPT4F1 | DOM | | GG | 40 |
| hCV29881864 | rs10514542 | | ENDPT4F1 | REC | | CC | 14 |
| hCV29881864 | rs10514542 | | ENDPT4F1 | REC | | CG + GG | 75 |
| hCV29881864 | rs10514542 | | ENDPT4F1 | ADD | | C | — |

| hCV # | rs # | TOTAL | HR | 95% Lower CL for HR | 95% Upper CL for HR | P-VALUE | 2DF P-VALUE |
|---|---|---|---|---|---|---|---|
| hCV1305848 | rs6016200 | 86 | 0 | 0 | 1.63E+248 | 0.9648 | 0.2079 |
| hCV1305848 | rs6016200 | 875 | 0.72 | 0.507 | 1.035 | 0.0764 | 0.2079 |
| hCV1305848 | rs6016200 | 1806 | ref | — | — | — | 0.2079 |
| hCV1305848 | rs6016200 | 961 | 0.66 | 0.46 | 0.938 | 0.0209 | — |
| hCV1305848 | rs6016200 | 1806 | ref | — | — | — | — |
| hCV1305848 | rs6016200 | 86 | 0 | 0 | 9.16E+246 | 0.9649 | — |
| hCV1305848 | rs6016200 | 2681 | ref | — | — | — | — |
| hCV1305848 | rs6016200 | — | 0.63 | 0.451 | 0.876 | 0.0061 | — |
| hCV1746715 | rs4750628 | 701 | 1.47 | 0.906 | 2.392 | 0.1187 | 0.0324 |
| hCV1746715 | rs4750628 | 1340 | 1.76 | 1.151 | 2.691 | 0.0091 | 0.0324 |
| hCV1746715 | rs4750628 | 726 | ref | — | — | — | 0.0324 |
| hCV1746715 | rs4750628 | 2041 | 1.66 | 1.103 | 2.5 | 0.015 | — |
| hCV1746715 | rs4750628 | 726 | ref | — | — | — | — |
| hCV1746715 | rs4750628 | 701 | 0.99 | 0.688 | 1.42 | 0.9495 | — |
| hCV1746715 | rs4750628 | 2066 | ref | — | — | — | — |

TABLE 24-continued

| | | | | | | | |
|---|---|---|---|---|---|---|---|
| hCV1746715 | rs4750628 | — | 1.18 | 0.947 | 1.465 | 0.1424 | — |
| hCV29881864 | rs10514542 | 224 | 1.76 | 1.072 | 2.875 | 0.0253 | 0.0767 |
| hCV29881864 | rs10514542 | 1102 | 1.06 | 0.756 | 1.486 | 0.7354 | 0.0767 |
| hCV29881864 | rs10514542 | 1450 | ref | — | — | — | 0.0767 |
| hCV29881864 | rs10514542 | 1326 | 1.18 | 0.858 | 1.609 | 0.3138 | — |
| hCV29881864 | rs10514542 | 1450 | ref | — | — | — | — |
| hCV29881864 | rs10514542 | 224 | 1.71 | 1.07 | 2.736 | 0.0249 | — |
| hCV29881864 | rs10514542 | 2552 | ref | — | — | — | — |
| hCV29881864 | rs10514542 | — | 1.24 | 0.975 | 1.564 | 0.08 | — |
| hDV70959216 | rs17482753 | 21 | 0 | 0 | — | 0.974 | 0.2331 |
| hDV70959216 | rs17482753 | 495 | 0.66 | 0.416 | 1.063 | 0.088 | 0.2331 |
| hDV70959216 | rs17482753 | 2252 | ref | — | — | — | 0.2331 |
| hDV70959216 | rs17482753 | 516 | 0.64 | 0.399 | 1.019 | 0.0599 | — |
| hDV70959216 | rs17482753 | 2252 | ref | — | — | — | — |
| hDV70959216 | rs17482753 | 21 | 0 | 0 | — | 0.974 | — |
| hDV70959216 | rs17482753 | 2747 | ref | — | — | — | — |
| hDV70959216 | rs17482753 | — | 0.63 | 0.398 | 0.991 | 0.0458 | — |
| hCV1305848 | rs6016200 | 44 | 0 | 0 | . | 0.9823 | 0.3016 |
| hCV1305848 | rs6016200 | 426 | 0.68 | 0.422 | 1.107 | 0.1216 | 0.3016 |
| hCV1305848 | rs6016200 | 898 | ref | — | — | — | 0.3016 |
| hCV1305848 | rs6016200 | 470 | 0.62 | 0.381 | 0.997 | 0.0487 | — |
| hCV1305848 | rs6016200 | 898 | ref | — | — | — | — |
| hCV1305848 | rs6016200 | 44 | 0 | 0 | — | 0.9823 | — |
| hCV1305848 | rs6016200 | 1324 | ref | — | — | — | — |
| hCV1305848 | rs6016200 | — | 0.59 | 0.379 | 0.929 | 0.0226 | — |
| hCV1746715 | rs4750628 | 349 | 1.34 | 0.699 | 2.568 | 0.3775 | 0.1054 |
| hCV1746715 | rs4750628 | 665 | 1.79 | 1.021 | 3.132 | 0.0421 | 0.1054 |
| hCV1746715 | rs4750628 | 355 | ref | — | — | — | 0.1054 |
| hCV1746715 | rs4750628 | 1014 | 1.63 | 0.95 | 2.802 | 0.0763 | — |
| hCV1746715 | rs4750628 | 355 | ref | — | — | — | — |
| hCV1746715 | rs4750628 | 349 | 0.89 | 0.545 | 1.449 | 0.6359 | — |
| hCV1746715 | rs4750628 | 1020 | ref | — | — | — | — |
| hCV1746715 | rs4750628 | — | 1.13 | 0.844 | 1.501 | 0.4216 | — |
| hCV29881864 | rs10514542 | 115 | 2.28 | 1.238 | 4.187 | 0.0081 | 0.0236 |
| hCV29881864 | rs10514542 | 565 | 1.06 | 0.675 | 1.673 | 0.7927 | 0.0236 |
| hCV29881864 | rs10514542 | 694 | ref | — | — | — | 0.0236 |
| hCV29881864 | rs10514542 | 680 | 1.25 | 0.826 | 1.903 | 0.2888 | — |
| hCV29881864 | rs10514542 | 694 | ref | — | — | — | — |
| hCV29881864 | rs10514542 | 115 | 2.21 | 1.25 | 3.921 | 0.0064 | — |
| hCV29881864 | rs10514542 | 1259 | ref | — | — | — | — |
| hCV29881864 | rs10514542 | — | 1.38 | 1.009 | 1.878 | 0.0438 | — |

TABLE 25

| hCV # | rs # | Gene Symbol | ENDPT | TIMEVAR | MODE | GENO-TYPE | Risk Allele | STATIN |
|---|---|---|---|---|---|---|---|---|
| hDV77718013 | | | ENDPT4F1 | TIMETO_EP4F1 | REC | TC + CC | | Pravastatin |
| hCV3216551 | rs562338 | | ENDPT4F1 | TIMETO_EP4F1 | GEN | GG | | Pravastatin |
| hCV2862873 | rs780094 | GCKR | ENDPT4F1 | TIMETO_EP4F1 | DOM | TC + TT | | Pravastatin |
| hCV9296529 | rs4358307 | | ENDPT4F1 | TIMETO_EP4F1 | GEN | GA | | Pravastatin |
| hCV29480044 | rs10516433 | TSPAN5 | ENDPT4F1 | TIMETO_EP4F1 | GEN | TC | | Pravastatin |
| hCV29480044 | rs10516433 | TSPAN5 | ENDPT4F1 | TIMETO_EP4F1 | REC | TC + CC | | Pravastatin |
| hCV30454150 | rs10516434 | TSPAN5 | ENDPT4F1 | TIMETO_EP4F1 | GEN | TC | | Pravastatin |
| hCV30454150 | rs10516434 | TSPAN5 | ENDPT4F1 | TIMETO_EP4F1 | REC | TC + CC | | Pravastatin |
| hCV8942032 | rs1264352 | DDR1 | ENDPT4F1 | TIMETO_EP4F1 | DOM | CG + CC | C | Pravastatin |
| hCV9473891 | rs1555173 | | ENDPT4F1 | TIMETO_EP4F1 | REC | CT + TT | | Pravastatin |
| hCV2442143 | rs12544854 | ASAH1 | ENDPT4F1 | TIMETO_EP4F1 | GEN | TC | | Pravastatin |
| hCV2442143 | rs12544854 | ASAH1 | ENDPT4F1 | TIMETO_EP4F1 | DOM | TC + TT | | Pravastatin |
| hCV2442143 | rs12544854 | ASAH1 | ENDPT4F1 | TIMETO_EP4F1 | GEN | TC | | Pravastatin |
| hCV2442143 | rs12544854 | ASAH1 | ENDPT4F1 | TIMETO_EP4F1 | DOM | TC + TT | | Pravastatin |
| hCV1463226 | rs10890 | FXN | ENDPT4F1 | TIMETO_EP4F1 | GEN | TT | | Pravastatin |
| hCV1463226 | rs10890 | FXN | ENDPT4F1 | TIMETO_EP4F1 | GEN | CC | | Pravastatin |
| hCV2741051 | rs2230806 | ABCA1 | ENDPT4F1 | TIMETO_EP4F1 | GEN | TC | | Pravastatin |
| hCV2741051 | rs2230806 | ABCA1 | ENDPT4F1 | TIMETO_EP4F1 | DOM | TC + TT | | Pravastatin |
| hCV2741051 | rs2230806 | ABCA1 | ENDPT4F1 | TIMETO_EP4F1 | GEN | TC | | Pravastatin |
| hCV2741051 | rs2230806 | ABCA1 | ENDPT4F1 | TIMETO_EP4F1 | DOM | TC + TT | | Pravastatin |
| hCV2959482 | rs3890182 | ABCA1 | ENDPT4F1 | TIMETO_EP4F1 | GEN | AG | | Pravastatin |
| hCV2959482 | rs3890182 | ABCA1 | ENDPT4F1 | TIMETO_EP4F1 | DOM | AG + AA | | Pravastatin |
| hCV22275299 | rs28927680 | BUD13 | ENDPT4F1 | TIMETO_EP4F1 | GEN | GC | | Pravastatin |
| hCV29566897 | rs10507755 | | ENDPT4F1 | TIMETO_EP4F1 | REC | CT + TT | | Pravastatin |
| hCV8757333 | rs1800588 | LIPC | ENDPT4F1 | TIMETO_EP4F1 | DOM | TC + TT | | Pravastatin |
| hCV16164743 | rs2928932 | | ENDPT4F1 | TIMETO_EP4F1 | GEN | CC | | Pravastatin |
| hCV16164743 | rs2928932 | | ENDPT4F1 | TIMETO_EP4F1 | GEN | AA | | Pravastatin |
| hCV9324316 | rs9305020 | | ENDPT4F1 | TIMETO_EP4F1 | GEN | TT | | Pravastatin |
| hCV9324316 | rs9305020 | | ENDPT4F1 | TIMETO_EP4F1 | REC | CT + TT | | Pravastatin |
| hCV1846459 | rs4803759 | | ENDPT4F1 | TIMETO_EP4F1 | GEN | TC | | Pravastatin |

TABLE 25-continued

| hCV # | rs # | | Gene | | MODE | GENOTYPE | | STRATA |
|---|---|---|---|---|---|---|---|---|
| hCV1846459 | rs4803759 | | ENDPT4F1 | TIMETO_EP4F1 | GEN | CC | | Pravastatin |
| hCV1846459 | rs4803759 | | ENDPT4F1 | TIMETO_EP4F1 | REC | TC + CC | | Pravastatin |
| hCV26682080 | rs4420638 | | ENDPT4F1 | TIMETO_EP4F1 | GEN | GG | | Pravastatin |
| hCV26682080 | rs4420638 | | ENDPT4F1 | TIMETO_EP4F1 | GEN | GA | | Pravastatin |
| hCV26682080 | rs4420638 | | ENDPT4F1 | TIMETO_EP4F1 | DOM | GA + GG | | Pravastatin |

| hCV # | rs # | EVENTS | TOTAL | HR | 95% Lower CL for HR | 95% Upper CL for HR | P-VALUE | PVAL_INTX |
|---|---|---|---|---|---|---|---|---|
| hDV77718013 | | 66 | 1359 | 0.74 | 0.539 | 1.022 | 0.0673 | 0.0556 |
| hCV3216551 | rs562338 | 40 | 932 | 0.59 | 0.401 | 0.877 | 0.0089 | 0.04137 |
| hCV2862873 | rs780094 | 41 | 887 | 0.6 | 0.403 | 0.881 | 0.0095 | 0.09031 |
| hCV9296529 | rs4358307 | 25 | 624 | 0.5 | 0.307 | 0.807 | 0.0047 | 0.08098 |
| hCV29480044 | rs10516433 | 16 | 454 | 0.46 | 0.255 | 0.832 | 0.0101 | 0.03925 |
| hCV29480044 | rs10516433 | 61 | 1309 | 0.67 | 0.487 | 0.934 | 0.0178 | 0.04698 |
| hCV30454150 | rs10516434 | 16 | 451 | 0.46 | 0.255 | 0.832 | 0.0102 | 0.04149 |
| hCV30454150 | rs10516434 | 61 | 1310 | 0.67 | 0.486 | 0.931 | 0.017 | 0.04884 |
| hCV8942032 | rs1264352 | 10 | 392 | 0.41 | 0.195 | 0.859 | 0.0182 | 0.07391 |
| hCV9473891 | rs1555173 | 67 | 1363 | 0.75 | 0.547 | 1.035 | 0.0801 | 0.07415 |
| hCV2442143 | rs12544854 | 29 | 713 | 0.55 | 0.35 | 0.877 | 0.0118 | 0.02918 |
| hCV2442143 | rs12544854 | 43 | 1070 | 0.57 | 0.391 | 0.836 | 0.004 | 0.00824 |
| hCV2442143 | rs12544854 | 29 | 704 | 0.57 | 0.36 | 0.905 | 0.0172 | 0.04882 |
| hCV2442143 | rs12544854 | 42 | 1059 | 0.56 | 0.384 | 0.825 | 0.0033 | 0.01402 |
| hCV1463226 | rs10890 | 9 | 303 | 0.41 | 0.188 | 0.885 | 0.0233 | 0.02602 |
| hCV1463226 | rs10890 | 16 | 416 | 0.48 | 0.266 | 0.874 | 0.0162 | 0.02602 |
| hCV2741051 | rs2230806 | 16 | 597 | 0.47 | 0.258 | 0.856 | 0.0136 | 0.09085 |
| hCV2741051 | rs2230806 | 20 | 709 | 0.47 | 0.272 | 0.801 | 0.0056 | 0.03067 |
| hCV2741051 | rs2230806 | 17 | 603 | 0.5 | 0.275 | 0.892 | 0.0192 | 0.06908 |
| hCV2741051 | rs2230806 | 20 | 711 | 0.47 | 0.273 | 0.802 | 0.0057 | 0.02439 |
| hCV2959482 | rs3890182 | 8 | 302 | 0.34 | 0.152 | 0.767 | 0.0093 | 0.06769 |
| hCV2959482 | rs3890182 | 8 | 320 | 0.34 | 0.151 | 0.753 | 0.0081 | 0.02862 |
| hCV22275299 | rs28927680 | 2 | 175 | 0.2 | 0.042 | 0.908 | 0.0372 | 0.0983 |
| hCV29566897 | rs10507755 | 67 | 1350 | 0.76 | 0.552 | 1.049 | 0.0957 | 0.02347 |
| hCV8757333 | rs1800588 | 21 | 567 | 0.49 | 0.286 | 0.824 | 0.0074 | 0.05012 |
| hCV16164743 | rs2928932 | 6 | 190 | 0.31 | 0.124 | 0.797 | 0.0148 | 0.03514 |
| hCV16164743 | rs2928932 | 23 | 555 | 0.6 | 0.355 | 1.004 | 0.052 | 0.03514 |
| hCV9324316 | rs9305020 | 48 | 963 | 0.7 | 0.482 | 1.016 | 0.0604 | 0.05765 |
| hCV9324316 | rs9305020 | 67 | 1352 | 0.76 | 0.554 | 1.05 | 0.0968 | 0.02527 |
| hCV1846459 | rs4803759 | 25 | 565 | 0.62 | 0.378 | 1.023 | 0.0613 | 0.05544 |
| hCV1846459 | rs4803759 | 31 | 707 | 0.66 | 0.415 | 1.036 | 0.0707 | 0.05544 |
| hCV1846459 | rs4803759 | 56 | 1272 | 0.64 | 0.457 | 0.895 | 0.0092 | 0.01624 |
| hCV26682080 | rs4420638 | 2 | 58 | 0.25 | 0.05 | 1.217 | 0.0855 | 0.07632 |
| hCV26682080 | rs4420638 | 15 | 383 | 0.5 | 0.268 | 0.919 | 0.0259 | 0.07632 |
| hCV26682080 | rs4420638 | 17 | 441 | 0.45 | 0.255 | 0.804 | 0.0068 | 0.04158 |

TABLE 26

| hCV # | rs # | Gene | MODE | STRATA | ADJUST | GENOTYPE | EVENTS | TOTAL | HR | 95% Lower CL for HR | 95% Upper CL for HR | P-VALUE |
|---|---|---|---|---|---|---|---|---|---|---|---|---|
| hCV11474611 | rs3814843 | CALM1 | GEN | ALL | STATIN | GG | 1 | 3 | 7.54 | 1.055 | 53.886 | 0.0441 |
| hCV11474611 | rs3814843 | CALM1 | GEN | ALL | STATIN | GT | 14 | 224 | 1.17 | 0.676 | 2.038 | 0.5698 |
| hCV11474611 | rs3814843 | CALM1 | GEN | ALL | STATIN | TT | 128 | 2392 | ref | — | — | — |
| hCV11474611 | rs3814843 | CALM1 | REC | ALL | STATIN | GG | 1 | 3 | 7.43 | 1.041 | 53.062 | 0.0455 |
| hCV11474611 | rs3814843 | CALM1 | REC | ALL | STATIN | GT + TT | 142 | 2616 | ref | — | — | — |
| hCV11474611 | rs3814843 | CALM1 | GEN | ALL | | GG | 1 | 3 | 6.64 | 0.919 | 47.944 | 0.0606 |
| hCV11474611 | rs3814843 | CALM1 | GEN | ALL | | GT | 6 | 104 | 0.95 | 0.413 | 2.188 | 0.9051 |
| hCV11474611 | rs3814843 | CALM1 | GEN | ALL | | TT | 70 | 1183 | ref | — | — | — |
| hCV11474611 | rs3814843 | CALM1 | REC | ALL | | GG | 1 | 3 | 6.67 | 0.924 | 48.09 | 0.0599 |
| hCV11474611 | rs3814843 | CALM1 | REC | ALL | | GT + TT | 76 | 1287 | ref | — | — | — |
| hCV2930693 | rs13183672 | FSTL4 | REC | ALL | STATIN | AA | 96 | 1498 | 1.51 | 1.07 | 2.14 | 0.0191 |
| hCV2930693 | rs13183672 | FSTL4 | REC | ALL | STATIN | AC + CC | 48 | 1122 | ref | — | — | — |
| hCV2930693 | rs13183672 | FSTL4 | ADD | ALL | STATIN | A | — | — | 1.29 | 0.965 | 1.719 | 0.0859 |
| hCV2930693 | rs13183672 | FSTL4 | REC | ALL | | AA | 52 | 729 | 1.61 | 0.998 | 2.59 | 0.0512 |
| hCV2930693 | rs13183672 | FSTL4 | REC | ALL | | AC + CC | 25 | 560 | ref | — | — | — |
| hCV2930693 | rs13183672 | FSTL4 | ADD | ALL | | A | — | — | 1.48 | 0.982 | 2.24 | 0.0609 |

TABLE 27

| hCV # | rs | Gene | MODE | GENO-TYPE | STATIN | EVENTS | TOTAL | HR | 95% Lower CL for HR | 95% Upper CL for HR | P-VALUE | PVAL_INTX |
|---|---|---|---|---|---|---|---|---|---|---|---|---|
| hCV1022614 | rs220479 | ITGAE | GEN | CC | Pravastatin | 52 | 973 | 0.89 | 0.609 | 1.295 | 0.5366 | 0.22592 |
| hCV1022614 | rs220479 | ITGAE | GEN | CC | Placebo | 56 | 927 | ref | — | — | — | 0.22592 |
| hCV1022614 | rs220479 | ITGAE | GEN | CT | Pravastatin | 15 | 408 | 0.48 | 0.257 | 0.887 | 0.0192 | 0.22592 |
| hCV1022614 | rs220479 | ITGAE | GEN | CT | Placebo | 30 | 400 | ref | — | — | — | 0.22592 |
| hCV1022614 | rs220479 | ITGAE | GEN | TT | Pravastatin | 3 | 46 | 0.91 | 0.203 | 4.047 | 0.8969 | 0.22592 |
| hCV1022614 | rs220479 | ITGAE | GEN | TT | Placebo | 4 | 56 | ref | — | — | — | 0.22592 |
| hCV1022614 | rs220479 | ITGAE | DOM | CT + CC | Pravastatin | 67 | 1381 | 0.74 | 0.541 | 1.024 | 0.0696 | 0.79081 |
| hCV1022614 | rs220479 | ITGAE | DOM | CT + CC | Placebo | 86 | 1327 | ref | — | — | — | 0.79081 |
| hCV1022614 | rs220479 | ITGAE | REC | CT + TT | Pravastatin | 18 | 454 | 0.52 | 0.294 | 0.921 | 0.0248 | 0.11998 |
| hCV1022614 | rs220479 | ITGAE | REC | CT + TT | Placebo | 34 | 456 | ref | — | — | — | 0.11998 |
| hCV11450563 | rs2038366 | | GEN | GG | Pravastatin | 29 | 539 | 1.15 | 0.669 | 1.975 | 0.6132 | 0.17234 |
| hCV11450563 | rs2038366 | | GEN | GG | Placebo | 24 | 522 | ref | — | — | — | 0.17234 |
| hCV11450563 | rs2038366 | | GEN | GT | Pravastatin | 28 | 638 | 0.61 | 0.381 | 0.986 | 0.0436 | 0.17234 |
| hCV11450563 | rs2038366 | | GEN | GT | Placebo | 43 | 602 | ref | — | — | — | 0.17234 |
| hCV11450563 | rs2038366 | | GEN | TT | Pravastatin | 10 | 151 | 1.13 | 0.472 | 2.724 | 0.7789 | 0.17234 |
| hCV11450563 | rs2038366 | | GEN | TT | Placebo | 10 | 167 | ref | — | — | — | 0.17234 |
| hCV11450563 | rs2038366 | | DOM | GT + GG | Pravastatin | 57 | 1177 | 0.81 | 0.567 | 1.148 | 0.2334 | 0.47195 |
| hCV11450563 | rs2038366 | | DOM | GT + GG | Placebo | 67 | 1124 | ref | — | — | — | 0.47195 |
| hCV11450563 | rs2038366 | | REC | GT + TT | Pravastatin | 38 | 789 | 0.7 | 0.463 | 1.064 | 0.0954 | 0.15155 |
| hCV11450563 | rs2038366 | | REC | GT + TT | Placebo | 53 | 769 | ref | — | — | — | 0.15155 |
| hCV2091644 | rs1010 | VAMP8 | GEN | CC | Pravastatin | 12 | 271 | 1.18 | 0.51 | 2.73 | 0.6997 | 0.48071 |
| hCV2091644 | rs1010 | VAMP8 | GEN | CC | Placebo | 10 | 258 | ref | — | — | — | 0.48071 |
| hCV2091644 | rs1010 | VAMP8 | GEN | CT | Pravastatin | 31 | 686 | 0.66 | 0.418 | 1.045 | 0.0763 | 0.48071 |
| hCV2091644 | rs1010 | VAMP8 | GEN | CT | Placebo | 45 | 666 | ref | — | — | — | 0.48071 |
| hCV2091644 | rs1010 | VAMP8 | GEN | TT | Pravastatin | 26 | 455 | 0.71 | 0.43 | 1.186 | 0.1928 | 0.48071 |
| hCV2091644 | rs1010 | VAMP8 | GEN | TT | Placebo | 35 | 448 | ref | — | — | — | 0.48071 |
| hCV2091644 | rs1010 | VAMP8 | DOM | CT + CC | Pravastatin | 43 | 957 | 0.76 | 0.507 | 1.126 | 0.1678 | 0.87535 |
| hCV2091644 | rs1010 | VAMP8 | DOM | CT + CC | Placebo | 55 | 924 | ref | — | — | — | 0.87535 |
| hCV2091644 | rs1010 | VAMP8 | REC | CT + TT | Pravastatin | 57 | 1141 | 0.68 | 0.487 | 0.961 | 0.0284 | 0.23503 |
| hCV2091644 | rs1010 | VAMP8 | REC | CT + TT | Placebo | 80 | 1114 | ref | — | — | — | 0.23503 |
| hCV2169762 | rs1804689 | HPS1 | GEN | TT | Pravastatin | 4 | 107 | 0.99 | 0.266 | 3.694 | 0.9903 | 0.34901 |
| hCV2169762 | rs1804689 | HPS1 | GEN | TT | Placebo | 5 | 131 | ref | — | — | — | 0.34901 |
| hCV2169762 | rs1804689 | HPS1 | GEN | TG | Pravastatin | 36 | 652 | 0.92 | 0.583 | 1.468 | 0.7398 | 0.34901 |
| hCV2169762 | rs1804689 | HPS1 | GEN | TG | Placebo | 36 | 600 | ref | — | — | — | 0.34901 |
| hCV2169762 | rs1804689 | HPS1 | GEN | GG | Pravastatin | 30 | 668 | 0.59 | 0.372 | 0.924 | 0.0214 | 0.34901 |
| hCV2169762 | rs1804689 | HPS1 | GEN | GG | Placebo | 49 | 651 | ref | — | — | — | 0.34901 |
| hCV2169762 | rs1804689 | HPS1 | DOM | TG + TT | Pravastatin | 40 | 759 | 0.95 | 0.612 | 1.461 | 0.8004 | 0.13433 |
| hCV2169762 | rs1804689 | HPS1 | DOM | TG + TT | Placebo | 41 | 731 | ref | — | — | — | 0.13433 |
| hCV2169762 | rs1804689 | HPS1 | REC | TG + GG | Pravastatin | 66 | 1320 | 0.73 | 0.529 | 1.006 | 0.0547 | 0.65359 |
| hCV2169762 | rs1804689 | HPS1 | REC | TG + GG | Placebo | 85 | 1251 | ref | — | — | — | 0.65359 |
| hCV2192261 | rs3213646 | EXOD1 | GEN | CC | Pravastatin | 27 | 417 | 1.05 | 0.613 | 1.799 | 0.8592 | 0.20384 |
| hCV2192261 | rs3213646 | EXOD1 | GEN | CC | Placebo | 26 | 416 | ref | — | — | — | 0.20384 |
| hCV2192261 | rs3213646 | EXOD1 | GEN | CT | Pravastatin | 24 | 691 | 0.54 | 0.328 | 0.898 | 0.0175 | 0.20384 |
| hCV2192261 | rs3213646 | EXOD1 | GEN | CT | Placebo | 41 | 646 | ref | — | — | — | 0.20384 |
| hCV2192261 | rs3213646 | EXOD1 | GEN | TT | Pravastatin | 13 | 245 | 0.64 | 0.316 | 1.278 | 0.2036 | 0.20384 |
| hCV2192261 | rs3213646 | EXOD1 | GEN | TT | Placebo | 20 | 243 | ref | — | — | — | 0.20384 |
| hCV2192261 | rs3213646 | EXOD1 | DOM | CT + CC | Pravastatin | 51 | 1108 | 0.73 | 0.506 | 1.048 | 0.0882 | 0.72432 |
| hCV2192261 | rs3213646 | EXOD1 | DOM | CT + CC | Placebo | 67 | 1062 | ref | — | — | — | 0.72432 |
| hCV2192261 | rs3213646 | EXOD1 | REC | CT + TT | Pravastatin | 37 | 936 | 0.57 | 0.379 | 0.857 | 0.007 | 0.07855 |
| hCV2192261 | rs3213646 | EXOD1 | REC | CT + TT | Placebo | 61 | 889 | ref | — | — | — | 0.07855 |
| hCV7425232 | rs3900940 | MYH15 | GEN | CC | Pravastatin | 13 | 160 | 1.03 | 0.461 | 2.296 | 0.9448 | 0.57268 |
| hCV7425232 | rs3900940 | MYH15 | GEN | CC | Placebo | 11 | 142 | ref | — | — | — | 0.57268 |
| hCV7425232 | rs3900940 | MYH15 | GEN | CT | Pravastatin | 23 | 561 | 0.61 | 0.365 | 1.022 | 0.0604 | 0.57268 |
| hCV7425232 | rs3900940 | MYH15 | GEN | CT | Placebo | 39 | 583 | ref | — | — | — | 0.57268 |
| hCV7425232 | rs3900940 | MYH15 | GEN | TT | Pravastatin | 30 | 620 | 0.71 | 0.442 | 1.146 | 0.1618 | 0.57268 |
| hCV7425232 | rs3900940 | MYH15 | GEN | TT | Placebo | 39 | 573 | ref | — | — | — | 0.57268 |
| hCV7425232 | rs3900940 | MYH15 | DOM | CT + CC | Pravastatin | 36 | 721 | 0.72 | 0.468 | 1.102 | 0.1293 | 0.97544 |
| hCV7425232 | rs3900940 | MYH15 | DOM | CT + CC | Placebo | 50 | 725 | ref | — | — | — | 0.97544 |
| hCV7425232 | rs3900940 | MYH15 | REC | CT + TT | Pravastatin | 53 | 1181 | 0.66 | 0.467 | 0.939 | 0.0207 | 0.33623 |
| hCV7425232 | rs3900940 | MYH15 | REC | CT + TT | Placebo | 78 | 1156 | ref | — | — | — | 0.33623 |
| hCV945276 | rs89962 | KRT4 | GEN | TT | Pravastatin | 9 | 238 | 0.96 | 0.392 | 2.375 | 0.9381 | 0.71864 |
| hCV945276 | rs89962 | KRT4 | GEN | TT | Placebo | 10 | 255 | ref | — | — | — | 0.71864 |
| hCV945276 | rs89962 | KRT4 | GEN | TG | Pravastatin | 37 | 674 | 0.64 | 0.423 | 0.979 | 0.0397 | 0.71864 |
| hCV945276 | rs89962 | KRT4 | GEN | TG | Placebo | 53 | 628 | ref | — | — | — | 0.71864 |
| hCV945276 | rs89962 | KRT4 | GEN | GG | Pravastatin | 17 | 443 | 0.65 | 0.349 | 1.196 | 0.1641 | 0.71864 |
| hCV945276 | rs89962 | KRT4 | GEN | GG | Placebo | 25 | 426 | ref | — | — | — | 0.71864 |
| hCV945276 | rs89962 | KRT4 | DOM | TG + TT | Pravastatin | 46 | 912 | 0.7 | 0.48 | 1.027 | 0.0683 | 0.83505 |
| hCV945276 | rs89962 | KRT4 | DOM | TG + TT | Placebo | 63 | 883 | ref | — | — | — | 0.83505 |
| hCV945276 | rs89962 | KRT4 | REC | TG + GG | Pravastatin | 54 | 1117 | 0.65 | 0.458 | 0.916 | 0.0141 | 0.42005 |
| hCV945276 | rs89962 | KRT4 | REC | TG + GG | Placebo | 78 | 1054 | ref | — | — | — | 0.42005 |

TABLE 28

Association of MYH15 (rs3900940/hCV7425232) with stroke endpoint in CARE
Study population:
CARE study (n = 2913)
Endpoint:
stroke or TIA (offical CARE endpoint) ("endpt4f1")
Statistical method:
Cox model
Association of MYH15 SNP (rs3900940/hCV7425232) with stroke endpoint in CARE combined treatment arms

| | Adjusted1 | | | Adjusted2 | | | Adjusted3 | | |
|---|---|---|---|---|---|---|---|---|---|
| Genotype | HR | 95% CI | 2-sided p-value | HR | 95% CI | 2-sided p-value | HR | 95% CI | 2-sided p-value |
| Hom_CC | 1.403 | 0.88-2.23 | 0.153 | 1.51 | 0.94-2.40 | 0.086 | 1.49 | 0.93-2.37 | 0.094 |
| Het_CT | 0.925 | 0.66-1.30 | 0.6565 | 0.89 | 0.63-1.25 | 0.49 | 0.881 | 0.62-1.24 | 0.4715 |
| Maj_TT | 1 | | | 1 | | | 1 | | |
| Rec_CC | 1.46 | 0.94-2.25 | 0.09 | 1.6 | 1.03-2.47 | 0.0358 | 1.58 | 1.02-2.45 | 0.039 |
| Maj + het | 1 | | | 1 | | | 1 | | |

"Adjusted1" = Adjusted for statin use
"Adjusted2" = Adjusted for traditional risk factors (TRF), body mass index (BMI), and statin use
"Adjusted3" = Adjusted for TRF, BMI, statin use, and CHD (CARE primary endpoint)
Conclusions:
1) The MYH15 SNP (rs3900940/hCV7425232) was associated with stroke in CARE.
2) The MYH15 SNP (rs3900940/hCV7425232) was associated with stroke in CARE even after adjusting for CHD. (CHD defined in accordance with CARE original endpoint-fatal CHD/definite non-fatal MI, "endpt1")

TABLE 29

| hCV # | rs # | Gene symbol | Risk Allele | MODE | STRATA | GENO_PLACEBO | EVENTS_PLACEBO | TOTAL_PLACEBO |
|---|---|---|---|---|---|---|---|---|
| hCV2091644 | rs1010 | VAMP8 | C | GEN | ALL | CC | 49 | 521 |
| hCV2091644 | rs1010 | VAMP8 | C | GEN | hist | CC | 28 | 235 |
| hCV2091644 | rs1010 | VAMP8 | C | GEN | hist | CT | 58 | 633 |
| hCV2442143 | rs12544854 | ASAH1 | T | GEN | no hist | CT | 48 | 808 |
| hCV8942032 | rs1264352 | DDR1 | C | GEN | ALL | CC | 8 | 110 |
| hCV2169762 | rs1804689 | HP51 | T | GEN | no hist | GT | 38 | 670 |
| hCV16158671 | rs2200733 | C4 | T | GEN | ALL | CT | 37 | 489 |
| hCV16158671 | rs2200733 | C4 | T | GEN | no hist | CT | 19 | 285 |
| hCV16158671 | rs2200733 | C4 | T | GEN | hist | TT | 3 | 10 |
| hCV27504565 | rs3219489 | MUTYH | C | GEN | hist | CG | 35 | 465 |
| hCV27511436 | rs3750145 | FZD1 | T | GEN | ALL | CC | 4 | 77 |
| hCV27511436 | rs3750145 | FZD1 | T | GEN | hist | CC | 1 | 31 |
| hCV7425232 | rs3900940 | MYH15 | C | GEN | hist | CT | 55 | 528 |

| hCV # | HR_PLACEBO | LOWER_PLACEBO | UPPER_PLACEBO | P_PLACEBO | EVENTS_ALL | no event | HR_ALL | P_ALL |
|---|---|---|---|---|---|---|---|---|
| hCV2091644 | 1.50982 | 1.030611 | 2.211844 | 0.0344528 | 88 | 951 | 1.340598 | 0.051104903 |
| hCV2091644 | 1.503 | 0.897908 | 2.515874 | 0.1210805 | 54 | 428 | 1.633661 | 0.014183695 |
| hCV2091644 | 1.13938 | 0.733208 | 1.770572 | 0.5617921 | 118 | 1136 | 1.344979 | 0.076364852 |
| hCV2442143 | 1.31132 | 0.778332 | 2.209298 | 0.3085018 | 101 | 1535 | 1.326084 | 0.166536479 |
| hCV8942032 | 1.01239 | 0.495766 | 2.067369 | 0.9730365 | 22 | 214 | 1.368996 | 0.190221586 |
| hCV2169762 | 0.99636 | 0.64971 | 1.527967 | 0.9866678 | 85 | 1236 | 1.35397 | 0.062193717 |
| hCV16158671 | 1.07497 | 0.753308 | 1.533975 | 0.6902781 | 80 | 900 | 1.197273 | 0.172251195 |
| hCV16158671 | 1.2283 | 0.742471 | 2.032018 | 0.4233603 | 38 | 517 | 1.282126 | 0.189409128 |
| hCV16158671 | 3.71145 | 1.175206 | 11.72124 | 0.0254095 | 4 | 18 | 2.311594 | 0.124212946 |
| hCV27504565 | 0.70803 | 0.473602 | 1.0585 | 0.092402 | 69 | 853 | 0.726379 | 0.040276813 |
| hCV27511436 | 0.65977 | 0.244625 | 1.779435 | 0.4113489 | 6 | 149 | 0.503156 | 0.113669409 |
| hCV27511436 | 0.32028 | 0.044599 | 2.300102 | 0.2576826 | 2 | 64 | 0.307292 | 0.120384642 |
| hCV7425232 | 1.21122 | 0.833465 | 1.760195 | 0.3149935 | 107 | 956 | 1.224954 | 0.171949776 |

TABLE 30

| hCV # | rs # | Gene/Chrom symbol | Risk Allele | MODE | STRATA | GENO_PLACEBO | EVENTS_PLACEBO | TOTAL_PLACEBO |
|---|---|---|---|---|---|---|---|---|
| hCV2091644 | rs1010 | VAMP8 | C | GEN | ALL | CC | 49 | 521 |
| hCV2091644 | rs1010 | VAMP8 | C | DOM | ALL | CC + CT | 153 | 1968 |
| hCV2091644 | rs1010 | VAMP8 | C | GEN | no hist | CC | 21 | 286 |
| hCV2091644 | rs1010 | VAMP8 | C | GEN | hist | CC | 28 | 235 |

TABLE 30-continued

| hCV # | rs # | Gene/Chrom symbol | Risk Allele | MODE | STRATA | GENO_RESP | EVENTS_RESP | no event |
|---|---|---|---|---|---|---|---|---|
| hCV26505812 | rs10757274 | C9p21 | G | GEN | ALL | AG | 121 | 1455 |
| hCV26505812 | rs10757274 | C9p21 | G | DOM | ALL | GG + AG | 169 | 2156 |
| hCV26505812 | rs10757274 | C9p21 | G | GEN | no hist | GG | 23 | 364 |
| hCV26505812 | rs10757274 | C9p21 | G | GEN | no hist | AG | 52 | 826 |
| hCV26505812 | rs10757274 | C9p21 | G | DOM | no hist | GG + AG | 75 | 1190 |
| hCV26505812 | rs10757274 | C9p21 | G | GEN | hist | AG | 69 | 629 |
| hCV2442143 | rs12544854 | ASAH1 | T | GEN | no hist | TT | 26 | 393 |
| hCV8942032 | rs1264352 | DDR1 | C | GEN | no hist | CG | 37 | 550 |
| hCV8942032 | rs1264352 | DDR1 | C | DOM | no hist | CC + CG | 41 | 616 |
| hCV16158671 | rs2200733 | C4 | T | GEN | hist | TT | 3 | 10 |
| hCV27504565 | rs3219489 | MUTYH | C | GEN | hist | CG | 35 | 465 |
| hCV27504565 | rs3219489 | MUTYH | C | DOM | hist | GG + CG | 41 | 523 |
| hCV27511436 | rs3750145 | FZD1 | T | DOM | ALL | CC + CT | 50 | 804 |
| hCV27511436 | rs3750145 | FZD1 | T | GEN | no hist | CT | 16 | 414 |
| hCV27511436 | rs3750145 | FZD1 | T | DOM | no hist | CC + CT | 19 | 460 |

| hCV # | HR_PLACEBO | LOWER_PLACEBO | UPPER_PLACEBO | P_PLACEBO | EVENTS_ALL | no event | HR_ALL | P_ALL |
|---|---|---|---|---|---|---|---|---|
| hCV2091644 | 1.509818 | 1.030611 | 2.211844 | 0.0344528 | 88 | 951 | 1.340598 | 0.0511049 |
| hCV2091644 | 1.242162 | 0.916407 | 1.683713 | 0.1622853 | | | | |
| hCV2091644 | 1.452091 | 0.820968 | 2.568392 | 0.1998539 | 34 | 523 | 1.033962 | 0.91230651 |
| hCV2091644 | 1.503005 | 0.897908 | 2.515874 | 0.1210805 | 54 | 428 | 1.633661 | 0.0141837 |
| hCV26505812 | 1.464442 | 1.027673 | 2.086842 | 0.0347703 | 215 | 2683 | 1.118574 | 0.41790129 |
| hCV26505812 | 1.381146 | 0.981881 | 1.942766 | 0.0636069 | | | | |
| hCV26505812 | 1.507129 | 0.820845 | 2.767193 | 0.1857813 | 47 | 674 | 1.215134 | 0.39336777 |
| hCV26505812 | 1.482778 | 0.876794 | 2.50758 | 0.1417039 | 87 | 1528 | 0.992161 | 1 |
| hCV26505812 | 1.489002 | 0.900117 | 2.463154 | 0.1210931 | | | | |
| hCV26505812 | 1.372228 | 0.849193 | 2.217411 | 0.196237 | 128 | 1155 | 1.185801 | 0.35086569 |
| hCV2442143 | 1.479057 | 0.825673 | 2.649492 | 0.1881955 | 41 | 704 | 1.173733 | 0.49295851 |
| hCV8942032 | 1.324522 | 0.870367 | 2.015654 | 0.1895578 | 61 | 972 | 1.10852 | 0.55960326 |
| hCV8942032 | 1.305687 | 0.868558 | 1.962816 | 0.1996948 | | | | |
| hCV16158671 | 3.711451 | 1.175206 | 11.72124 | 0.0254095 | 4 | 18 | 2.311594 | 0.12421295 |
| hCV27504565 | 0.708031 | 0.473602 | 1.0585 | 0.092402 | 69 | 853 | 0.726379 | 0.04027681 |
| hCV27504565 | 0.741641 | 0.506363 | 1.08624 | 0.1247589 | | | | |
| hCV27511436 | 0.80098 | 0.583058 | 1.100353 | 0.1707752 | | | | |
| hCV27511436 | 0.603398 | 0.351722 | 1.035162 | 0.066584 | 42 | 805 | 0.824734 | 0.33847297 |
| hCV27511436 | 0.646002 | 0.390525 | 1.068608 | 0.0888378 | | | | |

TABLE 31

| hCV # | rs # | Gene/Chrom symbol | Risk Allele | MODE | STRATA | GENO_RESP | STATIN | EVENTS_RESP |
|---|---|---|---|---|---|---|---|---|
| hCV2091644 | rs1010 | VAMP8 | C | DOM | no hist | CC + CT | pravastatin | 50 |
| hCV2091644 | rs1010 | VAMP8 | C | DOM | no hist | CC + CT | placebo | 67 |
| hCV29539757 | rs10110659 | KCNQ3 | C | REC | hist | CC + AC | pravastatin | 106 |
| hCV29539757 | rs10110659 | KCNQ3 | C | REC | hist | CC + AC | placebo | 100 |
| hCV26505812 | rs10757274 | C9p21 | G | GEN | ALL | GG | pravastatin | 51 |
| hCV26505812 | rs10757274 | C9p21 | G | GEN | ALL | GG | placebo | 48 |
| hCV26505812 | rs10757274 | C9p21 | G | GEN | ALL | AG | pravastatin | 94 |
| hCV26505812 | rs10757274 | C9p21 | G | GEN | ALL | AG | placebo | 121 |
| hCV26505812 | rs10757274 | C9p21 | G | GEN | ALL | AA | pravastatin | 56 |
| hCV26505812 | rs10757274 | C9p21 | G | GEN | ALL | AA | placebo | 41 |
| hCV26505812 | rs10757274 | C9p21 | G | DOM | ALL | GG + AG | pravastatin | 145 |
| hCV26505812 | rs10757274 | C9p21 | G | DOM | ALL | GG + AG | placebo | 169 |
| hCV26505812 | rs10757274 | C9p21 | G | GEN | no hist | GG | pravastatin | 24 |
| hCV26505812 | rs10757274 | C9p21 | G | GEN | no hist | GG | placebo | 23 |
| hCV26505812 | rs10757274 | C9p21 | G | GEN | no hist | AG | pravastatin | 35 |
| hCV26505812 | rs10757274 | C9p21 | G | GEN | no hist | AG | placebo | 52 |
| hCV26505812 | rs10757274 | C9p21 | G | GEN | no hist | AA | pravastatin | 28 |
| hCV26505812 | rs10757274 | C9p21 | G | GEN | no hist | AA | placebo | 19 |
| hCV26505812 | rs10757274 | C9p21 | G | DOM | no hist | GG + AG | pravastatin | 59 |
| hCV26505812 | rs10757274 | C9p21 | G | DOM | no hist | GG + AG | placebo | 75 |
| hCV2169762 | rs1804689 | HPS1 | T | DOM | no hist | TT + GT | pravastatin | 57 |
| hCV2169762 | rs1804689 | HPS1 | T | DOM | no hist | TT + GT | placebo | 47 |
| hCV2169762 | rs1804689 | HPS1 | T | REC | hist | GG + GT | pravastatin | 109 |
| hCV2169762 | rs1804689 | HPS1 | T | REC | hist | GG + GT | placebo | 102 |

| hCV # | no event | TOTAL_RESP | HR_RESP | LOWER_RESP | UPPER_RESP | P_RESP | P_INT_RESP |
|---|---|---|---|---|---|---|---|
| hCV2091644 | 994 | 1044 | 0.7860368 | 0.54496 | 1.13377 | 0.19768 | 0.0837336 |
| hCV2091644 | 1033 | 1100 | | | | | 0.0837336 |
| hCV29539757 | 1087 | 1193 | 1.0088023 | 0.76761 | 1.32578 | 0.94987 | 0.0530448 |
| hCV29539757 | 1040 | 1140 | | | | | 0.0530448 |

TABLE 31-continued

| | | | | | | | |
|---|---|---|---|---|---|---|---|
| hCV26505812 | 638 | 689 | 1.0816406 | 0.7293 | 1.60421 | 0.69635 | 0.0696553 |
| hCV26505812 | 653 | 701 | | | | | 0.0696553 |
| hCV26505812 | 1349 | 1443 | 0.7768621 | 0.59335 | 1.01713 | 0.06629 | 0.0696553 |
| hCV26505812 | 1334 | 1455 | | | | | 0.0696553 |
| hCV26505812 | 674 | 730 | 1.3304985 | 0.88923 | 1.99075 | 0.16486 | 0.0696553 |
| hCV26505812 | 680 | 721 | | | | | 0.0696553 |
| hCV26505812 | 1987 | 2132 | 0.8638087 | 0.69193 | 1.07838 | 0.1959 | 0.0630809 |
| hCV26505812 | 1987 | 2156 | | | | | 0.0630809 |
| hCV26505812 | 333 | 357 | 1.0681052 | 0.6028 | 1.89259 | 0.82141 | 0.0828923 |
| hCV26505812 | 341 | 364 | | | | | 0.0828923 |
| hCV26505812 | 754 | 789 | 0.6977172 | 0.45454 | 1.071 | 0.09971 | 0.0828923 |
| hCV26505812 | 774 | 826 | | | | | 0.0828923 |
| hCV26505812 | 395 | 423 | 1.5704654 | 0.87695 | 2.81243 | 0.12894 | 0.0828923 |
| hCV26505812 | 424 | 443 | | | | | 0.0828923 |
| hCV26505812 | 1087 | 1146 | 0.8131888 | 0.57817 | 1.14374 | 0.23474 | 0.0573322 |
| hCV26505812 | 1115 | 1190 | | | | | 0.0573322 |
| hCV2169762 | 731 | 788 | 1.2655756 | 0.86016 | 1.86208 | 0.23193 | 0.033 |
| hCV2169762 | 777 | 824 | | | | | 0.033 |
| hCV2169762 | 1063 | 1172 | 1.0276801 | 0.7845 | 1.34624 | 0.84289 | 0.0507564 |
| hCV2169762 | 1035 | 1137 | | | | | 0.0507564 |

TABLE 32

| hCV # | rs # | Gene/Chrom symbol | Risk Allele | MODE | STRATA | GENO_RESP | STATIN | EVENTS_RESP |
|---|---|---|---|---|---|---|---|---|
| hCV2091644 | rs1010 | VAMP8 | C | GEN | no hist | CC | pravastatin | 13 |
| hCV2091644 | rs1010 | VAMP8 | C | GEN | no hist | CC | placebo | 21 |
| hCV2091644 | rs1010 | VAMP8 | C | GEN | no hist | CT | pravastatin | 37 |
| hCV2091644 | rs1010 | VAMP8 | C | GEN | no hist | CT | placebo | 46 |
| hCV2091644 | rs1010 | VAMP8 | C | GEN | no hist | TT | pravastatin | 36 |
| hCV2091644 | rs1010 | VAMP8 | C | GEN | no hist | TT | placebo | 27 |
| hCV2091644 | rs1010 | VAMP8 | C | DOM | no hist | CC + CT | pravastatin | 50 |
| hCV2091644 | rs1010 | VAMP8 | C | DOM | no hist | CC + CT | placebo | 67 |
| hCV29539757 | rs10110659 | KCNQ3 | C | GEN | hist | AA | pravastatin | 7 |
| hCV29539757 | rs10110659 | KCNQ3 | C | GEN | hist | AA | placebo | 16 |
| hCV29539757 | rs10110659 | KCNQ3 | C | GEN | hist | AC | pravastatin | 44 |
| hCV29539757 | rs10110659 | KCNQ3 | C | GEN | hist | AC | placebo | 44 |
| hCV29539757 | rs10110659 | KCNQ3 | C | GEN | hist | CC | pravastatin | 62 |
| hCV29539757 | rs10110659 | KCNQ3 | C | GEN | hist | CC | placebo | 56 |
| hCV29539757 | rs10110659 | KCNQ3 | C | REC | hist | CC + AC | pravastatin | 106 |
| hCV29539757 | rs10110659 | KCNQ3 | C | REC | hist | CC + AC | placebo | 100 |
| hCV26505812 | rs10757274 | C9p21 | G | GEN | ALL | GG | pravastatin | 51 |
| hCV26505812 | rs10757274 | C9p21 | G | GEN | ALL | GG | placebo | 48 |
| hCV26505812 | rs10757274 | C9p21 | G | GEN | ALL | AG | pravastatin | 94 |
| hCV26505812 | rs10757274 | C9p21 | G | GEN | ALL | AG | placebo | 121 |
| hCV26505812 | rs10757274 | C9p21 | G | GEN | ALL | AA | pravastatin | 56 |
| hCV26505812 | rs10757274 | C9p21 | G | GEN | ALL | AA | placebo | 41 |
| hCV26505812 | rs10757274 | C9p21 | G | DOM | ALL | GG + AG | pravastatin | 145 |
| hCV26505812 | rs10757274 | C9p21 | G | DOM | ALL | GG + AG | placebo | 169 |
| hCV26505812 | rs10757274 | C9p21 | G | GEN | no hist | GG | pravastatin | 24 |
| hCV26505812 | rs10757274 | C9p21 | G | GEN | no hist | GG | placebo | 23 |
| hCV26505812 | rs10757274 | C9p21 | G | GEN | no hist | AG | pravastatin | 35 |
| hCV26505812 | rs10757274 | C9p21 | G | GEN | no hist | AG | placebo | 52 |
| hCV26505812 | rs10757274 | C9p21 | G | GEN | no hist | AA | pravastatin | 28 |
| hCV26505812 | rs10757274 | C9p21 | G | GEN | no hist | AA | placebo | 19 |
| hCV26505812 | rs10757274 | C9p21 | G | DOM | no hist | GG + AG | pravastatin | 59 |
| hCV26505812 | rs10757274 | C9p21 | G | DOM | no hist | GG + AG | placebo | 75 |
| hCV2442143 | rs12544854 | ASAH1 | T | REC | no hist | CC + CT | pravastatin | 72 |
| hCV2442143 | rs12544854 | ASAH1 | T | REC | no hist | CC + CT | placebo | 68 |
| hCV2442143 | rs12544854 | ASAH1 | T | DOM | hist | TT + CT | pravastatin | 88 |
| hCV2442143 | rs12544854 | ASAH1 | T | DOM | hist | TT + CT | placebo | 82 |
| hCV27830265 | rs12762303 | ALOX5 | G | DOM | no hist | GG + AG | pravastatin | 25 |
| hCV27830265 | rs12762303 | ALOX5 | G | DOM | no hist | GG + AG | placebo | 16 |
| hCV2169762 | rs1804689 | HPS1 | T | GEN | no hist | TT | pravastatin | 10 |
| hCV2169762 | rs1804689 | HPS1 | T | GEN | no hist | TT | placebo | 9 |
| hCV2169762 | rs1804689 | HPS1 | T | GEN | no hist | GT | pravastatin | 47 |
| hCV2169762 | rs1804689 | HPS1 | T | GEN | no hist | GT | placebo | 38 |
| hCV2169762 | rs1804689 | HPS1 | T | GEN | no hist | GG | pravastatin | 30 |
| hCV2169762 | rs1804689 | HPS1 | T | GEN | no hist | GG | placebo | 47 |
| hCV2169762 | rs1804689 | HPS1 | T | DOM | no hist | TT + GT | pravastatin | 57 |
| hCV2169762 | rs1804689 | HPS1 | T | DOM | no hist | TT + GT | placebo | 47 |
| hCV2169762 | rs1804689 | HPS1 | T | GEN | hist | TT | pravastatin | 5 |
| hCV2169762 | rs1804689 | HPS1 | T | GEN | hist | TT | placebo | 12 |
| hCV2169762 | rs1804689 | HPS1 | T | GEN | hist | GT | pravastatin | 47 |
| hCV2169762 | rs1804689 | HPS1 | T | GEN | hist | GT | placebo | 46 |

TABLE 32-continued

| hCV # | rs | gene | allele | model | hist | geno | treatment | n |
|---|---|---|---|---|---|---|---|---|
| hCV2169762 | rs1804689 | HPS1 | T | GEN | hist | GG | pravastatin | 62 |
| hCV2169762 | rs1804689 | HPS1 | T | GEN | hist | GG | placebo | 56 |
| hCV2169762 | rs1804689 | HPS1 | T | REC | hist | GG + GT | pravastatin | 109 |
| hCV2169762 | rs1804689 | HPS1 | T | REC | hist | GG + GT | placebo | 102 |
| hCV1348610 | rs3739636 | C9orf46 | A | GEN | hist | AA | pravastatin | 24 |
| hCV1348610 | rs3739636 | C9orf46 | A | GEN | hist | AA | placebo | 19 |
| hCV1348610 | rs3739636 | C9orf46 | A | GEN | hist | AG | pravastatin | 47 |
| hCV1348610 | rs3739636 | C9orf46 | A | GEN | hist | AG | placebo | 61 |
| hCV1348610 | rs3739636 | C9orf46 | A | GEN | hist | GG | pravastatin | 43 |
| hCV1348610 | rs3739636 | C9orf46 | A | GEN | hist | GG | placebo | 35 |
| hCV1348610 | rs3739636 | C9orf46 | A | DOM | hist | AA + AG | pravastatin | 71 |
| hCV1348610 | rs3739636 | C9orf46 | A | DOM | hist | AA + AG | placebo | 80 |
| hCV27511436 | rs3750145 | FZD1 | T | GEN | no hist | CC | pravastatin | 1 |
| hCV27511436 | rs3750145 | FZD1 | T | GEN | no hist | CC | placebo | 3 |
| hCV27511436 | rs3750145 | FZD1 | T | GEN | no hist | CT | pravastatin | 26 |
| hCV27511436 | rs3750145 | FZD1 | T | GEN | no hist | CT | placebo | 16 |
| hCV27511436 | rs3750145 | FZD1 | T | GEN | no hist | TT | pravastatin | 60 |
| hCV27511436 | rs3750145 | FZD1 | T | GEN | no hist | TT | placebo | 75 |
| hCV27511436 | rs3750145 | FZD1 | T | DOM | no hist | CC + CT | pravastatin | 27 |
| hCV27511436 | rs3750145 | FZD1 | T | DOM | no hist | CC + CT | placebo | 19 |

| hCV # | no event | TOTAL_RESP | HR_RESP | LOWER_RESP | UPPER_RESP | P_RESP | P_INT_RESP |
|---|---|---|---|---|---|---|---|
| hCV2091644 | 258 | 271 | 0.635895 | 0.31841 | 1.26996 | 0.199563 | 0.1798335 |
| hCV2091644 | 265 | 286 | | | | | 0.1798335 |
| hCV2091644 | 736 | 773 | 0.850356 | 0.5516 | 1.31092 | 0.462931 | 0.1798335 |
| hCV2091644 | 768 | 814 | | | | | 0.1798335 |
| hCV2091644 | 492 | 528 | 1.358113 | 0.82457 | 2.2369 | 0.22925 | 0.1798335 |
| hCV2091644 | 510 | 537 | | | | | 0.1798335 |
| hCV2091644 | 994 | 1044 | 0.786037 | 0.54496 | 1.13377 | 0.197677 | 0.0837336 |
| hCV2091644 | 1033 | 1100 | | | | | 0.0837336 |
| hCV29539757 | 96 | 103 | 0.411487 | 0.16926 | 1.00034 | 0.050088 | 0.1548877 |
| hCV29539757 | 92 | 108 | | | | | 0.1548877 |
| hCV29539757 | 493 | 537 | 0.994615 | 0.6549 | 1.51055 | 0.979793 | 0.1548877 |
| hCV29539757 | 481 | 525 | | | | | 0.1548877 |
| hCV29539757 | 594 | 656 | 1.015618 | 0.70762 | 1.45767 | 0.93301 | 0.1548877 |
| hCV29539757 | 559 | 615 | | | | | 0.1548877 |
| hCV29539757 | 1087 | 1193 | 1.008802 | 0.76761 | 1.32578 | 0.949874 | 0.0530448 |
| hCV29539757 | 1040 | 1140 | | | | | 0.0530448 |
| hCV26505812 | 638 | 689 | 1.081641 | 0.7293 | 1.60421 | 0.696354 | 0.0696553 |
| hCV26505812 | 653 | 701 | | | | | 0.0696553 |
| hCV26505812 | 1349 | 1443 | 0.776862 | 0.59335 | 1.01713 | 0.066291 | 0.0696553 |
| hCV26505812 | 1334 | 1455 | | | | | 0.0696553 |
| hCV26505812 | 674 | 730 | 1.330498 | 0.88923 | 1.99075 | 0.164856 | 0.0696553 |
| hCV26505812 | 680 | 721 | | | | | 0.0696553 |
| hCV26505812 | 1987 | 2132 | 0.863809 | 0.69193 | 1.07838 | 0.195899 | 0.0630809 |
| hCV26505812 | 1987 | 2156 | | | | | 0.0630809 |
| hCV26505812 | 333 | 357 | 1.068105 | 0.6028 | 1.89259 | 0.821407 | 0.0828923 |
| hCV26505812 | 341 | 364 | | | | | 0.0828923 |
| hCV26505812 | 754 | 789 | 0.697717 | 0.45454 | 1.071 | 0.099711 | 0.0828923 |
| hCV26505812 | 774 | 826 | | | | | 0.0828923 |
| hCV26505812 | 395 | 423 | 1.570465 | 0.87695 | 2.81243 | 0.128942 | 0.0828923 |
| hCV26505812 | 424 | 443 | | | | | 0.0828923 |
| hCV26505812 | 1087 | 1146 | 0.813189 | 0.57817 | 1.14374 | 0.234739 | 0.0573322 |
| hCV26505812 | 1115 | 1190 | | | | | 0.0573322 |
| hCV2442143 | 1146 | 1218 | 1.087339 | 0.78059 | 1.51463 | 0.620489 | 0.1385034 |
| hCV2442143 | 1175 | 1243 | | | | | 0.1385034 |
| hCV2442143 | 865 | 953 | 1.043307 | 0.77225 | 1.4095 | 0.78239 | 0.1787787 |
| hCV2442143 | 850 | 932 | | | | | 0.1787787 |
| hCV27830265 | 474 | 499 | 1.479294 | 0.78982 | 2.77065 | 0.22133 | 0.1332561 |
| hCV27830265 | 445 | 461 | | | | | 0.1332561 |
| hCV2169762 | 127 | 137 | 1.27501 | 0.51771 | 3.14008 | 0.597269 | 0.102835 |
| hCV2169762 | 145 | 154 | | | | | 0.102835 |
| hCV2169762 | 604 | 651 | 1.268286 | 0.82701 | 1.94501 | 0.27599 | 0.102835 |
| hCV2169762 | 632 | 670 | | | | | 0.102835 |
| hCV2169762 | 753 | 783 | 0.65902 | 0.41685 | 1.04187 | 0.074354 | 0.102835 |
| hCV2169762 | 763 | 810 | | | | | 0.102835 |
| hCV2169762 | 731 | 788 | 1.265576 | 0.86016 | 1.86208 | 0.231932 | 0.033 |
| hCV2169762 | 777 | 824 | | | | | 0.033 |
| hCV2169762 | 119 | 124 | 0.336546 | 0.11847 | 0.95606 | 0.040922 | 0.1254774 |
| hCV2169762 | 99 | 111 | | | | | 0.1254774 |
| hCV2169762 | 511 | 558 | 0.94255 | 0.62771 | 1.4153 | 0.775439 | 0.1254774 |
| hCV2169762 | 480 | 526 | | | | | 0.1254774 |
| hCV2169762 | 552 | 614 | 1.104484 | 0.76954 | 1.58521 | 0.589855 | 0.1254774 |
| hCV2169762 | 555 | 611 | | | | | 0.1254774 |
| hCV2169762 | 1063 | 1172 | 1.02768 | 0.7845 | 1.34624 | 0.842894 | 0.0507564 |
| hCV2169762 | 1035 | 1137 | | | | | 0.0507564 |
| hCV1348610 | 226 | 250 | 0.986092 | 0.54 | 1.80071 | 0.963642 | 0.1842815 |
| hCV1348610 | 186 | 205 | | | | | 0.1842815 |

TABLE 32-continued

| hCV# | | | | | | | |
|---|---|---|---|---|---|---|---|
| hCV1348610 | 566 | 613 | 0.740596 | 0.50624 | 1.08345 | 0.121846 | 0.1842815 |
| hCV1348610 | 545 | 606 | | | | | 0.1842815 |
| hCV1348610 | 378 | 421 | 1.276897 | 0.81723 | 1.99511 | 0.283036 | 0.1842815 |
| hCV1348610 | 392 | 427 | | | | | 0.1842815 |
| hCV1348610 | 792 | 863 | 0.806434 | 0.58581 | 1.11014 | 0.187096 | 0.1002517 |
| hCV1348610 | 731 | 811 | | | | | 0.1002517 |
| hCV27511436 | 42 | 43 | 0.349207 | 0.03631 | 3.35808 | 0.362284 | 0.1652143 |
| hCV27511436 | 43 | 46 | | | | | 0.1652143 |
| hCV27511436 | 407 | 433 | 1.575251 | 0.84504 | 2.93645 | 0.152693 | 0.1652143 |
| hCV27511436 | 398 | 414 | | | | | 0.1652143 |
| hCV27511436 | 1035 | 1095 | 0.85237 | 0.60701 | 1.19691 | 0.356417 | 0.1652143 |
| hCV27511436 | 1099 | 1174 | | | | | 0.1652143 |
| hCV27511436 | 449 | 476 | 1.387947 | 0.77175 | 2.49613 | 0.273626 | 0.1600111 |
| hCV27511436 | 441 | 460 | | | | | 0.1600111 |

TABLE 33

| hCV # | rs # | gene/chrom symbol | ENDPT | MODE | STRATA | ADJUST | GENOTYPE |
|---|---|---|---|---|---|---|---|
| hCV1348610 | rs3739636 | C9orf46 | ATHERO | GEN | WHITE | AGEBL GEND01 | AG |
| hCV15857769 | rs2924914 | | ATHERO | GEN | WHITE | AGEBL GEND01 | TT |
| hCV15857769 | rs2924914 | | ATHERO | REC | WHITE | AGEBL GEND01 | TT |
| hCV15857769 | rs2924914 | | ATHERO | ADD | WHITE | AGEBL GEND01 | T |
| hCV15857769 | rs2924914 | | ATHERO | GEN | WHITE | AGEBL GEND01 BMI PRESSM DIABADA HTN LDLADJBL HDL44BL | TT |
| hCV15857769 | rs2924914 | | ATHERO | REC | WHITE | AGEBL GEND01 BMI PRESSM DIABADA HTN LDLADJBL HDL44BL | TT |
| hCV15857769 | rs2924914 | | ISCHEM | GEN | WHITE | AGEBL GEND01 | TT |
| hCV15857769 | rs2924914 | | ISCHEM | REC | WHITE | AGEBL GEND01 | TT |
| hCV15857769 | rs2924914 | | ISCHEM | ADD | WHITE | AGEBL GEND01 | T |
| hCV15857769 | rs2924914 | | ISCHEM | GEN | WHITE | AGEBL GEND01 BMI PRESSM DIABADA HTN LDLADJBL HDL44BL | TT |
| hCV15857769 | rs2924914 | | ISCHEM | ADD | WHITE | AGEBL GEND01 BMI PRESSM DIABADA HTN LDLADJBL HDL44BL | T |
| hCV15857769 | rs2924914 | | STROKE | GEN | WHITE | AGEBL GEND01 | TT |
| hCV16336 | rs362277 | HD | STROKE | ADD | WHITE | AGEBL GEND01 | C |
| hCV30308202 | rs9482985 | LAMA2 | ISCHEM | REC | WHITE | AGEBL GEND01 | GG |
| hCV30308202 | rs9482985 | LAMA2 | ISCHEM | REC | WHITE | AGEBL GEND01 BMI PRESSM DIABADA HTN LDLADJBL HDL44BL | GG |

| hCV # | EVENTS | TOTAL | HR | 95% Lower CL for HR | 95% Upper CL for HR | P-VALUE 2-sided) | 2DF P-VALUE |
|---|---|---|---|---|---|---|---|
| hCV1348610 | 147 | 1809 | 1.28 | 0.97 | 1.70 | 0.087 | 0.232 |
| hCV15857769 | 31 | 310 | 1.52 | 1.03 | 2.26 | 0.036 | 0.111 |
| hCV15857769 | 31 | 310 | 1.47 | 1.01 | 2.13 | 0.046 | . |
| hCV15857769 | . | . | 1.19 | 0.99 | 1.43 | 0.066 | . |
| hCV15857769 | 30 | 300 | 1.46 | 0.98 | 2.17 | 0.067 | 0.186 |
| hCV15857769 | 30 | 300 | 1.4 | 0.96 | 2.06 | 0.083 | . |
| hCV15857769 | 41 | 310 | 1.42 | 1.01 | 1.99 | 0.044 | 0.127 |
| hCV15857769 | 41 | 310 | 1.36 | 0.98 | 1.88 | 0.064 | . |
| hCV15857769 | . | . | 1.16 | 0.99 | 1.35 | 0.060 | . |
| hCV15857769 | 40 | 300 | 1.36 | 0.97 | 1.93 | 0.078 | 0.202 |
| hCV15857769 | . | . | 1.14 | 0.98 | 1.34 | 0.093 | . |

TABLE 33-continued

| hCV15857769 | 48 | 310 | 1.32 | 0.96 | 1.80 | 0.084 | 0.220 |
|---|---|---|---|---|---|---|---|
| hCV16336 | . | . | 1.2 | 0.97 | 1.49 | 0.093 | . |
| hCV30308202 | 280 | 2509 | 1.21 | 0.98 | 1.50 | 0.080 | . |
| hCV30308202 | 275 | 2458 | 1.21 | 0.98 | 1.51 | 0.080 | . |

TABLE 34

| hCV # | rs # | gene/chrom symbol | ENDPT | MODE | STRATA | ADJUST | GENOTYPE |
|---|---|---|---|---|---|---|---|
| hCV1348610 | rs3739636 | C9orf46 | ATHERO | GEN | BLACK | AGEBL GEND01 BMI PRESSM DIABADA HTN LDLADJBL HDL44BL | AA |
| hCV1348610 | rs3739636 | C9orf46 | ATHERO | ADD | BLACK | AGEBL GEND01 BMI PRESSM DIABADA HTN LDLADJBL HDL44BL | A |
| hCV1348610 | rs3739636 | C9orf46 | ISCHEM | GEN | BLACK | AGEBL GEND01 BMI PRESSM DIABADA HTN LDLADJBL HDL44BL | AA |
| hCV1348610 | rs3739636 | C9orf46 | ISCHEM | ADD | BLACK | AGEBL GEND01 BMI PRESSM DIABADA HTN LDLADJBL HDL44BL | A |
| hCV1348610 | rs3739636 | C9orf46 | STROKE | GEN | BLACK | AGEBL GEND01 BMI PRESSM DIABADA HTN LDLADJBL HDL44BL | AA |
| hCV1348610 | rs3739636 | C9orf46 | STROKE | REC | BLACK | AGEBL GEND01 BMI PRESSM DIABADA HTN LDLADJBL HDL44BL | AA |
| hCV1348610 | rs3739636 | C9orf46 | STROKE | ADD | BLACK | AGEBL GEND01 BMI PRESSM DIABADA HTN LDLADJBL HDL44BL | A |
| hCV1619596 | rs1048621 | SDCBP2 | ISCHEM | GEN | BLACK | AGEBL GEND01 | AA |
| hCV1619596 | rs1048621 | SDCBP2 | ISCHEM | REC | BLACK | AGEBL GEND01 | AA |
| hCV1619596 | rs1048621 | SDCBP2 | ISCHEM | GEN | BLACK | AGEBL GEND01 BMI PRESSM DIABADA HTN LDLADJBL HDL44BL | AA |
| hCV1619596 | rs1048621 | SDCBP2 | ISCHEM | REC | BLACK | AGEBL GEND01 BMI PRESSM DIABADA HTN LDLADJBL HDL44BL | AA |
| hCV1619596 | rs1048621 | SDCBP2 | STROKE | GEN | BLACK | AGEBL GEND01 | AA |
| hCV1619596 | rs1048621 | SDCBP2 | STROKE | REC | BLACK | AGEBL GEND01 | AA |
| hCV1619596 | rs1048621 | SDCBP2 | STROKE | GEN | BLACK | AGEBL GEND01 BMI PRESSM DIABADA HTN LDLADJBL HDL44BL | AA |
| hCV1619596 | rs1048621 | SDCBP2 | STROKE | REC | BLACK | AGEBL GEND01 BMI PRESSM DIABADA HTN LDLADJBL HDL44BL | AA |
| hCV16336 | rs362277 | HD | ISCHEM | GEN | BLACK | AGEBL GEND01 | CT |
| hCV16336 | rs362277 | HD | ISCHEM | GEN | BLACK | AGEBL GEND01 BMI PRESSM DIABADA HTN LDLADJBL HDL44BL | CT |

TABLE 34-continued

| hCV1723718 | rs12481805 | UMOD L1 | ATHERO | GEN | BLACK | AGEBL GEND01 | AA |
| hCV1723718 | rs12481805 | UMOD L1 | ATHERO | REC | BLACK | AGEBL GEND01 | AA |
| hCV1723718 | rs12481805 | UMOD L1 | ATHERO | GEN | BLACK | AGEBL GEND01 BMI PRESSM DIABADA HTN LDLADJBL HDL44BL | AA |
| hCV1723718 | rs12481805 | UMOD L1 | ATHERO | REC | BLACK | AGEBL GEND01 BMI PRESSM DIABADA HTN LDLADJBL HDL44BL | AA |
| hCV1723718 | rs12481805 | UMOD L1 | ISCHEM | GEN | BLACK | AGEBL GEND01 | AA |
| hCV1723718 | rs12481805 | UMOD L1 | ISCHEM | REC | BLACK | AGEBL GEND01 | AA |
| hCV1723718 | rs12481805 | UMOD L1 | ISCHEM | GEN | BLACK | AGEBL GEND01 BMI PRESSM DIABADA HTN LDLADJBL HDL44BL | AA |
| hCV1723718 | rs12481805 | UMOD L1 | ISCHEM | REC | BLACK | AGEBL GEND01 BMI PRESSM DIABADA HTN LDLADJBL HDL44BL | AA |
| hCV25596936 | rs6967117 | EPHA1 | STROKE | GEN | BLACK | AGEBL GEND01 BMI PRESSM DIABADA HTN LDLADJBL HDL44BL | TT |
| hCV25596936 | rs6967117 | EPHA1 | STROKE | REC | BLACK | AGEBL GEND01 BMI PRESSM DIABADA HTN LDLADJBL HDL44BL | TT |
| hCV27077072 | rs8060368 | | ATHERO | REC | BLACK | AGEBL GEND01 | CC |
| hCV27077072 | rs8060368 | | ATHERO | ADD | BLACK | AGEBL GEND01 | C |
| hCV27077072 | rs8060368 | | ATHERO | ADD | BLACK | AGEBL GEND01 BMI PRESSM DIABADA HTN LDLADJBL HDL44BL | C |
| hCV27077072 | rs8060368 | | ISCHEM | ADD | BLACK | AGEBL GEND01 | C |
| hCV8754449 | rs781226 | TESK2 | ATHERO | GEN | BLACK | AGEBL GEND01 BMI PRESSM DIABADA HTN LDLADJBL HDL44BL | CT |
| hCV8754449 | rs781226 | TESK2 | ISCHEM | GEN | BLACK | AGEBL GEND01 BMI PRESSM DIABADA HTN LDLADJBL HDL44BL | CT |

| hCV # | EVENTS | TOTAL | HR | 95% Lower CL for HR | 95% Upper CL for HR | P-VALUE (2-sided) | 2DF P-VALUE |
| --- | --- | --- | --- | --- | --- | --- | --- |
| hCV1348610 | 17 | 151 | 2.03 | 0.93 | 4.40 | 0.074 | 0.203 |
| hCV1348610 | . | . | 1.41 | 0.97 | 2.06 | 0.073 | . |
| hCV1348610 | 20 | 151 | 1.83 | 0.91 | 3.67 | 0.089 | 0.214 |
| hCV1348610 | . | . | 1.36 | 0.96 | 1.93 | 0.085 | . |
| hCV1348610 | 25 | 151 | 1.75 | 0.94 | 3.23 | 0.076 | 0.173 |
| hCV1348610 | 25 | 151 | 1.56 | 0.96 | 2.54 | 0.075 | . |
| hCV1348610 | . | . | 1.33 | 0.98 | 1.82 | 0.072 | . |
| hCV1619596 | 6 | 22 | 2.36 | 1.00 | 5.60 | 0.051 | 0.150 |
| hCV1619596 | 6 | 22 | 2.28 | 0.98 | 5.32 | 0.055 | . |
| hCV1619596 | 5 | 20 | 2.66 | 1.02 | 6.90 | 0.045 | 0.133 |
| hCV1619596 | 5 | 20 | 2.54 | 1.00 | 6.46 | 0.050 | . |
| hCV1619596 | 7 | 22 | 2.15 | 0.97 | 4.75 | 0.059 | 0.165 |
| hCV1619596 | 7 | 22 | 2.12 | 0.97 | 4.61 | 0.059 | . |
| hCV1619596 | 6 | 20 | 2.24 | 0.95 | 5.31 | 0.067 | 0.185 |
| hCV1619596 | 6 | 20 | 2.2 | 0.95 | 5.14 | 0.068 | . |
| hCV16336 | 43 | 326 | 1.68 | 0.92 | 3.07 | 0.094 | 0.083 |
| hCV16336 | 41 | 309 | 1.95 | 1.02 | 3.71 | 0.043 | 0.033 |
| hCV1723718 | 3 | 8 | 3.95 | 1.21 | 12.91 | 0.023 | 0.046 |
| hCV1723718 | 3 | 8 | 4.15 | 1.28 | 13.49 | 0.018 | . |
| hCV1723718 | 3 | 8 | 3.4 | 1.00 | 11.56 | 0.051 | 0.085 |
| hCV1723718 | 3 | 8 | 3.61 | 1.07 | 12.22 | 0.039 | . |
| hCV1723718 | 3 | 8 | 3.26 | 1.01 | 10.59 | 0.049 | 0.073 |

TABLE 34-continued

| | | | | | | | |
|---|---|---|---|---|---|---|---|
| hCV1723718 | 3 | 8 | 3.46 | 1.07 | 11.17 | 0.038 | . |
| hCV1723718 | 3 | 8 | 3.08 | 0.92 | 10.32 | 0.068 | 0.096 |
| hCV1723718 | 3 | 8 | 3.29 | 0.99 | 10.95 | 0.052 | . |
| hCV25596936 | 1 | 4 | 7 | 0.80 | 61.25 | 0.079 | 0.170 |
| hCV25596936 | 1 | 4 | 6.66 | 0.77 | 58.06 | 0.086 | . |
| hCV27077072 | 48 | 444 | 1.78 | 0.96 | 3.29 | 0.066 | . |
| hCV27077072 | . | . | 1.82 | 1.03 | 3.24 | 0.041 | . |
| hCV27077072 | . | . | 1.64 | 0.91 | 2.95 | 0.097 | . |
| hCV27077072 | . | . | 1.56 | 0.94 | 2.59 | 0.087 | . |
| hCV8754449 | 35 | 297 | 1.86 | 0.99 | 3.46 | 0.052 | 0.081 |
| hCV8754449 | 39 | 297 | 1.8 | 1.01 | 3.24 | 0.048 | 0.085 |

TABLE 35

| hCV # | rs # | gene/chrom symbol | ENDPT | MODE | STRATA | ADJUST | GENOTYPE |
|---|---|---|---|---|---|---|---|
| hCV11425801 | rs3805953 | PEX6 | ISCHEM | GEN | WHITE | AGEBL GEND01 BMI PRESSM DIABADA HTN LDLADJBL HDL44BL | CT |
| hCV11425801 | rs3805953 | PEX6 | STROKE | GEN | WHITE | AGEBL GEND01 BMI PRESSM DIABADA HTN LDLADJBL HDL44BL | CT |
| hCV1348610 | rs3739636 | C9orf46 | ATHERO | DOM | WHITE | AGEBL GEND01 | AG + AA |
| hCV1348610 | rs3739636 | C9orf46 | ATHERO | GEN | WHITE | AGEBL GEND01 BMI PRESSM DIABADA HTN LDLADJBL HDL44BL | AG |
| hCV1348610 | rs3739636 | C9orf46 | ATHERO | DOM | WHITE | AGEBL GEND01 BMI PRESSM DIABADA HTN LDLADJBL HDL44BL | AG + AA |
| hCV15857769 | rs2924914 | | ATHERO | ADD | WHITE | AGEBL GEND01 BMI PRESSM DIABADA HTN LDLADJBL HDL44BL | T |
| hCV15857769 | rs2924914 | | ISCHEM | DOM | WHITE | AGEBL GEND01 | TC + TT |
| hCV15857769 | rs2924914 | | ISCHEM | REC | WHITE | AGEBL GEND01 BMI PRESSM DIABADA HTN LDLADJBL HDL44BL | TT |
| hCV15857769 | rs2924914 | | STROKE | REC | WHITE | AGEBL GEND01 | TT |
| hCV15857769 | rs2924914 | | STROKE | ADD | WHITE | AGEBL GEND01 | T |
| hCV15857769 | rs2924914 | | STROKE | GEN | WHITE | AGEBL GEND01 BMI PRESSM DIABADA HTN LDLADJBL HDL44BL | TT |
| hCV15857769 | rs2924914 | | STROKE | REC | WHITE | AGEBL GEND01 BMI PRESSM DIABADA HTN LDLADJBL HDL44BL | TT |
| hCV15857769 | rs2924914 | | STROKE | ADD | WHITE | AGEBL GEND01 BMI PRESSM DIABADA HTN LDLADJBL HDL44BL | T |
| hCV16158671 | rs2200733 | | STROKE | GEN | WHITE | AGEBL GEND01 | TT |
| hCV16158671 | rs2200733 | | STROKE | REC | WHITE | AGEBL GEND01 | TT |
| hCV16158671 | rs2200733 | | STROKE | GEN | WHITE | AGEBL GEND01 BMI PRESSM DIABADA HTN LDLADJBL HDL44BL | TT |

TABLE 35-continued

| hCV16158671 | rs2200733 | | STROKE | REC | WHITE | AGEBL GEND01 BMI PRESSM DIABADA HTN LDLADJBL HDL44BL | TT |
|---|---|---|---|---|---|---|---|
| hCV16336 | rs362277 | HD | STROKE | GEN | WHITE | AGEBL GEND01 | CC |
| hCV16336 | rs362277 | HD | STROKE | DOM | WHITE | AGEBL GEND01 | CT + CC |
| hCV16336 | rs362277 | HD | STROKE | REC | WHITE | AGEBL GEND01 | CC |
| hCV16336 | rs362277 | HD | STROKE | ADD | WHITE | AGEBL GEND01 BMI PRESSM DIABADA HTN LDLADJBL HDL44BL | C |
| hCV29401764 | rs7793552 | LOC646588 | ISCHEM | REC | WHITE | AGEBL GEND01 | CC |
| hCV30308202 | rs9482985 | LAMA2 | ISCHEM | ADD | WHITE | AGEBL GEND01 | G |
| hCV30308202 | rs9482985 | LAMA2 | ISCHEM | ADD | WHITE | AGEBL GEND01 BMI PRESSM DIABADA HTN LDLADJBL HDL44BL | G |
| hCV30308202 | rs9482985 | LAMA2 | STROKE | REC | WHITE | AGEBL GEND01 | GG |
| hCV32160712 | rs11079160 | | ATHERO | GEN | WHITE | AGEBL GEND01 | TT |
| hCV32160712 | rs11079160 | | ATHERO | REC | WHITE | AGEBL GEND01 | TT |
| hCV32160712 | rs11079160 | | ATHERO | GEN | WHITE | AGEBL GEND01 BMI PRESSM DIABADA HTN LDLADJBL HDL44BL | TT |
| hCV32160712 | rs11079160 | | ATHERO | REC | WHITE | AGEBL GEND01 BMI PRESSM DIABADA HTN LDLADJBL HDL44BL | TT |

| hCV # | EVENTS | TOTAL | HR | 95% Lower CL for HR | 95% Upper CL for HR | P-VALUE (2-sided) | 2DF P-VALUE |
|---|---|---|---|---|---|---|---|
| hCV11425801 | 206 | 1814 | 1.17 | 0.928 | 1.48 | 0.1834 | 0.1314 |
| hCV11425801 | 254 | 1814 | 1.15 | 0.933 | 1.418 | 0.1894 | 0.1374 |
| hCV1348610 | 205 | 2556 | 1.25 | 0.953 | 1.631 | 0.108 | . |
| hCV1348610 | 143 | 1763 | 1.25 | 0.938 | 1.658 | 0.1286 | 0.3147 |
| hCV1348610 | 201 | 2499 | 1.22 | 0.933 | 1.605 | 0.1444 | . |
| hCV15857769 | . | . | 1.17 | 0.969 | 1.403 | 0.1033 | . |
| hCV15857769 | 187 | 1704 | 1.16 | 0.942 | 1.422 | 0.165 | . |
| hCV15857769 | 40 | 300 | 1.31 | 0.942 | 1.821 | 0.1092 | . |
| hCV15857769 | 48 | 310 | 1.28 | 0.947 | 1.723 | 0.1093 | . |
| hCV15857769 | . | . | 1.12 | 0.974 | 1.288 | 0.1112 | . |
| hCV15857769 | 47 | 300 | 1.29 | 0.939 | 1.766 | 0.1172 | 0.2918 |
| hCV15857769 | 47 | 300 | 1.26 | 0.928 | 1.702 | 0.1394 | . |
| hCV15857769 | . | . | 1.11 | 0.96 | 1.274 | 0.1632 | . |
| hCV16158671 | 16 | 90 | 1.41 | 0.853 | 2.323 | 0.1811 | 0.4076 |
| hCV16158671 | 16 | 90 | 1.4 | 0.85 | 2.306 | 0.1856 | . |
| hCV16158671 | 16 | 88 | 1.48 | 0.895 | 2.443 | 0.1272 | 0.3047 |
| hCV16336 | 408 | 3030 | 2.2 | 0.707 | 6.862 | 0.1734 | 0.2057 |
| hCV16336 | 495 | 3764 | 2.14 | 0.689 | 6.677 | 0.188 | . |
| hCV16336 | 408 | 3030 | 1.19 | 0.944 | 1.49 | 0.1428 | . |
| hCV16336 | . | . | 1.16 | 0.937 | 1.44 | 0.1709 | . |
| hCV29401764 | 199 | 1792 | 1.15 | 0.941 | 1.395 | 0.1757 | . |
| hCV30308202 | . | . | 1.14 | 0.946 | 1.368 | 0.1694 | . |
| hCV30308202 | . | . | 1.14 | 0.949 | 1.374 | 0.1586 | . |
| hCV30308202 | 342 | 2509 | 1.14 | 0.942 | 1.376 | 0.1802 | . |
| hCV32160712 | 13 | 119 | 1.47 | 0.835 | 2.572 | 0.183 | 0.3099 |
| hCV32160712 | 13 | 119 | 1.5 | 0.858 | 2.617 | 0.1551 | . |
| hCV32160712 | 13 | 117 | 1.49 | 0.851 | 2.626 | 0.1621 | 0.2277 |
| hCV32160712 | 13 | 117 | 1.54 | 0.883 | 2.698 | 0.1277 | . |

TABLE 36

| hCV # | rs # | gene/chrom symbol | ENDPT | MODE | STRATA | ADJUST | GENO TYPE |
|---|---|---|---|---|---|---|---|
| hCV11425801 | rs3805953 | PEX6 | ISCHEM | GEN | BLACK | AGEBL GEND01 | CT |
| hCV11425801 | rs3805953 | PEX6 | ISCHEM | GEN | BLACK | AGEBL GEND01 BMI PRESSM DIABADA HTN LDLADJBL HDL44BL | CT |
| hCV11425801 | rs3805953 | PEX6 | STROKE | GEN | BLACK | AGEBL GEND01 | CT |
| hCV11425801 | rs3805953 | PEX6 | STROKE | GEN | BLACK | AGEBL GEND01 BMI PRESSM DIABADA HTN LDLADJBL HDL44BL | CT |
| hCV11425842 | rs10948059 | GNMT | ATHERO | GEN | BLACK | AGEBL GEND01 BMI PRESSM DIABADA HTN LDLADJBL HDL44BL | CC |
| hCV11425842 | rs10948059 | GNMT | ATHERO | REC | BLACK | AGEBL GEND01 BMI PRESSM DIABADA HTN LDLADJBL HDL44BL | CC |
| hCV11425842 | rs10948059 | GNMT | ATHERO | ADD | BLACK | AGEBL GEND01 BMI PRESSM DIABADA HTN LDLADJBL HDL44BL | C |
| hCV11425842 | rs10948059 | GNMT | STROKE | GEN | BLACK | AGEBL GEND01 BMI PRESSM DIABADA HTN LDLADJBL HDL44BL | CC |
| hCV11425842 | rs10948059 | GNMT | STROKE | ADD | BLACK | AGEBL GEND01 BMI PRESSM DIABADA HTN LDLADJBL HDL44BL | C |
| hCV1348610 | rs3739636 | C9orf46 | ATHERO | GEN | BLACK | AGEBL GEND01 | AA |
| hCV1348610 | rs3739636 | C9orf46 | ATHERO | DOM | BLACK | AGEBL GEND01 BMI PRESSM DIABADA HTN LDLADJBL HDL44BL | AG + AA |
| hCV1348610 | rs3739636 | C9orf46 | ATHERO | REC | BLACK | AGEBL GEND01 BMI PRESSM DIABADA HTN LDLADJBL HDL44BL | AA |
| hCV1348610 | rs3739636 | C9orf46 | ISCHEM | REC | BLACK | AGEBL GEND01 BMI PRESSM DIABADA HTN LDLADJBL HDL44BL | AA |
| hCV1619596 | rs1048621 | SDCBP2 | ISCHEM | ADD | BLACK | AGEBL GEND01 | A |
| hCV1619596 | rs1048621 | SDCBP2 | ISCHEM | ADD | BLACK | AGEBL GEND01 BMI PRESSM DIABADA HTN LDLADJBL HDL44BL | A |
| hCV16336 | rs362277 | HD | ATHERO | GEN | BLACK | AGEBL GEND01 BMI PRESSM DIABADA HTN LDLADJBL HDL44BL | CT |
| hCV16336 | rs362277 | HD | ISCHEM | DOM | BLACK | AGEBL GEND01 BMI PRESSM DIABADA HTN LDLADJBL HDL44BL | CT + CC |
| hCV16336 | rs362277 | HD | STROKE | GEN | BLACK | AGEBL GEND01 BMI PRESSM DIABADA HTN LDLADJBL HDL44BL | CT |
| hCV1723718 | rs12481805 | UMODL1 | STROKE | GEN | BLACK | AGEBL GEND01 | AA |
| hCV1723718 | rs12481805 | UMODL1 | STROKE | REC | BLACK | AGEBL GEND01 | AA |

TABLE 36-continued

| hCV# | rs# | Gene | Condition | Model | Race | Covariates | Genotype |
|---|---|---|---|---|---|---|---|
| hCV1723718 | rs12481805 | UMODL1 | STROKE | GEN | BLACK | AGEBL GEND01 BMI PRESSM DIABADA HTN LDLADJBL HDL44BL | AA |
| hCV1723718 | rs12481805 | UMODL1 | STROKE | REC | BLACK | AGEBL GEND01 BMI PRESSM DIABADA HTN LDLADJBL HDL44BL | AA |
| hCV25596936 | rs6967117 | EPHA1 | STROKE | GEN | BLACK | AGEBL GEND01 | TT |
| hCV25596936 | rs6967117 | EPHA1 | STROKE | REC | BLACK | AGEBL GEND01 | TT |
| hCV27077072 | rs8060368 | | ATHERO | REC | BLACK | AGEBL GEND01 BMI PRESSM DIABADA HTN LDLADJBL HDL44BL | CC |
| hCV27077072 | rs8060368 | | ISCHEM | REC | BLACK | AGEBL GEND01 | CC |
| hCV27077072 | rs8060368 | | ISCHEM | ADD | BLACK | AGEBL GEND01 BMI PRESSM DIABADA HTN LDLADJBL HDL44BL | C |
| hCV29401764 | rs7793552 | LOC646588 | STROKE | GEN | BLACK | AGEBL GEND01 | CC |
| hCV29401764 | rs7793552 | LOC646588 | STROKE | REC | BLACK | AGEBL GEND01 | CC |
| hCV29401764 | rs7793552 | LOC646588 | STROKE | GEN | BLACK | AGEBL GEND01 BMI PRESSM DIABADA HTN LDLADJBL HDL44BL | CC |
| hCV29401764 | rs7793552 | LOC646588 | STROKE | REC | BLACK | AGEBL GEND01 BMI PRESSM DIABADA HTN LDLADJBL HDL44BL | CC |
| hCV8754449 | rs781226 | TESK2 | ATHERO | GEN | BLACK | AGEBL GEND01 | CT |
| hCV8754449 | rs781226 | TESK2 | ATHERO | DOM | BLACK | AGEBL GEND01 BMI PRESSM DIABADA HTN LDLADJBL HDL44BL | CT + CC |
| hCV8754449 | rs781226 | TESK2 | ISCHEM | DOM | BLACK | AGEBL GEND01 BMI PRESSM DIABADA HTN LDLADJBL HDL44BL | CT + CC |
| hCV8754449 | rs781226 | TESK2 | STROKE | GEN | BLACK | AGEBL GEND01 BMI PRESSM DIABADA HTN LDLADJBL HDL44BL | CT |
| hCV8942032 | rs1264352 | DDR1 | STROKE | GEN | BLACK | AGEBL GEND01 | CG |
| hCV8942032 | rs1264352 | DDR1 | STROKE | GEN | BLACK | AGEBL GEND01 BMI PRESSM DIABADA HTN LDLADJBL HDL44BL | CG |

| hCV # | EVENTS | TOTAL | HR | 95% Lower CL for HR | 95% Upper CL for HR | P-VALUE (2-sided) | 2DF P-VALUE |
|---|---|---|---|---|---|---|---|
| hCV11425801 | 25 | 184 | 1.4 | 0.853 | 2.286 | 0.1849 | 0.4151 |
| hCV11425801 | 24 | 177 | 1.47 | 0.882 | 2.446 | 0.1399 | 0.3364 |
| hCV11425801 | 30 | 184 | 1.35 | 0.865 | 2.119 | 0.1854 | 0.1546 |
| hCV11425801 | 29 | 177 | 1.39 | 0.88 | 2.209 | 0.1574 | 0.145 |
| hCV11425842 | 19 | 158 | 1.63 | 0.789 | 3.384 | 0.1864 | 0.3447 |
| hCV11425842 | 19 | 158 | 1.5 | 0.857 | 2.628 | 0.1557 | . |
| hCV11425842 | . | . | 1.29 | 0.894 | 1.872 | 0.1716 | . |
| hCV11425842 | 25 | 158 | 1.51 | 0.822 | 2.78 | 0.1837 | 0.4087 |
| hCV11425842 | . | . | 1.23 | 0.908 | 1.664 | 0.181 | . |
| hCV1348610 | 17 | 157 | 1.64 | 0.769 | 3.515 | 0.1995 | 0.4376 |
| hCV1348610 | 39 | 427 | 1.72 | 0.865 | 3.421 | 0.1223 | . |
| hCV1348610 | 17 | 151 | 1.54 | 0.855 | 2.786 | 0.1497 | . |
| hCV1348610 | 20 | 151 | 1.57 | 0.91 | 2.713 | 0.1048 | . |
| hCV1619596 | . | . | 1.33 | 0.902 | 1.954 | 0.1502 | . |
| hCV1619596 | . | . | 1.37 | 0.904 | 2.084 | 0.1373 | . |
| hCV16336 | 34 | 309 | 1.61 | 0.832 | 3.118 | 0.1574 | 0.1458 |
| hCV16336 | 53 | 469 | 1.6 | 0.853 | 3 | 0.1434 | . |

TABLE 36-continued

| | | | | | | | |
|---|---|---|---|---|---|---|---|
| hCV16336 | 48 | 309 | 1.44 | 0.846 | 2.456 | 0.1788 | 0.1231 |
| hCV1723718 | 3 | 8 | 2.45 | 0.763 | 7.88 | 0.1323 | 0.1146 |
| hCV1723718 | 3 | 8 | 2.62 | 0.816 | 8.39 | 0.1057 | . |
| hCV1723718 | 3 | 8 | 2.28 | 0.692 | 7.493 | 0.1755 | 0.1501 |
| hCV1723718 | 3 | 8 | 2.44 | 0.746 | 8.015 | 0.1401 | . |
| hCV25596936 | 1 | 4 | 4.13 | 0.551 | 31.03 | 0.1676 | 0.3443 |
| hCV25596936 | 1 | 4 | 4.04 | 0.539 | 30.26 | 0.1741 | . |
| hCV27077072 | 44 | 423 | 1.59 | 0.852 | 2.96 | 0.1453 | . |
| hCV27077072 | 53 | 444 | 1.48 | 0.859 | 2.566 | 0.1567 | . |
| hCV27077072 | . | . | 1.51 | 0.891 | 2.567 | 0.125 | . |
| hCV29401764 | 13 | 61 | 1.62 | 0.855 | 3.084 | 0.1382 | 0.3119 |
| hCV29401764 | 13 | 61 | 1.58 | 0.873 | 2.848 | 0.1313 | . |
| hCV29401764 | 12 | 57 | 1.62 | 0.836 | 3.15 | 0.1529 | 0.3156 |
| hCV29401764 | 12 | 57 | 1.61 | 0.87 | 2.981 | 0.1291 | . |
| hCV8754449 | 36 | 310 | 1.49 | 0.836 | 2.657 | 0.1758 | 0.1929 |
| hCV8754449 | 43 | 414 | 1.61 | 0.879 | 2.966 | 0.1228 | . |
| hCV8754449 | 49 | 414 | 1.59 | 0.899 | 2.806 | 0.1107 | . |
| hCV8754449 | 46 | 297 | 1.39 | 0.847 | 2.289 | 0.192 | 0.1777 |
| hCV8942032 | 38 | 244 | 1.34 | 0.867 | 2.058 | 0.1894 | 0.1396 |
| hCV8942032 | 36 | 229 | 1.43 | 0.915 | 2.25 | 0.1155 | 0.0872 |

TABLE 37

| hCV # (C9p21 SNP) | rs # (C9p21 SNP) | ADJUST | MODE | GENO-TYPE | STATIN | EVENTS |
|---|---|---|---|---|---|---|
| hCV26505812 | rs10757274 | unadjusted | GEN | AA | Pravastatin | 17 |
| hCV26505812 | rs10757274 | unadjusted | GEN | AA | Placebo | 17 |
| hCV26505812 | rs10757274 | unadjusted | GEN | AG | Pravastatin | 27 |
| hCV26505812 | rs10757274 | unadjusted | GEN | AG | Placebo | 48 |
| hCV26505812 | rs10757274 | unadjusted | GEN | GG | Pravastatin | 23 |
| hCV26505812 | rs10757274 | unadjusted | GEN | GG | Placebo | 25 |
| hCV26505812 | rs10757274 | unadjusted | DOM | AG + AA | Pravastatin | 44 |
| hCV26505812 | rs10757274 | unadjusted | DOM | AG + AA | Placebo | 65 |
| hCV26505812 | rs10757274 | unadjusted | REC | AG + GG | Pravastatin | 50 |
| hCV26505812 | rs10757274 | unadjusted | REC | AG + GG | Placebo | 73 |
| hCV26505812 | rs10757274 | AGE MALE CURRSMK HYPERTEN_1 DIABETES_1 BMI BASE_LDL BASE_HD1 | GEN | AA | Pravastatin | 18 |
| hCV26505812 | rs10757274 | AGE_MALE CURRSMK HYPERTEN_1 DIABETES_1 BMI BASE_EDL BASE_HD1 | GEN | AA | Placebo | 17 |
| hCV26505812 | rs10757274 | AGE_MALE CURRSMK HYPERTEN_1 DIABETES_1 BMI BASE_EDL BASE_HD1 | GEN | GA | Pravastatin | 29 |
| hCV26505812 | rs10757274 | AGE_MALE CURRSMK HYPERTEN_1 DIABETES_1 BMI BASE_EDL BASE_HD1 | GEN | GA | Placebo | 50 |
| hCV26505812 | rs10757274 | AGE MALE CURRSMK HYPERTEN_1 DIABETES_1 BMI BASE_EDL BASE_HD1 | GEN | GG | Pravastatin | 25 |
| hCV26505812 | rs10757274 | AGE MALE CURRSMK HYPERTEN_1 DIABETES_1 BMI BASE_EDL BASE_HD1 | GEN | GG | Placebo | 26 |
| hCV26505812 | rs10757274 | AGE MALE CURRSMK HYPERTEN_1 DIABETES_1 BMI BASE_EDL BASE_HD1 | REC | GA + AA | Pravastatin | 47 |
| hCV26505812 | rs10757274 | AGE MALE CURRSMK HYPERTEN_1 DIABETES_1 BMI BASE_EDL BASE_HD1 | REC | GA + AA | Placebo | 67 |
| hCV26505812 | rs10757274 | AGE MALE CURRSMK HYPERTEN_1 DIABETES_1 BMI BASE_EDL BASE_HD1 | DOM | GA + GG | Pravastatin | 54 |
| hCV26505812 | rs10757274 | AGE MALE CURRSMK HYPERTEN_1 DIABETES_1 BMI BASE_EDL BASE_HD1 | DOM | GA + GG | Placebo | 76 |

| hCV # (C9p21 SNP) | TOTAL | HR | 95% Lower Confidence Limit for Hazard Ratio | 95% Upper Confidence Limit for Hazard Ratio | P-VALUE | PVAL_IN TX |
|---|---|---|---|---|---|---|
| hCV26505812 | 315 | 0.85 | 0.433 | 1.667 | 0.6359 | 0.44429 |
| hCV26505812 | 262 | ref | . | . | . | 0.44429 |
| hCV26505812 | 666 | 0.58 | 0.361 | 0.927 | 0.0229 | 0.44429 |

TABLE 37-continued

| | | | | | | |
|---|---|---|---|---|---|---|
| hCV26505812 | 689 | ref | . | . | . | 0.44429 |
| hCV26505812 | 414 | 0.91 | 0.515 | 1.599 | 0.7377 | 0.44429 |
| hCV26505812 | 412 | ref | . | . | . | 0.44429 |
| hCV26505812 | 981 | 0.65 | 0.446 | 0.96 | 0.03 | 0.34883 |
| hCV26505812 | 951 | ref | . | . | . | 0.34883 |
| hCV26505812 | 1080 | 0.69 | 0.484 | 0.994 | 0.0463 | 0.65126 |
| hCV26505812 | 1101 | ref | . | . | . | 0.65126 |
| hCV26505812 | 328 | 0.92 | 0.469 | 1.802 | 0.8064 | 0.43653 |
| hCV26505812 | 272 | ref | . | . | . | 0.43653 |
| hCV26505812 | 690 | 0.61 | 0.384 | 0.963 | 0.0339 | 0.43653 |
| hCV26505812 | 727 | ref | . | . | . | 0.43653 |
| hCV26505812 | 441 | 1 | 0.574 | 1.732 | 0.9924 | 0.43653 |
| hCV26505812 | 425 | ref | . | . | . | 0.43653 |
| hCV26505812 | 1018 | 0.69 | 0.476 | 1.005 | 0.0533 | 0.3725 |
| hCV26505812 | 999 | ref | . | . | . | 0.3725 |
| hCV26505812 | 1131 | 0.73 | 0.512 | 1.03 | 0.0728 | 0.60059 |
| hCV26505812 | 1152 | ref | . | . | . | 0.60059 |

TABLE 38 for chromosome 9p21 SNP (rs10757274/hCV26505812):

| ENDPT | Risk Allele | MODE | STRATA | GENO_ RESP | STATIN | EVENTS_ RESP | no event | TOTAL_ RESP | HR_ RESP_ unadj | LOWER_ RESP_ unadj | UPPER_ RESP_ unadj | P_ RESP_ unadj |
|---|---|---|---|---|---|---|---|---|---|---|---|---|
| stroke | G | GEN | ALL | GG | pravastatin | 51 | 638 | 689 | 1.082 | 0.729 | 1.604 | 0.696 |
| stroke | G | GEN | ALL | GG | placebo | 48 | 653 | 701 | | | | |
| stroke | G | GEN | ALL | AG | pravastatin | 94 | 1349 | 1443 | 0.777 | 0.593 | 1.017 | 0.066 |
| stroke | G | GEN | ALL | AG | placebo | 121 | 1334 | 1455 | | | | |
| stroke | G | GEN | ALL | AA | pravastatin | 56 | 674 | 730 | 1.330 | 0.889 | 1.991 | 0.165 |
| stroke | G | GEN | ALL | AA | placebo | 41 | 680 | 721 | | | | |
| stroke | G | DOM | ALL | GG + AG | pravastatin | 145 | 1987 | 2132 | 0.864 | 0.692 | 1.078 | 0.196 |
| stroke | G | DOM | ALL | GG + AG | placebo | 169 | 1987 | 2156 | | | | |
| stroke | G | REC | ALL | AA + AG | pravastatin | 150 | 2023 | 2173 | 0.919 | 0.736 | 1.147 | 0.455 |
| stroke | G | REC | ALL | AA + AG | placebo | 162 | 2014 | 2176 | | | | |
| stroke | G | GEN | no hist | GG | pravastatin | 24 | 333 | 357 | 1.068 | 0.603 | 1.893 | 0.821 |
| stroke | G | GEN | no hist | GG | placebo | 23 | 341 | 364 | | | | |
| stroke | G | GEN | no hist | AG | pravastatin | 35 | 754 | 789 | 0.698 | 0.455 | 1.071 | 0.100 |
| stroke | G | GEN | no hist | AG | placebo | 52 | 774 | 826 | | | | |
| stroke | G | GEN | no hist | AA | pravastatin | 28 | 395 | 423 | 1.570 | 0.877 | 2.812 | 0.129 |
| stroke | G | GEN | no hist | AA | placebo | 19 | 424 | 443 | | | | |
| stroke | G | DOM | no hist | GG + AG | pravastatin | 59 | 1087 | 1146 | 0.813 | 0.578 | 1.144 | 0.235 |
| stroke | G | DOM | no hist | GG + AG | placebo | 75 | 1115 | 1190 | | | | |
| stroke | G | REC | no hist | AA + AG | pravastatin | 63 | 1149 | 1212 | 0.927 | 0.660 | 1.302 | 0.662 |
| stroke | G | REC | no hist | AA + AG | placebo | 71 | 1198 | 1269 | | | | |
| stroke | G | GEN | hist | GG | pravastatin | 27 | 305 | 332 | 1.098 | 0.637 | 1.892 | 0.736 |
| stroke | G | GEN | hist | GG | placebo | 25 | 312 | 337 | | | | |
| stroke | G | GEN | hist | AG | pravastatin | 59 | 595 | 654 | 0.816 | 0.576 | 1.155 | 0.251 |
| stroke | G | GEN | hist | AG | placebo | 69 | 560 | 629 | | | | |
| stroke | G | GEN | hist | AA | pravastatin | 28 | 279 | 307 | 1.093 | 0.625 | 1.911 | 0.755 |
| stroke | G | GEN | hist | AA | placebo | 22 | 256 | 278 | | | | |
| stroke | G | DOM | hist | GG + AG | pravastatin | 86 | 900 | 986 | 0.892 | 0.666 | 1.195 | 0.444 |
| stroke | G | DOM | hist | GG + AG | placebo | 94 | 872 | 966 | | | | |
| stroke | G | REC | hist | AA + AG | pravastatin | 87 | 874 | 961 | 0.885 | 0.660 | 1.187 | 0.415 |
| stroke | G | REC | hist | AA + AG | placebo | 91 | 816 | 907 | | | | |

| ENDPT | Risk Allele | MODE | P_INT_ RESP_ unadj | P_ RESP_ adj | P_INT_ RESP_ adj | GENO_ PLA- CEBO | EVENTS_ PLA- CEBO | TOTAL_ PLA- CEBO | HR_ PLA- CEBO | LOWER_ PLA- CEBO | UPPER_ PLA- CEBO | P_ PLA- CEBO |
|---|---|---|---|---|---|---|---|---|---|---|---|---|
| stroke | G | GEN | 0.070 | 0.602 | 0.050 | GG | 48 | 701 | 1.20631 | 0.79513 | 1.8301 | 0.37779 |
| stroke | G | GEN | 0.070 | | 0.050 | | | | | | | |
| stroke | G | GEN | 0.070 | 0.053 | 0.050 | AG | 121 | 1455 | 1.46444 | 1.02767 | 2.0868 | 0.03477 |
| stroke | G | GEN | 0.070 | | 0.050 | | | | | | | |
| stroke | G | GEN | 0.070 | 0.158 | 0.050 | AA | 41 | 721 | ref | 0 | 0 | 0 |
| stroke | G | GEN | 0.070 | | 0.050 | | | | | | | |
| stroke | G | DOM | 0.063 | 0.175 | 0.055 | GG + AG | 169 | 2156 | 1.38115 | 0.98188 | 1.9428 | 0.06361 |
| stroke | G | DOM | 0.063 | | 0.055 | | | | | | | |
| stroke | G | REC | 0.472 | 0.432 | 0.398 | AA + AG | | | | | | |
| stroke | G | REC | 0.472 | | 0.398 | | | | | | | |
| stroke | G | GEN | 0.083 | 0.824 | 0.065 | GG | 23 | 364 | 1.50713 | 0.82085 | 2.7672 | 0.18578 |
| stroke | G | GEN | 0.083 | | 0.065 | | | | | | | |
| stroke | G | GEN | 0.083 | 0.077 | 0.065 | AG | 52 | 826 | 1.48278 | 0.87679 | 2.5076 | 0.1417 |
| stroke | G | GEN | 0.083 | | 0.065 | | | | | | | |
| stroke | G | GEN | 0.083 | 0.108 | 0.065 | AA | 19 | 443 | ref | 0 | 0 | 0 |
| stroke | G | GEN | 0.083 | | 0.065 | | | | | | | |

TABLE 38-continued for chromosome 9p21 SNP (rs10757274/hCV26505812):

| stroke | G | DOM | 0.057 | 0.191 | 0.049 | GG + AG | 75 | 1190 | 1.489 | 0.90012 | 2.4632 | 0.12109 |
|---|---|---|---|---|---|---|---|---|---|---|---|---|
| stroke | G | DOM | 0.057 |  | 0.049 |  |  |  |  |  |  |  |
| stroke | G | REC | 0.669 | 0.636 | 0.624 | AA + AG |  |  |  |  |  |  |
| stroke | G | REC | 0.669 |  | 0.624 |  |  |  |  |  |  |  |
| stroke | G | GEN | 0.535 | 0.650 | 0.576 | GG | 25 | 337 | 0.91337 | 0.51499 | 1.6199 | 0.75659 |
| stroke | G | GEN | 0.535 |  | 0.576 |  |  |  |  |  |  |  |
| stroke | G | GEN | 0.535 | 0.323 | 0.576 | AG | 69 | 629 | 1.37223 | 0.84919 | 2.2174 | 0.19624 |
| stroke | G | GEN | 0.535 |  | 0.576 |  |  |  |  |  |  |  |
| stroke | G | GEN | 0.535 | 0.978 | 0.576 | AA | 22 | 278 | ref | 0 | 0 | 0 |
| stroke | G | GEN | 0.535 |  | 0.576 |  |  |  |  |  |  |  |
| stroke | G | DOM | 0.508 | 0.552 | 0.576 | GG + AG | 94 | 966 | 1.21007 | 0.76069 | 1.9249 | 0.42078 |
| stroke | G | DOM | 0.508 |  | 0.576 |  |  |  |  |  |  |  |
| stroke | G | REC | 0.500 | 0.420 | 0.450 | AA + AG |  |  |  |  |  |  |
| stroke | G | REC | 0.500 |  | 0.450 |  |  |  |  |  |  |  |

SEQUENCE LISTING (1914 sequences)

SEQ ID NO: 1 - DNA, 10412 bp, Homo sapiens
gtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 2 - DNA, 4445 bp, Homo sapiens
gtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatcctaaaaaaaaaaaaaaa

SEQ ID NO: 3 - DNA, 1385 bp, Homo sapiens
gccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaa

SEQ ID NO: 4 - DNA, 10719 bp, Homo sapiens
tggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcaaaaaaaaaaaaaaaaaa

SEQ ID NO: 5 - DNA, 2542 bp, Homo sapiens
agtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 6 - DNA, 2609 bp, Homo sapiens
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 7 - DNA, 6921 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggtgctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctaaaaaaaa

SEQ ID NO: 8 - DNA, 2216 bp, Homo sapiens
cgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccagatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaaaaaaaaaaaaaaaaaaaaaaaaa

SEQ ID NO: 9 - DNA, 3229 bp, Homo sapiens
atttttactgccagctttcaagttggaagagggaaattacgtttaaaggtcagcagatgacagatggattttcacaatttggaaataaaaacatgagtgaagggttcggaaggcaagtctctggtccattacacacttccagaaaaacttagtacccagagactcacattactgggagtgctatctactcacaagtgttgcactccattgagaaaaaaaaaaaaaccaggaagttgctgttctactgaggactgaccaagaagccatgaaataccttactgtgggagacttagaagattgcctactgaataaggtggacttgaggcgccagcagatttcccaggctgtggaggaggtgcagaaagtcgttcatcatttgaccacaaacatcagcaaccaagacattagatttcaagctgtgccttactctgacacgtacaatgaaaatattaaggttttggctcccagtcagttcctcgtcacagtcccaataaaaggcctggccgggtacagggaggccagggagcagcactggcggtactacacactgcagggcaccaggctgccctgcccgttgcgggaccctgagggtctgcagcagtggctggaggtggaacagtttatgaagagcctgtggcagtggcatgagacagatgtgaacatcgacggagacattgtgcctgccaaggtcctcctagtgttccggaagctggtggaaaatgcagttagaacctgtcacctctcaggtaaggtcagcctgctaggaaaccgctctgcagtttgggttgctgtggaaacatctgcatatcaggtggaactggagctggtccccgcagtggagatccccaccacctggtccaagaaagcccggtggcctcgatgtctgcagcgctggccttcccaagagagagtggagtgcatcaagtcgtttgggtttaacttgttggcctgttcaaattatcactggcagctgagcttcctccgtgctgagcaggtgttactggaacagctggatgaagatgggggctgccgtaggaagtgttttcaggtcatgaggcacctgaaggaggacatctggtgcccagggaacaggccggttatcacgtcccaccatctgcagactgtgctcttttggacctgcgagaaatatccccactttaaagactggcaggtcttcagcaaagcatttctgcgcctggtgaggaaactgcacaagtgcgtgagccagcacttcctgaaacactatttcgtccggaacagcaacctctttcagtgcgccaacccgactgaactggacactgtggcccaaaagctggccaccttcctgaagaacccccagatcggcccgccctgatggttgccccggcctgggaggctcttggacattttattctggcttaaccttgttctttggatggttcctcagtcaggtgccaggatcctgcctaggagaaaggccacgaatggcagcggaaattacatcaaaccagaaacacttcagcagggggaaaactgtgccccaggatgtctggcccaggcctccctggagcccagcaagcatttctgccctagctaattctcctggagacagctctcatcaggcttccccaggcacagatttggagctggtgacagttctgaacttagtttcccttgttcaggctgtgatcgtctcacagtgaaggtggagacagaacccctggaagtctggacatgagcctgctggccaatactgtgcccagcccactgatcatgggcacattctcctgccatttgtaaaatgggaatgttaacgtgcctacctctgagcagggctgtgtgcctatgaaactgtgctggcgccttttcaaggggaaggcattggatcaacacaaagtgttcctggttggttgagtagctggtgtttgcatcctggatcggtacccacagcactgacgcaaaattgcacctgatgagttagtgagcctgtgcttccttgctgccctccagcttccttagcatgtgggtcagtggctcctgatgttctgtctgcttccctggtattctctaagcagggaggggaatggttttgatgataagtgtaagtcaaagatgaaagtacaactcttggcctgatcccaaccatagccctctctttgcttcccatgccatgggccatggatggaacttccttatatatttatgtaaataacctagtactatgatctgcatggagtgaccttaggtgtctgtcactgctcagtgtgttcctttgctcacttcattcactcactcactcattgacaaataatgctcattaggcaccgggaacacagcaaagagcaaagtggatgaggacctccccctggggatgccacctaatggtggagacaagaaatgaacgacagataaacacgcacagttattacagatggaagcaagtgcttcaaaggaaataaacagaatgttgaagtagagtccacagaaaggtccccgaaggatgaaaatgcaaatagctgaaggggaaggaaaagtgaccaaaggcaggcatggtggggctggcatgagtcagagcacctggccttgtaaagccaggaaggaatcagtattttattctaagatcaaaggtgtgacatttggcctctccagaagcagaagagtatcacgatctgactgcattttaaacaattgttctggtaactgcatgaagaaggtctggggactcacacaggagctgggcactgagtgctcttgagccacccatttggaatttcacagaggcccacaaggcaacatattctgtgtggcacaaccgatcaggaattctaggagttctcggtgagatcaatggtttttttctggcgtttatgtaatgcttctcaactcaaggggctcctttattacttttgaatgtttttgcccaaatgtctataccaaagataaatttctaaagcatgaactactgattttgttttcatgaaaattcacatttgaaaatgaaaatgattacttttcaaaagtactgtaaacggcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatagatccaggagctggttttttgaaaggatcaacaaaattgatagaccgctagcaagactaat

SEQ ID NO: 10 - DNA, 2281 bp, Homo sapiens
gtctctcagtctttctctctttctcattctctttcaatatggaacttgaaaagcgtgaaaaaagaagcttattaaacaagaatttagaggagaaactgacggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaataggtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagcaatacaagaccaagtcaagctacaaggcttttgcagcaatccctacaaacacattgcttttggaacagaaggcactagatgaaccagccaagactgaaagtgtctccaaggacaacacattagaaccaccagtggagctctattttcctgcacagctcaggcagcaaactgaagagctctgtgctaccattgataaggtcttacaggattccttgtctatgcattcttctgattctccttcaaggtccccaaagacattgttgggttctgacacagtcaaaactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaagaatggctgtgactatttttcaatacaaattttatttaatgcatacatttctaactgagtcaggtttttattccccttttacttcacttttttacatgaaaaaaatcacaacttttaaagtaactaattagctttcagaagacgctgatattcagaggttctctggtgagatcttgaacatgagaaagttggtattttgtataacacacattgctttcctgttctgttgggattcggtgctgctgggacagactatgtgccaggagcagcccagtgctgatgaacatcgcgttactggagtgtctgtgtctgggataccactgtctctctgcctgtcaccacatgattcttgtgaagactactttagagttagtttgtatccaaaatcctgagagcagcagagaccatagagcaaacccatacttgatgacagtcctgagagccccctagaggcacatcatgtgcccaccgtgttggccatcttcaatttatttcccagttgtcatccccagcagtctgtcctagccccctctaagtgatt

SEQ ID NO: 11 - DNA, 1571 bp, Homo sapiens
atgtgcagctggtaccttggatttgaatgttcttctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcagactcctacaactcttccaagagcagctggtcgagaaaccaaatatgcaaatctctcctcaccaacttctacagtatctgagagtcagctgactaagcctggagtaattcgcccagtacctgtaaaatccagaatattactgaaaaaagaggaggaagtctatgaacccaaccctttcagtaaatacttggaagataacagcgacctcttttctgaacagctgagtcatccaatggtggctattcctgaacatgaagctcttgattccaaagagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaagaatggctgtgactatttttcaatacaaattttatttaatgcatacatttctaactgagtcaggtttttattccccttttacttcacttttttacatgaaaaaaatcacaacttttaaagtaactaattagctttcagaagacgctgatattcagaggttctctggtgagatcttgaacatgagaaagttggtattttgtataacacacattgctttcctgttctgttgggattcggtgctgctgggacagactatgtgccaggagcagcccagtgctgatgaacatcgcgttactggagtgtctgtgtctgggataccactgtctctctgcctgtcaccacatgattcttgtgaagactactttagagttagtttgtatccaaaatcctgagagcagcagagaccatagagcaaacccatacttgatgacagtcctgagagccccctagaggcacatcatgtgcccaccgtgttggccatcttcaatttatttcccagttgtcatccccagcagtctgtcctagccccctctaagtgatt

SEQ ID NO: 12 - DNA, 1145 bp, Homo sapiens
atgcagggccgcgtggcagggagctgcgctcctctgggcctgctcctggtctgtcttcatctcccaggcctctttgcccggagcatcggtgttgtggaggagaaagtttcccaaaacttggggaccaacttgcctcagctcggacaaccttcctccactggcccctctaactctgaacatccgcagcccgctctggaccctaggtctaatgacttggcaagggttcctctgaagctcagcgtgcctgcatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccaaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagtcctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgtcagcatgtttccagcactatccccacttttcagtgcctcccctgctcatctccaataaaataaaagcacttatggaaaaaaaaaaa

SEQ ID NO: 13 - DNA, 8630 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccaaaaaaaaaaaaaaaaaa

SEQ ID NO: 14 - DNA, 1567 bp, Homo sapiens
cgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggttttttttctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataactttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgctta

SEQ ID NO: 15 - DNA, 3523 bp, Homo sapiens
atggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtgctccagcggccgagggggagcccgaggaggaggacgggggcgcggctgggcagcggagagacggccggccggggagtagccacaacggcagcggggacgggggcgctgccgccccgagcgcccgaccccgggacttcctgtacgtgggggtgatgaccgcgcagaagtacctgggcagccgcgcgctggccgcgcagcggacctgggcgcgtttcatcccgggccgcgtggagttcttttccagccagcagccccccaacgccggccagcccccgccacccctgcctgtcatcgcgctaccgggtgtggacgactcctatcctccccagaaaaagtccttcatgatgatcaagtacatgcacgaccactacctggacaagtatgagtggttcatgcgcgccgacgacgatgtctacatcaaaggtgataaattagaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatgattacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactgaaaaaaaaaaaaaaaaaaaaaaaaaaaaaaaa

SEQ ID NO: 16 - DNA, 5801 bp, Homo sapiens
gagcgagagcgcgaaggaaatctggccgccgccgccgcgagcgctcccgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagcttt

SEQ ID NO: 17 - DNA, 3840 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 18 - DNA, 3877 bp, Homo sapiens
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 19 - DNA, 3678 bp, Homo sapiens
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 20 - DNA, 2080 bp, Homo sapiens
gggcttaatgacggaaggagcatggcgtggagacacctgaaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattaaaaaaaaaaaaaaa

SEQ ID NO: 21 - DNA, 10580 bp, Homo sapiens
tttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcacctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtcaactcaagtgccagtggcttaaaactgggcagttttttttgagttctgtgacatacaacttagcatgggatcctcaagataatagattgttgacagcaactgattctattcagttgtgggctcctccaggagatgatattctggaagaggaggaagaaattgataatacagttcctcctgttttaaatgattggaagtgtgtctggcagtgcaaaacctcagtatctgtacatttgatggaatggtctcctgatggtgaatattttgctactgctggaaaggatgattgtcttttgaaagtgtggtatcctatgactggttggaagtcttcaattatacctcaggatcatcatgaagtaaaaaggagacagtcctctactcaattttcttttgtttacttggcacatccccgagctgtgacaggtttttcgtggcgcaaaactagcaagtatatgcccaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgagacaatacaccatttgaaaaatttaaggaaaggacagaggaggtcatctgttcttgtaactcatgctgaattaatgcccgaccagacagcaatgcatgaagttcaaagacacatttcccaccatgcaaatgcactctgtcattttcatattgcagcaagcatcaaccctgccacagatattccaaatgtcttggttggcactgcatttaatgttgatgatggaaatgggggctttgtagttcattggttaaacaacaaggaatttcattttacatcatctacagaagtatttatgcatcaattacgaaaactttctgataagcaggtagatcatgaaaatgatgatgcagatagagaagatgaggaacattcacaggaggatagagaacggggtttacatatgaaattagaccatgatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggcacatactgcaattctgcaagtgcttgctttgttgcttctgatggcaaaaatctgagactctatcaagctgtagtggatgcaaggaaattattagatgaattgtcagacccagaatcttcaaaacttattggagaagtgtttaatattgtgagccaacagtctactgctcgacctggctgcattattgaactcgacgcaataaccaaccaatgtggctcaaatacacagttgcttcatgtgtttcaagaagacttcattataggatataaaccacataaggaagatatggagaaaaaggaaacagaaatattttttcagccatcacaaggataccgcccaccaccattttcagaaaagttctttctagtagtaattgagaaggacagcaataataactctattctgcatatgtggcaccttcatcttaaatctgtacaagcatgtttagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggccatctgagttcttcttcaatttatccagtgtgccttgcaccttatttagtggttacaacttgttctgacaataaagtacgcttctggaaatgttgtatggaagccaacccagagtgtaataaaagtgatgagaaagaaatttatcattggaagagatggcctttgatgaatgatgaaggagaagataatagcagtacagtgagcattgtgggaagaccagttgctgttagctgttcatacacaggtcgccttgcagtggcttataagcagcctatccaccataatggttttgtttctaaagaattttccatgcatgtttgtatatttgaatgtgaatctacaggaggatcagagtgggttttagaacaaacaattcatcttgatgatttggttaaggttgggagtgtacttgattcaagggtcagcgtcgacagtaatctgtttgtgtatagcaagtcagatgcactcttgagcaaggatagatatcttattccgaatatcaaacatttagtacatttggactgggtatcaaaagaagatggctcccacattcttacagtgggagtcggtgcgaatatcttcatgtatggaaggctttcaggaattgtgactgagcaaaccaacagtaaggatggagtagctgtcatcactttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggaagagatacattagatgagtgtggtttgagatacttgttagctatgcgcctacacacatgccttttgacatcgctgcctcctttataccgagtgcagctacttcatcaaggtgtctctacatgccattttgcctgggcttttcattctgaggctgaagaagaactgattaatatgattccagcaattcagagaggggacccccagtggtctgaattaagagctatgggcataggatggtgggtgaggaacattaacacgcttcgaagatgcattgaaaaggttgccaaagcttcttttcaaaggaacaatgatgccttagatgctgcactattctacctttcaatgaagaagaaagcagtagtgtggggtctgtttaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtatgtcttgaaaaaatggaagatattcagctagccatggttattgcccgtttatatgaatctgaatttgagacttcatccacttatatatccatcctaaatcagaagattttgggttgccaaaaggatggctcaggattcagttgcaaaagattacatcctgatcctttcctgcgtagtcttgcctattgggtaatgaaagattacacccgagccttggacacattactggaacaaacaccaaaggaggatgatgaacatcaagttatcatcaagtcttgtaacccggtggcatttagtttttataactaccttcgaactcatcctttgctcattcgaagaaatcttgcctcccctgaaggaactttggcaaccttaggtctcaaaactgagaagaactttgttgataaaattaacctcatagaaagaaaattattctttaccactgcaaatgctcattttaaagttggatgccctgttttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtgcacacacttcattcactagcagcatcactttctgcatcaatttaccaagcattatgtgacagtcatagctacagtcaaacagaaggaaatcagtttacaggaatggcttatcaaggacttcttttaagtgatcgtagaagactaaggacagaaagcattgaagaacacgcaacaccaaattcatctcctgctcaatggcctggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcagcacctcctgtcctttctgaagacatagataaacaccgtaggagatttaacatgagaatgctcgtccctggaaggcctgtaaaagatgctaccccaccaccggtgcctgcagaaagaccatcttacaaagaaaaatttattcctcccgaacttagtatgtgggattattttgttgcaaagccatttcttcctttgtctgatagtggtgttatatatgattctgatgaaagcattcatagtgatgaagaagatgatgcctttttttcagatacacaaatacaggagcaccaagatccaaattcctatagctgggctcttctacatttgacaatggttaaactagcacttcacaatgtcaagaatttctttcctattgctggactggaattctctgagctgcctgtaacatcaccattaggtattgctgtgattaaaaacttggagaactgggaacagatcttgcaagagaaaatggatcagtttgaaggtccaccccctaactatatcaacacatatccaactgacctttcagtgggagctggaccagctattcttcgaaataaagcaatgctagaacctgaaaataccccattcaagtcccgggattcttctgcatttccagtcaaacgactttggcatttccttgttaaacaagaggtccttcaagagacatttattagatatattttcactaagaaaagaaagcagagtgaggttgaagctgatctgggctatccaggtggaaaggcgaaagtcatccataaggaatctgatatgatcatggcattttctgttaataaggcaaattgtaatgaaattgttttggcttcaacacatgatgttcaagaacttgatgttacttctctactggcctgtcagtcatacatatggatcggagaagaatatgacagagaatccaaaagttcagatgatgttgattatcgtggttccactacaactctttatcaacccagtgcaacatcctattcagcaagtcaggtgcatccaccttcatctctgccatggctgggcactggacagactagcactggagctagtgtgcttatgaaaaggaatctacataatgttaagagaatgacttcacacccagtccatcaatactatcttacaggtgctcaggacggcagtgtacgaatgtttgaatggacgcggcctcagcaacttgtctgctttcgtcaagctggcaatgcaagagttactagattatattttaattcacaaggcaacaagtgtggtgttgcggatggagagggttttctgagtatctggcaagttaaccaaactgcatcaaatcctaaaccttatatgagttggcagtgccacagtaaagccacaagtgactttgcatttattacctcttcaagtctagttgccacatctggacactccaatgacaatagaaatgtttgcctctgggacacattaatatcacccggaaacagcctcattcatggtttcacgtgccacgatcatggtgccacggtactgcagtatgcacccaaacagcaactcctaatctcggggggtaggaaaggacacgtctgcatttttgacatcaggcaaaggcagctcattcacacgttccaggcccatgactcagctattaaggctctggccttggatccctatgaggaatattttaccacaggttcagcagaaggtaacataaaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgttaggaatgtactatgtgaacatgacatatttgtagttaaccaaacacaccttcttagtccagtttagtactttttcttttcgtgtattcaaggttaaacacccaaacatttaaggatatgttgaaactacaccaatagagcatttcatatcataattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaaagaaaaataaatgttatttgttagagtttttagtttgatactgtttttgaccattgagatttttaatttgataaaa

SEQ ID NO: 22 - DNA, 1989 bp, Homo sapiens
acatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaagggaaaaaaaaaaaaaaaaaaaa

SEQ ID NO: 23 - DNA, 3104 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaaaaaaaaaaaaaaaa

SEQ ID NO: 24 - DNA, 3182 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgaaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaaaaaaaaaaaaaaaa

SEQ ID NO: 25 - DNA, 3367 bp, Homo sapiens
gcccccgcccggcccgccccgctctcctagtcccttgcaacctggcgctgccatccgggccactgtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgcgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggggctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccctggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccaggatgactcttcgcctgcccagcctgagtggctcagatgggatcccatatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaaaaaa

SEQ ID NO: 26 - DNA, 2262 bp, Homo sapiens
cacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaat

SEQ ID NO: 27 - DNA, 2270 bp, Homo sapiens
cacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcaagttcgaaccaacgtggcctcaaccagatttggaatgtcaaaaagcagagtgtctatttgatgaatttgaggaaatctggaactttgggccacccaggctctctagatgagaccacctatgaaagactagcagaggaaacgctggactctttagcagagttttttgaagaccttgcagacaagccatacacgtttgaggactatgatgtctcctttgggagtggtgtcttaactgtcaaactgggtggagatctaggaacctatgtgatcaacaagcagacgccaaacaagcaaatctggctatcttctccatccaggtatgtagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaat

SEQ ID NO: 28 - DNA, 4350 bp, Homo sapiens
agttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattca

SEQ ID NO: 29 - DNA, 3023 bp, Homo sapiens
attccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaaaaaaaaaaaaaaaaaa

SEQ ID NO: 30 - DNA, 3020 bp, Homo sapiens
gtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatgtatggatttatcaacacctgtctgcaatctcttgtgatagagaaatttggtgaagaaacatgggaaaaattgaaaacttctgcagaagtacaagatgccttcatgacctacacaatgtatgatgacgtcatcaccattaagctcatccaagaggcctgcaacattctgggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggagatgaatgcaccatcgtttcgtgtggagagaggagcagatgggaaaatgtttctccattgctactcggatagaagtggtctgtgccacattgtaccaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagccaaaaaggttacaagacagtcagggcatggagagagaccaagaggccctccaggcagctttcctcaagatgaaggagaaatatttgaatgtctctgcttgtcctgtgaaaaaatcccactgggatgttgtgagaagcatagtcatgtttggaaaagggcatctcatgaacacctttgagccaatttatcctgagagactctggattgaagagaagacattctgcaacgcttttcctttccacattgtattcgatgaatcactacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggccagatgatctggatggagtccatgtggtgcatggtgtacctgtgctctccgaagctccgcagcctgcaagagctggaagaactcaatatgcatctttctgacatcgccccccacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaaggggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacac

SEQ ID NO: 31 - DNA, 3080 bp, Homo sapiens
gtctacagctcccagcgtgagcgacgcagaagacgggtgatttctgcatttccatctgaggtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatgtatggatttatcaacacctgtctgcaatctcttgtgatagagaaatttggtgaagaaacatgggaaaaattgaaaacttctgcagaagtacaagatgccttcatgacctacacaatgtatgatgacgtcatcaccattaagctcatccaagaggcctgcaacattctgggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggagatgaatgcaccatcgtttcgtgtggagagaggagcagatgggaaaatgtttctccattgctactcggatagaagtggtctgtgccacattgtaccaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagccaaaaaggttacaagacagtcagggcatggagagagaccaagaggccctccaggcagctttcctcaagatgaaggagaaatatttgaatgtctctgcttgtcctgtgaaaaaatcccactgggatgttgtgagaagcatagtcatgtttggaaaagggcatctcatgaacacctttgagccaatttatcctgagagactctggattgaagagaagacattctgcaacgcttttcctttccacattgtattcgatgaatcactacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggccagatgatctggatggagtccatgtggtgcatggtgtacctgtgctctccgaagctccgcagcctgcaagagctggaagaactcaatatgcatctttctgacatcgccccccacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggagaatttaaaagctgcacgattcttttcagcgatgtagtgacatttactaacatctgtactgcctgtgaacctatacaaatagtgaacgtgctgaattccatgtactccaagtttgacagattaaccagtgtgcacgcagtctataaagtagaaacaataggagatgcttatatggtggtaggaggtgtaccagtgcctattggaaaccatgctcaaagagtggctaattttgccttggggatgagaatttctgcaaaggaagtgacgaatcctgttactggagaacccatccagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacagagccttgaaaaatcaagggtttaaaatcattgagaggggtgaaattgaagtgaaaggtaaagggagaatgaccacatactttttgatccagaacttgaatgccacagaggatgagatcatggggagatctaaaaccccagttgatcacaaggggtcaacacagaaagcatccttgcccaccaccaagctccagggctcagttcaaccatcttgccctgaacactcttctcttgcatcctggttattatgacgttctttgagctgggccgatagatccagctgaagagttctacatacattagtcttcaaggttcttctctgggcgtttcccatgcagctctctggtagctggggaatgatttgtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaaacgcagcagatgcagacgctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacac

SEQ ID NO: 32 - DNA, 8571 bp, Homo sapiens
gtgttcatgaaaaaaatgcacaaaatcctgcctggccggaataattcatgaagaaggggctggatccgtgggtcagagaacacaggaccagtttgccatcccaaggccgaaggcctccctccaacacagttctccaagctctagaaatctctgacacatcttgaccatgagaccacggctggtttttggcaggattcgaggcacaaacccagcagcctcaacctagttcatggaggagcctcgcggggtcctggccaagcaagcccgcccctctggtgggaagagcggcgcctaggtggagggtggctgccgtaggagtggacatgaatgctggctttcagagagaacagcgtttcagttttggtcatcggaagtggtgccttcagcacagaagaagagcgtgatttctcctccaaggccgttgatctccaacccagaactaaaggggagaagagccacccccagcatccagcgtggcatctcttgtgccaggaccagggatgactgggccatggacacagatgtctccaaccttcaaccgtttgcatagcacacgggggactcgtgggggccacctgccactgccagctgaaacaatacaatggcaatactgacatccttcatgacgttttcccgacagacattcaggcagaaagtgctggtgcgttttctgtctgcaaagtagagggccatgcctcaccaatagaatagcgtgggccctgatgacctgctccgagtccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtcatggatcctgaacaaagtgtcaagggcaccaagaaggctgagggaagtccccggaagcggctgaccaaaggagaggccattcagaccagtgtttcttccagcgtcccatacccaggcagcggcacagctgccacccaagagagccccgcccaagagctcttagccccgcagcccttcccgggcccctcatcagttcttagggaaggctctcaggagaaaacgggccagcagcagaagccccccaaaaggccccccatcgaagcatccgtccacatctcacagcttccgcagcaccctctgacaccagcattcatgtcgcctggcaaacctgagcatctcctggaggggtccacatggcaactggttgaccccatgagacctggaccctctggctccttcgtggcccctgggctccatcctcagagccagctccttccttcccacgcttccatcattccccccgaggaccttcctggagtccccaaagtcttcgtgcctcgtccttcccaggtctccttgaagcccacagaagaggcacacaagaaggagaggaagccccagaagccaggcaagtacatctgccagtactgcagccggccctgtgccaagcccagcgtgctccagaagcacattcgctcacacacaggtgagaggccctacccctgcggcccctgtggcttctccttcaagaccaagagtaatctctacaagcacaggaagtcccatgcccaccgcatcaaagcaggcctggcctcaggcatgggtggcgagatgtacccacatgggctggagatggagcggatccctggggaagagtttgaggagcccactgagggagaaagcacagattctgaagaggagactagtgccacctctggtcaccctgcagagctctccccaagacccaagcagccccttctctccagcgggctatacagctctgggagccacagttccagccacgaacgctgttccctgtcccagtccagcacagcccagtcactcgaagacccccctccatttgtggaaccctcatctgagcaccccctgagccataaacctgaagacacccacacgattaagcagaagctggccctccgcttaagcgagaggaagaaggtgatcgatgagcaggcgtttctgagcccaggcagcaaagggagtactgagtctgggtatttctctcgctccgagagtgcagagcagcaggtcagccccccaaacaccaacgccaagtcctacgctgagatcatctttggcaagtgtgggcgaataggacagcggaccgccatgctgacagccacctccacccagcccctcctgcccctgtccaccgaagacaagcccagcctggtgcctttgtctgtaccccggacgcaggtgatcgagcacatcacgaagctcatcaccatcaacgaggccgtggtggacaccagcgagatcgacagcgtgaagccaaggcggagctcactgtccaggcgcagcagcatggagtccccaaaatccagcctctaccgggagcccctgtcatcccacagtgagaaaaccaagcctgaacaatcactgctgagcctccagcacccgcccagtaccgccccccctgtgcctctcctgagaagccactcaatgccttctgccgcctgcactatcagcaccccccaccaccccttccgaggtagctactccttcgatgaccatatcaccgactccgaagccctgagccacagcagtcacgtgtttacctcccacccccggatgctgaagcgccagccggcaatcgaattacctttgggaggggaatacagttctgaggagcctggcccaagcagcaaagacacagcctccaagccctcggacgaagtggaacccaaggaaagcgagcttaccaaaaagaccaagaagggtttgaaaacaaaaggggtgatctacgaatgtaacatatgtggtgctcggtacaagaaaagggataactacgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgtctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcagcccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggctacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggcgctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggacccacgggttctcttcccgcccgcgcctctacctcacaagctcctcagcagaagcccagagacctgcgcctccccgtggcagaaggccgagtcccgaagtccctcctgctcacccggccctgctcatcctctctcctcccgacccttctccgccctccatgacttccacggccacatcctggcccggacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccgaccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttagcctctctccaactgcttcagcatctggcttccagtgtccagcaacagacgtttccagccactttcctcgaatcatcccacttcctcagccccatctgtccctccgtccaggagctctcacggccccatctgttgtaccttcccatgtatgcagttacctgtgcctttttctacaccttttgttgcttaaaaagaaacaaaacaaatcacatacatacatttaaaaaaaaaacaacaacccacgaggagtctgaggctgtgaatagtttatggttttggggaaaggctgatggtgaagcctcctgaccctccccgctgtggttggcagccacccaccccagaggctggcagagggaaaggggtacactgagggagaaaggaaaaggaaacttcaaacaatatagaattaaatgtaaaaggaagcactcctgtgtacaga

SEQ ID NO: 33 - DNA, 5607 bp, Homo sapiens
actcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttcaaaaaaaa

SEQ ID NO: 34 - DNA, 3714 bp, Homo sapiens
ggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtagcaccatctggctggaggggggcaccccccccatggatgcccttcagatagcagaggacaccctccaaacactggttccccactgccctgtgccttccggccccagaaggatcttcctggatgccaacgtgaaggaaagctactgccccctagtgccccacaccatgtactgcctgcccctgtggcagggcatcaacctggtgctcctgaccaggagccccagcgcgcccctggccctggttctgtcccagctgatggatggcttctccatgctggagaagaagctgaaggaagggccggagcccggggcctccctgcgctcccagcccctcgtgggagacctgcgccagaggatggacaagtttgtcaagaatcgaggggcacaggagattcagagcacctggctggagtttaaggccaaggctttctccaaaagtgagcccggatcctcctgggagctgctccaggcatgtgggaagctgaagcggcagctctgcgccatctaccggctgaactttctgaccacagcccccagcaggggaggcccacacctgccccagcacctgcaggaccaagtgcagaggctcatgcgggagaagctgacggactggaaggacttcttgctggtgaagagcaggaggaacatcaccatggtgtcctacctagaagacttcccaggcttggtgcacttcatctatgtggaccgcaccactgggcagatggtggcgccttccctcaactgcagtcaaaagacctcgtcggagttgggcaaggggccgctggctgcctttgtcaaaactaaggtctggtctctgatccagctggcgcgcagatacctgcagaagggctacaccacgctgctgttccaggagggggatttctactgctcctacttcctgtggttcgagaatgacatggggtacaaactccagatgatcgaggtgcccgtcctctccgacgactcagtgcctatcggcatgctgggaggagactactacaggaagctcctgcgctactacagcaagaaccgcccaaccgaggctgtcaggtgctacgagctgctggccctgcacctgtctgtcatccccactgacctgctggtgcagcaggccggccagctggcccggcgcctctgggaggcctcccgtatccccctgctctaggccaaggtggccgcagtctgcctttgcatcctgtcctccagccacccttgcttgccactgttccccatgacgagagcctcctgtctgcagtggccatcctgaggatagggcagagtgcccagggtggccccagggcttctaaaaccccacctagaccaccctccatgtcaggtactgagcaaggccccagatccttctctctggaggaagagggaagcccaggggtcctgtttgtaaaacaacggtggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgaggattacccagtgtggtaggtgctcaataaatgttggtcattgttatcactgaagcccaacatgctagtgcttctagacccttctgtcagtgctgataagcccttgctaagtcccagccccttcatgcttggctggcgtctgccctagggctggggttctcaagcccctggccctggcccagagatttggattcccttggcggccgtggagcccagcctttgatgtctttcaaagcttctgtggtgcgccctggattgagaaccaccacccgaggggtacagcccctctcttccaaccgagaagttcctgtcccagaatggacccagggacaagagaccctgagagccctgggactgggagtgtctgctcctctgaggccaggaggccggtgctgggccagagaggacggcgtggcgaaagtcagcgtccactgcagcacaggatcagatggccgtgtgctgtgcatgcaggagcctcgccttctgtgtctttagtcttgagccaaaatttgctcaaagactgatctcttccttgcagggaacagctttggggctgggggaactagaacccacatgttggtctaaaccctgagaaggtggcagtgaggaagtatcccctcaggtgactggatctgtgttcctccttaacatcatctgatggaatggcaatgaaaagcgtggattgtggaaaatacagaaaaacataaaggaaaaaactccaatcccctgagcccaccactgttcaggacccctgcttttgtcacctactatttccctttagtttttagcagcggctggatgtgatatgtctagtttaaccagtccccttgatctttctatataataaataacacaggagtgaacatcctgaatcag

SEQ ID NO: 35 - DNA, 1625 bp, Homo sapiens
ggtcctacccggaagcgcgcccgggctcctgcaggcggggcgctgtgcgcgccgcgatccggtacgtgggcctccgggctgtcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagatgaagtgcgtcttggtggccactgagggcgcagaggtcctcttctactggacagatcaggagtttgaagagagtctccggctgaagttcgggcagtcagagaatgaggaagaagagctccctgccctggaggaccagctcagcaccctcctagccccggtcatcatctcctccatgacgatgctggagaagctctcggacacctacacctgcttctccacggaaaatggcaacttcctgtatgtccttcacctgtttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaaggagctgcggcccccagacctggcgcagcgtgtccagctgtgggagcacttccagagcctgctgtggacctacagccgcctgcgggagcaggagcagtgcttcgccgtggaggccctggagcgactgattcacccccagctctgtgagctgtgcatagaggcgctggagcggcacgtcatccaggctgtcaacaccagccccgagcggggaggcgaggaggccctgcatgccttcctgctcgtgcactccaagctgctggcattctactctagccacagtgccagctccctgcgcccggccgacctgcttgccctcatcctcctggttcaggacctctaccccagcgagagcacagcagaggacgacattcagccttccccgcggagggcccggagcagccagaacatccccgtgcagcaggcctggagccctcactccacgggcccaactggggggagctctgcagagacggagacagacagcttctccctccctgaggagtacttcacaccagctccttcccctggcgatcagagctcaggtgaggaccggaggaaagcaggaggaaacaatagctagctgcgagcgacaggcagcccaggacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgttgatgacaagttgattcatttaaaacttctgtacatgcattctcagactcatcttttttgtaattaaaattaaaaattaagttaaatttagtaataatcatctaatttctatacattctaaaatatattcagcatctgtagtttatactttgtttctccaaagtatgtgggtaaacaataaaaaaaaactataaatattcaaaaaaaa

SEQ ID NO: 36 - DNA, 2088 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaaaaaaaaaaaaaaaaaaaaaaaaaaaaaaaaaaaaaaaa

SEQ ID NO: 37 - DNA, 3678 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaa

SEQ ID NO: 38 - DNA, 3878 bp, Homo sapiens
ccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagtaaaaaaaaaaaaaaaaaa

SEQ ID NO: 39 - DNA, 2924 bp, Homo sapiens
cagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcggagtctgagactagcagagtctcgagagcaaagccccaggagaaaagaggtggaaagtagactgagcccaggggaatctgcctaccagaagttgggcctgacagaggcccataaatggagacctgactccagagagtctcaggaacagagtttggtacaactggaggcaacagagtggaggctgaggtcaggagaagaaagacaagactactcggaagaatgtgggagaaaagaagagtggccagttccaggggtagctccaaaagagactgcagagctgtccgagaccctgacaagggaggcccaaggcaacagttccgcaggagtggaggcagcagagcagaggcctgtggaagatggcgagaggggcatgaagccaacagaagggtggaaatggaccctgaactccgggaaggctcgagaatggacacccagggacatagaggctcaaactcagaaaccagaacctccagagtcagcagagaagcttctggaatctcccggtgtggaggctggagaaggggaggctgagaaggaggaggcgggggctcagggcaggcctctgagagccctgcagaactgctgctctgtgccctcccccctcccaccagaggacgctgggactggaggcctgagacagcaggaagaggaagcagtggagctccagcccccaccaccagcccctctgtctcccccacccccagccccaactgccccccaacctcctggggatcccctcatgagccgcctgttctatggggtgaaggcagggccaggggtgggggccccccgccgcagtggacacaccttcaccgtcaacccccggcggtctgtgccccctgcgaccccagccaccccaacctctccagccacagttgatgctgcagtcccgggggctgggaagaagcggtacccaactgccgaggagatcttggttctggggggctacctccgtctcagccgcagctgccttgccaaggggtcccccgaaagacaccacaaacagcttaagatctccttcagcgagacagccctggagaccacgtaccaatacccctccgagagttcggtactggaggagctgggcccggagcctgaggtccccagtgcccccaaccctccagcagcccaacccgacgacgaagaggatgaggaagagctgctgctgctgcagccagagctccagggcgggctgcgcaccaaggccctgattgtggatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaaaaaaaaaaaaaaa

SEQ ID NO: 40 - DNA, 3972 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 41 - DNA, 591 bp, Homo sapiens
atgaatgatcgtgaatcggggagccctcagaatcacagcagtttcagagatactccaggggtgccttgtgatcagaacgaatttatagacaaaaaaggttctacccatcacctacagataatggtgagtaaatacaagaacaatgttctgctgaaaggattagaagccatcaatgactatcacttcagcataattaattccttactgatcaatgatttaaaacttaattcaacaaggagagacgaatatgacaaaattcagattgccgacttgatggaagaaaagttcccaggtgatgctggtttgggcaaactgagaactcttcaaagaaataccaacactgggagaggagaccttgctgaaactcttagaaaagtcaaaagatcatctgctctgggtttagatgtcctccttttttctttattggttgtgaataaaattaaatccattccagcaaaaggaaaaacctcatcaaagaagaggaagcagagaaaagtaggtccaactacacctttagcaaccacagacaagaagttcacagctgaaggaggagaggagactcctatagctcagcgttttcacacaccatag

SEQ ID NO: 42 - DNA, 733 bp, Homo sapiens
gaagtgcgtcggtaggggagggctcacctctccaggttgaaacgatggcggtcagaaccgcctgaggtaaaaacgggtggcactggggaagcggaggcgtagctcccgagagcctcacacttgtgctcagtgccgcctcacccctggtggatccgcgatggccgcggattcccctggattgccggcgctgggcaggagcgccacttctaatctctcccgagactggacgcccggcgccttccacgcgcgttgtgtctttccgggcggtccctcgaagctggctaccccgcgggctgttgactgcagtgggatctggtcactcagatgcggatagagggctaaatgcaagatggtatggcatccagactctgctcataagtatctgcagtgatccataccttgattgtacatctactctgcatcctgaggacctgaacatgctaactggtggctgcagatttgtcttctaaggagcaagtgtggtctgtggacaggcagcttcagcctcacctgggattttgtttgcactagaaagtgccaagccctaccctagacctattaaagcagaactggcgtttaacaagacaccccaggtaatttgtgtgcaccttagagtctgagatgcactagtgtagtgattcgcagggggacaattttgacctccaggggacaatatctggagacatttttgggtgtcacaacgtgctggggagagggtgctactggcatctaa

SEQ ID NO: 43 - DNA, 2069 bp, Homo sapiens
catgccttgcgcgccgcgggcccagagacgtgaggctgtcggcgtcctggtggccccgcctcgtgtccccccccggaccccacgccgcgggagcttgggggttgcggtcttctcttcctccgacctcaccttcgatgcggaagcgcaggggcaggtgcgccgccctcggcccgcgcaggcggtgggcccgtctggggcaaggcgcccggaagcgcctggttggttcagaaaatcggaccgcagcgggagggcgggcaccggcgcgtggtctcagtggccccaggcgaaccctgatgagcagcagccgcaagtggcttactaaaggagccactttctacgtttgtctggaatttacgtgaattaagctggcgggcgggcggccaggcctgtagtctcagcactttgggaggctcagcacttcgggaggctgtggcgggcggatcacctgagcctgggagttggagaccagcctgcgcaacgtagcaagaccctatctctaaaacagattcattaatacttagccaggcgcggtggctgaggtcccagctactcggcaggcccaggctggcctgagccagaccgctctggactgttttaattttttcagccttaatacctgccagaattttttttttactatgtatctttgtccttacgtatataaattttatatacaattgagattatcctgtatttgcttttcccccctcacttttatatggtgacttttctcatgttaggctgaatactaacattttggaaactgtcggcctgaaaacgagcggagacacagtttctctaagtagagagtttatttgggccacacttgagcacaaattcaaggcgccctgaatgtgtactccgattagcagttaacagtggattttaaaggcaaaaaagggggccagggagtggactaataggaacttgtttgtgaggaattctcactggtttacagaaataacattgattagtgactgactatatgttgttcagctattgagtgtgggtatagtgtccattgtggcgtcattaggttaatttatagctgtttgtggcgctgttgccaccagtagcagtttaaagaggtgaacacaggtcaaggggtagtagggcgcgattgtcgcctcatttgaatgtctctctcggcctgataattaaaagaactcgcgttcctcagataaaaattctcttttctcaaaaccatttaaatgtggtaattagaatggcccagaaggggcacagtgccttttagccctcgccattacttgctcttaggagtgcattttttgtagctgtgggtttttgactatctctgctgctttctccagcccctaccctcgtgactacaagggaaaacgtgcggtgctcacgagagagcctttatgggatttttaaaaaatggggattgtgggaaaatggctccagcagtcacagtttttcagtttctcacaatcccataaaaacagagcaaccaggtaacaaaactaaagcatgggcaacatttacagaccactggatggtgaagaattcccatgaacccctggttcacactgtaaggacacactactcagcatgggcaacatttacagactactggatggtgaagaattcccatgaacccctggttcacactgtaaggacagactactcagcatgggcaacatttacagaccactggatgatgaagaattcccatgaactcctggttccaactgtaaggacacactactcagctgtagcctgaagccgcctccttacatactgtaagtttagcctataggtttctccatacgtagtgaacagtcatctaattggatgtgtggacactgtaacctactcttgaatcagtcacaggcagcagcacttcaaactctgtttcaataagccagacacgagctgtagccaccctgctgtttgcaggcctcacctctgccttctgtgcctcactcccttttctgtccgtaagtctttggccacacagtggcactggagtctctctgagcctattctggtttgaggggttccctgattcctgaatcattctttgctcaattaaactctgtaaa

SEQ ID NO: 44 - DNA, 774 bp, Homo sapiens
atgaaggtccatatgcttgtaggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgttt

SEQ ID NO: 45 - DNA, 1905 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaaaa

SEQ ID NO: 46 - DNA, 1794 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 47 - DNA, 1791 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 48 - DNA, 1710 bp, Homo sapiens
tctcgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 49 - DNA, 1936 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttaaaaaaaaaaaaaaaa

SEQ ID NO: 50 - DNA, 2748 bp, Homo sapiens
cttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaa

SEQ ID NO: 51 - DNA, 3747 bp, Homo sapiens
gaattcggccgctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcattccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacattatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 52 - DNA, 966 bp, Homo sapiens
atgaataaggagaatcactccttgatagctgagttcatcctcacaggatttacatatcatccaaagctgaagactgttctgtttgtggtgttctttgccatctatctgatcaccatggtggggaacattggtttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgatgtccaagacactctgcattcagatgactgcaggagcctacctagctggcaacctgcatcccatgattgaagtagagtttctgttgaggttaactttctgtgggtctcatcaaatcaatcattttttctgtgatgttcttccattatatagactttcttgtattaacccttatatcaatgaattggtgttatttatcttggcaggatcaattcaaatctttactatagtcttagtttcttatttctacatccttttcacaatatttacaatgaaatccaaggagggaagaggcaaagctttatctacttgtgcatctcactttctctctgtgtcaatattctgtgattcccttctcttcatgtatgctcgaccaggtgcagttaatgaaggggataaagatatacctgttgctatattttatactttagttattcctttattaaatccttttatttatagcctaagaaataaggaagtaataaatattatgaaaaaaattatgaagaagagaaaattttgtcacattctgaaacaaatgtcatcccctctggcaacttga

SEQ ID NO: 53 - DNA, 966 bp, Homo sapiens
atggctagggaaaatcactccttagcagctgaattcatcctcataggatttacaaattatccagagctgaagacgcttctgtttgtggtgttctctgccatctatctggtcaccatggtggggaatcttggtctggtggcattaatttatgtagagcgtcgtcttctcacaccaatgtacatctttctgggcaacctggctctgatggattcctgctgttcctgtgctgttacccccaagatgttagagaatttcttttctgaggatagaattatttccctgtatgaatgtatggcacaattttattttctctgtcttgctgaaaccacagactgctttcttctggcgacaatggcctatgaccgctatgtggccatatgccacccactgcagtaccacaccatgatgtccaagacgctctgcattcggatgaccacaggggccttcaaagctggaaacctgcattccatgattcatgtagggcttttattaaggttaactttctgcaggtctaataaaattcaccactttttctgtgatattcttccactgtatagactctcctgtacagatccttctattaatgaactaatgatatatatcttttcaataccaattcaaatctttaccattgctactgtcttgatctcttatctctgcatccttttgactgttttcaaaatgaaatccaaggagggaagaggtaaagcattttctacctgtgcatcccactttctctctgtctcaatattttacatttgtcttctcatgtatattggaccatctgaagaaggagataaagatacaccagtggcaatattttatgcaatagtaatcccattactaaacccttttatttatagtctgagaaataaggaggtcataaatgttcttaaaaaaattatgaggaattataacattcttaaacaaacttgctctatagcaaatttatttttaatttattaa

SEQ ID NO: 54 - DNA, 1323 bp, Homo sapiens
acgtctcctctcgcccctaggggagaagcgtggactggggacgtggggggacccggggacggctccatcctcctttccccatccctacccccaccccagtgtctcctgaggcacagggtccccacgggccgggctgaccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaaaaaaaaaaaaaaaaaaaaaaaaaaaaaaaaaaaaaaaaaaaa

SEQ ID NO: 55 - DNA, 1475 bp, Homo sapiens
cttcccagatcaggaagccagctgagagacagggctacgtttcagggagggaaacagattcagcagcggcagcagctggagaaggtcgtggagcagcaccttgcctgcagggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaaa

SEQ ID NO: 56 - DNA, 1551 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaaaaaaaaaaaa

SEQ ID NO: 57 - DNA, 1851 bp, Homo sapiens
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaaaaaaaaaaaa

SEQ ID NO: 58 - DNA, 462 bp, Homo sapiens
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagcggcaataaataaaattcggtatgctgaattcaataaaaaaaaaa

SEQ ID NO: 59 - DNA, 4070 bp, Homo sapiens
gccgccagcgcttccatccccgccccggcgggtccaagccggtgccgggcgcccaggggttgccgcgctgggcgggagggcagcgcctgagagggcggtggggtggcggggttcctgcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctcttctttgcagttggcattgcccaatatgccctgttaggatacttcatccgctcctggaggaccctagccattctggttaacctgcagggaacggtggtctttctcttatctttattcattcctgaatcacctcgttggttatactcccagggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtttggtcggaagcgaacattatcagcatttctgtgcctaggaggactggcttgtcttattgtaatgtttcttccagaaaagaaagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtatccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatgtaccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattatgagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcccctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttc

SEQ ID NO: 60 - DNA, 2172 bp, Homo sapiens
atattggtaaaggcattagggcgaaggtggaacggaacttcctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaaaaaaaaaaaaaaaaaaaaaa

SEQ ID NO: 61 - DNA, 2475 bp, Homo sapiens
atattggtaaaggcattagggcgaaggtggaacggaacttcctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaaaaaaaaaaaaaaaaaaaaaa

SEQ ID NO: 62 - DNA, 1869 bp, Homo sapiens
gctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacaccggtgctcctacagccacggctccgggcggggaaggcgagccccacagccggccctgcgacgccctcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagagcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgaaaaaaaaaaaaaaaaaa

SEQ ID NO: 63 - DNA, 2174 bp, Homo sapiens
gaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccaaaaaaaaaaaaaaaaaaaaaaaaaaaaaaaaaaaaa

SEQ ID NO: 64 - DNA, 3060 bp, Homo sapiens
gttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 65 - DNA, 3306 bp, Homo sapiens
gttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 66 - DNA, 3093 bp, Homo sapiens
tcagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtgaaaaaaaaaaaaaaaaa

SEQ ID NO: 67 - DNA, 2510 bp, Homo sapiens
gcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaaaaaaaaaaaaaaaaaaaaaaaaa

SEQ ID NO: 68 - DNA, 4878 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccacgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 69 - DNA, 5262 bp, Homo sapiens
atgctcaggacctcggggctggcactgctggctctggtcagtgctgtgggcccaagccaggccagcggcttcacagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaagctccagagagggaccctgtgggctcctggtacaacgtcaccatactggtgaaaatggacttcaaggaactccagcaagtggaccccaggctcctgaaccacatgcgccttctgcattccttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccaatgcccaggtatttgaagtcacaataaagattgtaaaccacaacctgacggagaagttactcaaccgcagcagtgtggagtaccaggacttttctagacaactgcttcacgaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtgacctggtgagccccacgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtgttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacagcagcccggaagctcattggaaaggtcagaatcaaaaatgtcaggtactcagaatcctttcgcaacgcaagcagccaggagtatcgagatttcctagaactattcttcaggatggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcaattgcaataactttcggttgctgcaaaatagtgaaacctctgccacacaccagatgtcctggggacccctcatccggtctgaaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctc

SEQ ID NO: 70 - DNA, 757 bp, Homo sapiens
agatgcgaggtgggcgggggcaggctgaaagttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctataaaaaaaaaaaaaaaa

SEQ ID NO: 71 - DNA, 2322 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 72 - DNA, 2455 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 73 - DNA, 2452 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 74 - DNA, 3871 bp, Homo sapiens
ctcgtgccgccagccaaccgcgcggccgcttgttgagccagggctccaccgtcgccatgacgcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagaggacataagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaaaaaaaaaaaaaaaaaaaaaaaaaa

SEQ ID NO: 75 - DNA, 1795 bp, Homo sapiens
ctcgtgccgccagccaaccgcgcggccgcttgttgagccagggctccaccgtcgccatgacgcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaattttatcaaaaaaaaaaaaaaaaaaaaaaaaaaaaaaaaaaaaaaaaaaaaaaaaaaaaa

SEQ ID NO: 76 - DNA, 3048 bp, Homo sapiens
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtcaaaaaaaaaaaaaaaaaa

SEQ ID NO: 77 - DNA, 612 bp, Homo sapiens
aagactgttctgtttgtggtgttctttgccatctatctgatcaccatggtggggaacattgatttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgattgtcttaatatcttatctctatattcttcttactattttcaaaatgaaatccaaagagggaagggccaaagctttttctacctgtgcatcccactttttgtcagtttcattattctatggatctcttttcttcatgtacgttagaccaaatttgcttgaagaaggggataaagatataccagctgcaattttatttacaatagtagttcccttactaaatcctttcatttatagcctgagaaatagggaagtaataagtgtcttaagaaaaatt

SEQ ID NO: 78 - DNA, 1945 bp, Homo sapiens
cctttcagtggccctcgtggaacggtaggaagctgagctggactctctgccacatcgttcggttcccacaacagcctgatgaagcagcagcagaaaaaatggaagccattttggttaacgggtcacatcttagcagttggcagcgtaagaagcggaaggatccactggtcagaaatggagattgaggagaagctgagagcacggagggcttcaggggagagcctgtcctttggaaaagcgggcagtttgcactcgtggtagatgagtggggaggccgctcagtctctctgcccctttgcacatgctgcacccgtttagtttgacgtcgtggagagctcctccaggcacgggctgtgtgaaagggtttaaaagtttgggggcatggctgggggtccccgcatgaggggtgctgtgtaggctcccatcttttctgccggtcatgctgggagccaacagcaccggctcctgacgtggggacttgccctgtgccatgacgtggggactcgccctgtgccctgcgccccggttcctgctggttctgtgccttctggactcatttcctttccagggtccgcaaccgcttccgacacaatcactattttggctgcggccacggcttcattcgcttcagctgcgagcttttctcagcgcagagagcacagggaagctgggaggagtccgcctagatggaatcttccagaagcaacatgactcttttaggcctttgctgccagctaagaaggtgaagaaaagtcaccactgcaataaaaagagggcactttgtcttacttggcaataaaccaccaccagcagcagcagcaatagcagcacccccacccccaccaaacccaaaacaaacaagaaaagcaaaaggaaaccttcgttttcagtgagaggattggcatgaagaatccttgggacacaggaatcaatcaagacctttggatgcccctgcctgctctgtctctagaagcctcaagcccagcatccccatgccgacgtgctcatctctagcaaaacaccagcctctcagccctctctccataaaggccactagaaagtactgtgatgccaggctgctccacatccaggcagcctgggtgaccactgccctttatgagaatcagaaaaagctgtctcccgagtagttggaattacaggtgcatgccaccatgcctggctaatttttgtatttttagtagagatggagtttcactatgttggccaggctgctcttgaactcctgacctcaaatgatccacccgactcggcctcccaaagagctggaattacaggagaagctaaacgttttaaaataagtatattatttctgaattactataacagacatggactccatttgaacaagatacttaattccatcaaaaacttgtcaaaatatacaaatttagtcacaagacactttactaccatctaccaaagctgtagtaaacacacacattttccatctttgaaatgaaataacgtataataatgttttccaaaataacaaagatgtctgcagtgaatagcactccctttgatgtggcaactgggtcaatcgtgttaacaactgtgaattcatctttttaagaaattcttttattgtttcttttcttttccgcgacagtctcactcgtgttgccccggctggagtgcagtggcgctatcttggctcactgcagcctccgcctcccgggttcaagcaattctcatgcctcagcctcctgagtagctgggattataggcacgtgccaccacacccagctaatttttttgtatttttagtagagacggggtttgaccatgttggtcagggtggtctcgaattcctgacctcagttgagccgccggcctcggcctcccaggaagtgctgggattacaggcatgagccaccaggcccggccttattgtttctatttgtaataaatctgttccccttgc

SEQ ID NO: 79 - DNA, 859 bp, Homo sapiens
gtgctgtttttgtggtagtgagtaagtctcacaagatccgatggttttataaagggcagttcccctgcacaagctctcttctctgccaccacgcgtttgctgttcattcacctttcaccatgattgtgaggcctcccagccatgtggaactgtgcagactgaaagcttacaactgttacattaaatccagatggattggtttctttgcaataatcgtaactcgtctcttcctcccacgtttttaatattaagaaggtgtctatacaaatgcccttagccacatttatggtggtttctgaagaggaaaagtgttccatgaaagatgctggcccagagttatcaactggaaatcagtccaagaaaagatagttttctgtgttaataattttttctcagtgcgattgaattcttgcaatggttacacacagatgactttgattgatttgaaacattctctcctcttcttcccctcctcctccaactccttctcctttcatcctttcttggattcttgtgagagccttcttctgggacaattcccattctagttccagcctcagcacacctgtctggtattaggctgtgattgttctcatcattgaaaaaatagggaaactgagttatcaaagatcttattggttgaattgctctgaatatcagactgcctagcccaacacaggtaaaagagagtatcttatgtaataacagagtcaggtttctgatgataaaatgaagccacaatttcattaatatacaaaatgataatgagtgagtaaccaaaagccctccaaagcttacatcctagagtcccaaaatcccagatgccaggactgggcatggcatgttctttcattcctta

SEQ ID NO: 80 - DNA, 1097 bp, Homo sapiens
aggattctcccgagcccctgaaaaaaaaaaaaggtggagagactttgaaaacttttctctcgaaaagtctgaggaggcagaggacggcccggagtctcgtagcgcaccgccctggtcccacaccccccgcagccctaggaggatcggtgtgctgagcttgtggccaggagctccccgagccactttcgcgcgagcagcagaaaacctgagccgcggcccggcgagtgtcggcggcgctctggggaggagaggctgggaaggggctgcgagagatgctacttaagaacgtgaggctgagaggcggacttggtcagatctgcctgcgtgacaagctcaggacaggacgcttctgcccttgcattactgttgtaaaagtttccacccagtccctggtcgcactgcgttcccatcccggcagatgtgaactcaaaaacttcctccgctgtgcagtttcaattggcagacacaccctgtacctgaatgactcagaaggaggcagaatgaacaaacaacagacccctgacttctgggattttgtgagtttgccaaaaaaaaaaaaaaaagaagtatattgtgtctacccagcacaacaaaacgggggacttggcattcccccccttctcccgcctccacccacactaatttatgcattctttaaagccaaaggaatcaaagtgaaatttcacacctagtctgtatcaagcatgtgctaggttaatttaaccttactgctctgtgaagtaagtaagcattgctggccattttattgttgagagaagtgtcattcagacaactaaggtgacttgtagatttcccagctagtgagtggcagagctgggttccaaaacctaaatattgcaaatgccttgccttgtggctcaaacgctatcagtcaataaatagttaaggaattgaaatatatgttcctagagggaaacagacttctagatttaaagttttacatttgctgcatttctgactgtacaagtctacaaaatgcatataaaagtatgctaatgaatgtccttttaaaaccactcattttctacgtaagcatacaaagtgtatacatatgcatattaatgaatgttttctga

SEQ ID NO: 81 - protein, 2261 aa, Homo sapiens
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 82 - protein, 655 aa, Homo sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 83 - protein, 238 aa, Homo sapiens
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 84 - protein, 2843 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 85 - protein, 411 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 86 - protein, 395 aa, Homo sapiens
MPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 87 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPAPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGLPPREGPSRRAEEPGSRGDKEPGLPPPR

SEQ ID NO: 88 - protein, 619 aa, Homo sapiens
MAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGASPRRVRHDSPDPSPPRRARHGSSDISSPRRVHNNSPDTSRRTLGSSDTQQLRRARHDSPDLAPNVTYSLPRTKSGKAPERASSKTSPHWKESGASHLSFPKNSKYEYDPDISPPRKKQAKSHFGDKKQLDSKGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 89 - protein, 362 aa, Homo sapiens
MKYLTVGDLEDCLLNKVDLRRQQISQAVEEVQKVVHHLTTNISNQDIRFQAVPYSDTYNENIKVLAPSQFLVTVPIKGLAGYREAREQHWRYYTLQGTRLPCPLRDPEGLQQWLEVEQFMKSLWQWHETDVNIDGDIVPAKVLLVFRKLVENAVRTCHLSGKVSLLGNRSAVWVAVETSAYQVELELVPAVEIPTTWSKKARWPRCLQRWPSQERVECIKSFGFNLLACSNYHWQLSFLRAEQVLLEQLDEDGGCRRKCFQVMRHLKEDIWCPGNRPVITSHHLQTVLFWTCEKYPHFKDWQVFSKAFLRLVRKLHKCVSQHFLKHYFVRNSNLFQCANPTELDTVAQKLATFLKNPQIGPP

SEQ ID NO: 90 - protein, 458 aa, Homo sapiens [sequence omitted]

SEQ ID NO: 91 - protein, 234 aa, Homo sapiens [sequence omitted]

SEQ ID NO: 92 - protein, 325 aa, Homo sapiens
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPKASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 93 - protein, 2701 aa, Homo sapiens
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNAKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHAEVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSTLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKEVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQFNIKQISEVQEKVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQKLHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEAQNLSMQSVRMDNFQLTKKLHESLEEIRIVAKERDELRRIKESLKMERDQFIATLREMIARDRQNHQVKPEKRLLSDGQQHLTESLREKCSRIKELLKRYSEMDDHYECLNRLSLDLEKEIEFQKELSMRVKANLSLPYLQTKHIEKLFTANQRCSMEFHRIMKKLKYVLSYVTKIKEEQHESINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 94 - protein, 406 aa, Homo sapiens
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 95 - protein, 882 aa, Homo sapiens
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 96 - protein, 846 aa, Homo sapiens
MLFTVSCSKMSSIVDRDDSSIFDGLVEEDDKDKAKRVSRNKSEKKRRDQFNVLIKELGSMLPGNARKMDKSTVLQKSIDFLRKHKEITAQSDASEIRQDWKPTFLSNEEFTQLMLEALDGFFLAIMTDGSIIYVSESVTSLLEHLPSDLVDQSIFNFIPEGEHSEVYKILSTHLLESDSLTPEYLKSKNQLEFCCHMLRGTIDPKEPSTYEYVKFIGNFKSLNSVSSSAHNGFEGTIQRTHRPSYEDRVCFVATVRLATPQFIKEMCTVEEPNEEFTSRHSLEWKFLFLDHRAPPIIGYLPFEVLGTSGYDYYHVDDLENLAKCHEHLMQYGKGKSCYYRFLTKGQQWIWLQTHYYITYHQWNSRPEFIVCTHTVVSYAEVRAERRRELGIEESLPETAADKSQDSGSDNRINTVSLKEALERFDHSPTPSASSRSSRKSSHTAVSDPSSTPTKIPTDTSTPPRQHLPAHEKMVQRRSSFSSQSINSQSVGSSLTQPVMSQATNLPIPQGMSQFQFSAQLGAMQHLKDQLEQRTRMIEANIHRQQEELRKIQEQLQMVHGQGLQMFLQQSNPGLNFGSVQLSSGNSSNIQQLAPINMQGQVVPTNQIQSGMNTGHIGTTQHMIQQQTLQSTSTQSQQNVLSGHSQQTSLPSQTQSTLTAPLYNTMVISQPAAGSMVQIPSSMPQNSTQSAAVTTFTQDRQIRFSQGQQLVTKLVTAPVACGAVMVPSTMLMGQVVTAYPTFATQQQQSQTLSVTQQQQQQSSQEQQLTSVQQPSQAQLTQPPQQFLQTSRLLHGNPSTQLILSAAFPLQQSTFPQSHHQQHQSQQQQQLSRHRTDSLPDPSKVQPQ

SEQ ID NO: 97 - protein, 876 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 98 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 99 - protein, 919 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNASFSLFSRNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 100 - protein, 395 aa, Homo sapiens
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 101 - protein, 3036 aa, Homo sapiens
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTTTDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSFRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEYAKQSIFRNIGAGVMQIDIIQGNRLFSCGADGTLKTRVLPNAFNIPNRILDIL

SEQ ID NO: 102 - protein, 235 aa, Homo sapiens
MTQVTEKSTEHPEKTTSTTEKTTRTPEKPTLYSEKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 103 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 104 - protein, 364 aa, Homo sapiens; identical to SEQ ID NO: 103

SEQ ID NO: 105 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLASGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 106 - protein, 210 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 107 - protein, 196 aa, Homo sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRYVVDLSVMTGLGKTGCTPTTACPSMSCWPQSSLKP

SEQ ID NO: 108 - protein, 647 aa, Homo sapiens
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 109 - protein, 607 aa, Homo sapiens
MPRKKPFSVKQKKKQLQDKRERKRGLQDGLRSSSNSRSGSRERREEQTDTSDGESVTHHIRRLNQQPSQGLGPRGYDPNRYRLHFERDSREEVERRKRAAREQVLQPVSAELLELDIREVYQPGSVLDFPRRPPWSYEMSKEQLMSQEERSFQDYLGKIHGAYSSEKLSYFEHNLETWRQLWRVLEMSDIVLLITDIRHPVVNFPPALYEYVTGELGLALVLVLNKVDLAPPALVVAWKHYFHQHYPQLHVVLFTSFPRDPRTPQDPSSVLKKSRRRGRGWTRALGPEQLLRACEAITVGKVDLSSWREKIARDVAGATWGNGSGEEEEEEDGPAVLVEQQTDSAMEPTGPTQERYKDGVVTIGCVGFPNVGKSSLINGLVGRKVVSVSRTPGHTRYFQTYFLTPSVKLCDCPGLIFPSLLPRQLQVLAGIYPIAQIQEPYTAVGYLASRIPVQALLHLRHPEAEDPSAEHPWCAWDICEAWAEKRGYKTAKAARNDVYRAANSLLRLAVDGRLSLCFHPPGYSEQKGTWESHPETTELVVLQGRVGPAGDEEEEEEEELSSSCEEEGEEDRDADEEGEGDEETPTSAPGSSLAGRNPYALLGEDEC

SEQ ID NO: 110 - protein, 617 aa, Homo sapiens [sequence omitted]

SEQ ID NO: 111 - protein, 617 aa, Homo sapiens [sequence omitted]

SEQ ID NO: 112 - protein, 2406 aa, Homo sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGYKSNEEYVYVRGRGRGKYVCEECGIRCKKPSMLKKHIRTHTDVRPYVCKHCHFAFKTKGNLTKHMKSKAHSKKCQETGVLEELEAEEGTSDDLFQDSEGREGSEAVEEHQFSDLEDSDSDSDLDEDEDEDEEESQDELSRPSSEAPPPGPPHALRADSSPILGPQPPDAPASGTEATRGSSVSEAERLTASSCSMSSQSMPGLPWLGPAPLGSVEKDTGSALSYKPVSPRRPWSPSKEAGSRPPLARKHSLTKNDSSPQRCSPAREPQASAPSPPGLHVDPGRGMGALPCGSPRLQLSPLTLCPLGRELAPRAHVLSKLEGTTDPGLPRYSPTRRWSPGQAESPPRSAPPGKWALAGPGSPSAGEHGPGLGLDPRVLFPPAPLPHKLLSRSPETCASPWQKAESRSPSCSPGPAHPLSSRPFSALHDFHGHILARTEENIFSHLPLHSQHLTRAPCPLIPIGGIQMVQARPGAHPTLLPGPTAAWVSGFSGGGSDLTGAREAQERGRWSPTESSSASVSPVAKVSKFTLSSELEGGDYPKERERTGGGPGRPPDWTPHGTGAPAEPTPTHSPCTPPDTLPRPPQGRRAAQSWSPRLESPRAPTNPEPSATPPLDRSSSVGCLAEASARFPARTRNLSGEPRTRQDSPKPSGSGEPRAHPHQPEDRVPPNA

SEQ ID NO: 113 - protein, 295 aa, Homo sapiens
MEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 114 - protein, 700 aa, Homo sapiens [sequence omitted]

SEQ ID NO: 115 - protein, 324 aa, Homo sapiens
MKCVLVATEGAEVLFYWTDQEFEESLRLKFGQSENEEEELPALEDQLSTLLAPVIISSMTMLEKLSDTYTCFSTENGNFLYVLHLFGECLFIAINGDHTESEGDLRRKLYVLKYLFEVHFGLVTVDGHLIRKELRPPDLAQRVQLWEHFQSLLWTYSRLREQEQCFAVEALERLIHPQLCELCIEALERHVIQAVNTSPERGGEEALHAFLLVHSKLLAFYSSHSASSLRPADLLALILLVQDLYPSESTAEDDIQPSPRRARSSQNIPVQQAWSPHSTGPTGGSSAETETDSFSLPEEYFTPAPSPGDQSSGEDRRKAGGNNS

SEQ ID NO: 116 - protein, 223 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 117 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 118 - protein, 1179 aa, Homo sapiens
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 119 - protein, 613 aa, Homo sapiens
MATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 120 - protein, 814 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMKEEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDFQHERSQLLSNKSSGGWEVQDQGTGRFDVCDVNARKILPSPCPSPHSQKQSSTSTPLGDSIPKRPVSSIPLTGDSQTDSDIIAFIKARQSILQKQCLGSN

SEQ ID NO: 121 - protein, 196 aa, Homo sapiens [sequence omitted]

SEQ ID NO: 122 - protein, 134 aa, Homo sapiens
GKNGWHWGSGGVAPESLTLVLSAASPLVDPRWPRIPLDCRRWAGAPLLISPETGRPAPSTRVVSFRAVPRSWLPRGLLTAVGSGHSDADRGLNARWYGIQTLLISICSDPYLDCTSTLHPEDLNMLTGGCRFVF

SEQ ID NO: 123 - protein, 106 aa, Homo sapiens
MPCAPRAQRREAVGVLVAPPRVPPRTPRRGSLGVAVFSSSDLTFDAEAQGQVRRPRPAQAVGPSGARRPEAPGWFRKSDRSGRAGTGAWSQWPQANPDEQQPQVAY

SEQ ID NO: 124 - protein, 201 aa, Homo sapiens
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 125 - protein, 535 aa, Homo sapiens
MTPLVSRLSRLWAIMRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 126 - protein, 522 aa, Homo sapiens
MRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 127 - protein, 521 aa, Homo sapiens
MRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 128 - protein, 521 aa, Homo sapiens; identical to SEQ ID NO: 127

SEQ ID NO: 129 - protein, 546 aa, Homo sapiens
MTPLVSRLSRLWAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 130 - protein, 461 aa, Homo sapiens
MRPADLPPRPMEESPASSSAPTETEEPGSSAEVMEEVTTCSFNSPLFRQEDDRGITYRIPALLYIPPTHTFLAFAEKRSTRRDEDALHLVLRRGLRIGQLVQWGPLKPLMEATLPGHRTMNPCPVWEQKSGCVFLFFICVRGHVTERQQIVSGRNAARLCFIYSQDAGCSWSEVRDLTEEVIGSELKHWATFAVGPGHGIQLQSGRLVIPAYTYYIPSWFFCFQLPCKTRPHSLMIYSDDLGVTWHHGRLIRPMVTVECEVAEVTGRAGHPVLYCSARTPNRCRAEALSTDHGEGFQRLALSRQLCEPPHGCQGSVVSFRPLEIPHRCQDSSSKDAPTIQQSSPGSSLRLEEEAGTPSESWLLYSHPTSRKQRVDLGIYLNQTPLEAACWSRPWILHCGPCGYSDLAALEEEGLFGCLFECGTKQECEQIAFRLFTHREILSHLQGDCTSPGRNPSQFKSN

SEQ ID NO: 131 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 132 - protein, 321 aa, Homo sapiens
MNKENHSLIAEFILTGFTYHPKLKTVLFVVFFAIYLITMVGNIGLVALIYIEQRLHTPMYIFLGNLVLMDSCCSSAITPKMLENFFSEDKRITLYECMAQFYFLCLAETTDCFLLAAMAYDCYVAICNPLQYHTMMSKTLCIQMTAGAYLAGNLHPMIEVEFLLRLTFCGSHQINHFFCDVLPLYRLSCINPYINELVLFILAGSIQIFTIVLVSYFYILFTIFTMKSKEGRGKALSTCASHFLSVSIFCDSLLFMYARPGAVNEGDKDIPVAIFYTLVIPLLNPFIYSLRNKEVINIMKKIMKKRKFCHILKQMSSPLAT

SEQ ID NO: 133 - protein, 321 aa, Homo sapiens
MARENHSLAAEFILIGFTNYPELKTLLFVVFSAIYLVTMVGNLGLVALIYVERRLLTPMYIFLGNLALMDSCCSCAVTPKMLENFFSEDRIISLYECMAQFYFLCLAETTDCFLLATMAYDRYVAICHPLQYHTMMSKTLCIRMTTGAFKAGNLHSMIHVGLLLRLTFCRSNKIHHFFCDILPLYRLSCTDPSINELMIYIFSIPIQIFTIATVLISYLCILLTVFKMKSKEGRGKAFSTCASHFLSVSIFYICLLMYIGPSEEGDKDTPVAIFYAIVIPLLNPFIYSLRNKEVINVLKKIMRNYNILKQTCSIANLFLIY

SEQ ID NO: 134 - protein, 207 aa, Homo sapiens
MVAPVTGYSLGVRRAEIKPGVREIHLCKDERGKTGLRLRKVDQGLFVQLVQANTPASLVGLRFGDQLLQIDGRDCAGWSSHKAHQVVKKASGDKIVVVVRDRPFQRTVTMHKDSMGHVGFVIKKGKIVSLVKGSSAARNGLLTNHYVCEVDGQNVIGLKDKKIMEILATAGNVVTLTIIPSVIYEHMVKKLPPVLLHHTMDHSIPDA

SEQ ID NO: 135 - protein, 207 aa, Homo sapiens; identical to SEQ ID NO: 134

SEQ ID NO: 136 - protein, 335 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 137 - protein, 435 aa, Homo sapiens
MQGQGRRRGTCKDIFCSKMASYLYGVLFAVGLCAPIYCVSPANAPSAYPRPSSTKSTPASQVYSLNTDFAFRLYRRLVLETPSQNIFFSPVSVSTSLAMLSLGAHSVTKTQILQGLGFNLTHTPESAIHQGFQHLVHSLTVPSKDLTLKMGSALFVKKELQLQANFLGNVKRLYEAEVFSTDFSNPSIAQARINSHVKKKTQGKVVDIIQGLDLLTAMVLVNHIFFKAKWEKPFHPEYTRKNFPFLVGEQVTVHVPMMHQKEQFAFGVDTELNCFVLQMDYKGDAVAFFVLPSKGKMRQLEQALSARTLRKWSHSLQKRWIEVFIPRFSISASYNLETILPKMGIQNVFDKNADFSGIAKRDSLQVSKATHKAVLDVSEEGTEATAATTTKFIVRSKDGPSYFTVSFNRTFLMMITNKATDGILFLGKVENPTKS

SEQ ID NO: 138 - protein, 78 aa, Homo sapiens
MGSGLPLVLLLTLLGSSHGTGPGMTLQLKLKESFLTNSSYESSFLELLEKLCLLLHLPSGTSVTLHHARSQHHVVCNT

SEQ ID NO: 139 - protein, 547 aa, Homo sapiens
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFIPESPRWLYSQGRLSEAEEALYLIAKRNRKLKCTFSLTHPANRSCRETGSFLDLFRYRVLLGHTLILMFIWFVCSLVYYGLTLSAGDLGGSIYANLALSGLIEIPSYPLCIYLINQKWFGRKRTLSAFLCLGGLACLIVMFLPEKKDTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 140 - protein, 469 aa, Homo sapiens
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 141 - protein, 469 aa, Homo sapiens; identical to SEQ ID NO: 140

SEQ ID NO: 142 - protein, 398 aa, Homo sapiens
MDPVVGCGRGLFGFVFSAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 143 - protein, 470 aa, Homo sapiens
MSAQVLGFLRSWTPLPLAAPRGPAAAGNDAGAPTATAPGGEGEPHSRPCDARLGSTDKELKAGAAATGSAPTAPGTPWQREPRVEVMDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 144 - protein, 345 aa, Homo sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 145 - protein, 345 aa, Homo sapiens; identical to SEQ ID NO: 144

SEQ ID NO: 146 - protein, 571 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQADPDYLPRTENFGLDYDAFQHMVGDCPPDFLQLTFNCCNMDPKLRPSFVEIGKTLEEILSRLQEEEQERDRKLQPTARGLLEKAPGVKRLSSLDDKIPHKSPCPRRTIWLSRSQSDIFSRKPPRTVSVLDPYYRPRDGAARTPKVNPFSARQDLMGGKIKFFDLPSKSVISLVFDLDAPGPGTMPLADWQEPLAPPIRRWRSLPGSPEFLHQEACPFVGREESLSDGPPPRLSSLKYRVKEIPPFRASALPAAQAHEAMDCSILQEENGFGSRPQGTSPCPAGASEEMEVEERPAGSTPATFSTSGIGLQTQGKQDG

SEQ ID NO: 147 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 148 - protein, 1246 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPTGGGLSAATGVTVPGLGTGTAALGLENFTLSPSPGYPQGTPAAGQAWTPEPSPRRGGSNVVGYDRNNTGKGVEQELQGNSTMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 149 - protein, 1374 aa, Homo sapiens
MVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPTGGGLSAATGVTVPGLGTGTAALGLENFTLSPSPGYPQGTPAAGQAWTPEPSPRRGGSNVVGYDRNNTGKGVEQEVPSTAPGLGMDQGSPSQVNPSQGSPSQGSLRQESTSQASPSQRSTSQGSPSQVNPSQGSTSHANSSQGSPSQGSPSQESPSQGSTSQASPSHRNTIGVIGTTSSPKATGSTHSFPPGATDGPLALPGQLQGNSTMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 150 - protein, 100 aa, Homo sapiens
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 151 - protein, 242 aa, Homo sapiens
MVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 152 - protein, 367 aa, Homo sapiens
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 153 - protein, 366 aa, Homo sapiens
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 154 - protein, 848 aa, Homo sapiens
MTPGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMWPERIYQSPYGVTAVDFSIGAPNLLAVGYHNGTIAIYNVRSNSNVPVLDSSESPQKHLGPVWQLQWIEQDRGTTGDGKREILVSISADGRISKWVIRKGLDCYDLMRLKRTTAASNKKGGEKEKKDEALISRQAPGMCFAFHPKDTNIYLAGTEEGHIHKCSCSYNEQYLDTYRGHKGPVYKVTWNPFCHDVFLSCSADWGVIIWQQENVKPSLSFYPATSVVYDVAWSPKSSYIFAAANENRVEIWDLHISTLDPLIVNTANPGIKFTTILFAKQTDCLLVGDSDGQVSVYELRNMPTVLETGRGDIMDTLLGSKSNQSA

SEQ ID NO: 155 - protein, 545 aa, Homo sapiens
MTPGKHSGASARAANAGAWGYRDFRGGQKKGWWTTPQLVATMPVSPAGSHKQQNFGLNNATQPKKSISFFATMKATSVKGYTGANQSRMAVSKTVLIPPELKTVEKPNPNIKTTQVFDINGTDVTPRPLYHPDPLTGTAKPSKLLTSQEGSLGSEFISSYSLYQNTINPSTLGQFTRSVLGSSTVSKSSVSASESIAEDLEEPSYKRERLTSFTDLQVIRAAPEKIVTKEDLEKNIEIILTETETLRFFDLPTVMVSVESEEAEKVTQRNKNYEVLCRNRLGNDLYVERMMQTFNGAPKNKDVQCDKIIMEDKGIMSTAWDLYDSYNAMELVSLSVKQSVVESSSKANVLPKDQDQRLPGSTTEKNSETSSLMDIENVILAKIHEDEEDHSDAILKSDKFHQDLFFMERVLMENIFQPKLAAYRQLPVLKEPEPEEPEDVLESAKHEEVEEESKKEEEEEIHAEESTIPANLERLWSFSCDLTKGLNVSSLAWNKTNPDLLAVGYGHFGFKEQKRGLACCWSIKNPMVTQTRIRSIFIWLLTKFS

SEQ ID NO: 156 - protein, 706 aa, Homo sapiens
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEISHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 157 - protein, 189 aa, Homo sapiens
MVGNIDLVALIYIEQRLHTPMYIFLGNLVLMDSCCSSAITPKMLENFFSEDKRITLYECMAQFYFLCLAETTDCFLLAAMAYDCYVAICNPLQYHTMIVLISYLYILLTIFKMKSKEGRAKAFSTCASHFLSVSLFYGSLFFMYVRPNLLEEGDKDIPAAILFTIVVPLLNPFIYSLRNREVISVLRKI

SEQ ID NO: 158 - protein, 119 aa, Homo sapiens
ESEKAVSRVVGITGACHHAWLIFVFLVEMEFHYVGQAALELLTSNDPPDSASQRAGITGEAKRFKISILFLNYYNRHGLHLNKILNSIKNLSKYTNLVTRHFTTIYQSCSKHTHFPSLK

SEQ ID NO: 159 - protein, 41 aa, Homo sapiens
MIVRPPSHVELCRLKAYNCYIKSRWIGFFAIIVTRLFLPRF

SEQ ID NO: 160 - protein, 160 aa, Homo sapiens
AAARRVSAALWGGEAGKGLREMLLKNVRLRGGLGQICLRDKLRTGRFCPCITVVKVSTQSLVALRSHPGRCELKNFLRCAVSIGRHTLYLNDSEGGRMNKQQTPDFWDFVSLPKKKKKEVYCVYPAQQNGGLGIPPLLPPPPTLIYAFFKAKGIKVKFHT

SEQ ID NO: 161 - DNA, 201 bp, Homo sapiens
gctaccagttacatttgacaagtctgtgcaatggatcaaaatcagaagagatgattcaacttggtgaccaagaagtttctgagctttgtggcctaccaagrgagaaactggctgcagcagagcgagtacttcgttccaacatggacatcctgaagccaatcctgagaacactaaactctacatctcccttcccgagcaagg

SEQ ID NO: 162 - DNA, 201 bp, Homo sapiens
tcctgagatcctgagcctttggttaagaccgagctctattaagctgaaaagataaaaactctccagatgtcttccagtaatgtcgaagtttttatcccagrgtcacaaggaaacaccaatggcttccccgcgacagcttccaatgacctgaaggcatttactgaaggagctgtgttaagttttcataacatctgctatcga

SEQ ID NO: 163 - DNA, 201 bp, Homo sapiens
tagttttaaaaccagaattggaccttggatttttattttggcaattgtaactccatctaatcaagaaagaataaaagtttattgcacttctttttgagaamtatgttaaagtcaaaggggcatatatagagtaaggcttttgtgtatttaatcctaaaggtggctgtaatcatgaacctaggccaccatggggacctgaga

SEQ ID NO: 164 - DNA, 201 bp, Homo sapiens
tctagaccagcttctcccactaggtcccaggcacaaactccagttttaagtccttcccttcctgatatgtctctatccacacattcgtctgttcaggctgrtggatggcgaaaactcccacctaatctcagtcccactatagagtataatgatggaagaccagcaaagcgccatgatattgcacggtctcattctgaaagt

SEQ ID NO: 165 - DNA, 201 bp, Homo sapiens
tcaggaccaacgtacagaggtgcagttccatggtacaccataaatcttgacttaccaccctacaaaagatggcatgaattgatgcttgacaaggcaccaargctaaaggttatagtgaattctctgaagaatatgataaatacattcgtgccaagtggaaaagttatgcaggtggtggatgaaaaattgcctggcctactt

SEQ ID NO: 166 - DNA, 201 bp, Homo sapiens; identical to SEQ ID NO: 165

SEQ ID NO: 167 - DNA, 201 bp, Homo sapiens
acagaccgaggcacagagcctggccccattcggccatcccatcgacctggtcccccagtccagtttggcactagtgacaaggactcagacttacgcctagrggtaggagacagcttgaaagcagagaaggagctaacagcatcagtcactgaggccattcctgtatcacgagactgggagctgcttcccagtgctgctgcc

SEQ ID NO: 168 - DNA, 201 bp, Homo sapiens
tgggctgtggtagtgggcataggcagcgagatatccagtggtaacagttgtctgtgctaataattggagcccacacagaccagcaacttgttgaatgccasttttgaccacagaagaatattcgagacctgatgtttggactgaggtacctgtacttcttgggtgtgacagcaccggctgttgctggctttcagaggaagc

SEQ ID NO: 169 - DNA, 201 bp, Homo sapiens
ttccttagcatgtgggtcagtggctcctgatgttctgtctgcttccctggtattctctaagcagggaggggaatggttttgatgataagtgtaagtcaaaratgaaagtacaactcttggcctgatcccaaccatagccctctctttgcttcccatgccatgggccatggatggaacttccttatatatttatgtaaataa

SEQ ID NO: 170 - DNA, 201 bp, Homo sapiens
atattactgaaaaaagaggaggaagtctatgaacccaaccctttcagtaaatacttggaagataacagcgacctcttttctgaacaggatgtaacagtccytcccaagcctgtctcgctccatcctttatatcagactaaactctatcctcctgctaagtcactgctgcatccacagaccctctcacatgctgactgtctt

SEQ ID NO: 171 - DNA, 201 bp, Homo sapiens
tccccaaagacattgttgggttctgacacagtcaaaactcctacaactcttccaagagcagctggtcgagaaaccaaatatgcaaatctctcctcaccaawttctacagtatctgagagtcagctgactaagcctggagtaattcgcccagtacctgtaaaatccagaatattactgaaaaaagaggaggaagtctatgaa

SEQ ID NO: 172 - DNA, 201 bp, Homo sapiens
cttcatgggatggcccctcagcaaaagcatgggcagactcctacaactcttccaagagcagctggtcgagaaaccaaatatgcaaatctctcctcaccaawttctacagtatctgagagtcagctgactaagcctggagtaattcgcccagtacctgtaaaatccagaatattactgaaaaaagaggaggaagtctatgaa

SEQ ID NO: 173 - DNA, 201 bp, Homo sapiens
gcctgaagaactctcttacctctccagtgctgcggccctcgctccgggcagtggccctttgcctggggagtcttctcccgatgccacaggcctctcacccyaggcttcactcctccaccaggactcggagtccagacgactgccccgttctaattcactgggagccgggggaaaaatcctttcccaacgccctccctggtc

SEQ ID NO: 174 - DNA, 201 bp, Homo sapiens
aattcatagcaaccttaagggaaatgatagctagagaccgacagaaccaccaagtaaaacctgaaaaaaggttactaagtgatggacaacagcaccttacygaaagcctgagagaaaagtgctctagaataaaagagcttttgaagagatactcagagatggatgatcattatgagtgcttgaatagattgtctcttgact

SEQ ID NO: 175 - DNA, 201 bp, Homo sapiens
agctctttgaccatggctgtgactctctttccacagtatttatggcagtgggagcttcaattgccgctcgcttaggaacttatcctgactggttttttttytgctcttttattgggatgtttgtgttttattgcgctcattggcagacttatgtttcaggcatgttgagatttggaaaagtggatgtaactgaaattcaga

SEQ ID NO: 176 - DNA, 201 bp, Homo sapiens
gtagagacaatacaattcagggacaacaggtgtactatcccatcatctttagccagtatgacccaaaggtaacaaacgggggaaatcctcccactgatgartacttcatattctcaaaaaagactggattttggagagactatggatatggcatcacctgtatttacaaaagtgatcttctaggtgcaggtggatttgata

SEQ ID NO: 177 - DNA, 201 bp, Homo sapiens
ttgagtgttctagttcctggaattagttggcagagaaaatgctgcctagtgctacagatgtacattaaataccagccagcaggaggtgatcataggggcayagccagttctgacagtgttttaggtgcctggatattttttgatggaaaaagaatatattgccaaatattaagaagctcagctatgaaatgacctccaggg

SEQ ID NO: 178 - DNA, 201 bp, Homo sapiens
ttaaatgaatctttagaacttggcaagtctcactagataccttcaatcatcattttgagctcaaagaattctgagacttatggttggtcatatagaagagkaccttgaacctatagtttcctgaagaatcagtttaaaagatccaaggagtacaaaaggagaagtacaaatgtctactacaagacgaaaacgtagtatgtt

SEQ ID NO: 179 - DNA, 201 bp, Homo sapiens
ccactggacaacactgattcctggagaggtggctgcgcccccagcttctctctccctgtcacacactggaccccactggctgagaatctgggggtgaggargacaagaaggagaggaaaatgtttccttgtgcctgctcctgtacttgtcctcagcttgggcttcttcctcctccatcacctgaaacactggacctggggg

SEQ ID NO: 180 - DNA, 201 bp, Homo sapiens; identical to SEQ ID NO: 179

SEQ ID NO: 181 - DNA, 201 bp, Homo sapiens; identical to SEQ ID NO: 179

SEQ ID NO: 182 - DNA, 201 bp, Homo sapiens
tccgggatttatcaactcaaaccattcgggagatgtatgcactcacccaaggccgagttcccataattggggttggtggtgtgagcagcgggcaggacgcyctggagaagatccgggcaggggcctccctggtgcagctgtacacggccctcaccttctgggggccacccgttgtgggcaaagtcaagcgggaactggagg

SEQ ID NO: 183 - DNA, 201 bp, Homo sapiens
gtaagagatgggatattggtggtaggaatggattgtgaaatgcatgtatatgcacagtggaagcatgctgtcaaatttggagacactgaagctgatagttytaatgcagaagaggcagcaatgcaagatcattcgacctttaaatctaatatgctggcaagaaaaagtgttgttgaaggaacagctatttctgatgatgtt

SEQ ID NO: 184 - DNA, 201 bp, Homo sapiens
aataaaactgaagttactcatcaggtgcccactggttctttcaccctcattacatctagaacgaagctgagttctatcacatcagaagccacaggaaacgrgagccatccatacctcaataaagatggctcacagaaaggtatccacgctggacagatgggagagaatgattcattccctgcatgggccatagttattgtg

SEQ ID NO: 185 - DNA, 201 bp, Homo sapiens
cgtgtgctgtccacagtgcgacgtgctggcctatgagaaattcttccttctccttgctgaattcaactctgccatgaaccccatcatttactcctaccgcyacaaagaaatgagcgccacctttaggcagatcctctgctgccagcgcagtgagaaccccaccggccccacagaaggctcagaccgctcggcttcctccct

SEQ ID NO: 186 - DNA, 201 bp, Homo sapiens
tatttaaaatacccaagtacattctaattaccagtatatcagaggaaaattttcgtagtctttgtaaaataatatactcatcatagaaaacttgaaaaatrcagaaatgtataaaaaagcaaaaatgattactgataatatcacaacccagaagtaaccacctttaaaaagcaacccccatgtatgcctatatgtgtattg

SEQ ID NO: 187 - DNA, 201 bp, Homo sapiens
aacataattttaatggctatattatattccatttaatggatgcaactcagtttatttaaccattcccatgttgttaactatttaggttgtttctaattttsattattataaagttgcagaaatttggtgtacataaaactgtctccatataattgattattaggatatattcccatgaaggattctttttttaaaaaaatg

SEQ ID NO: 188 - DNA, 201 bp, Homo sapiens; identical to SEQ ID NO: 185

SEQ ID NO: 189 - DNA, 201 bp, Homo sapiens; identical to SEQ ID NO: 186

SEQ ID NO: 190 - DNA, 201 bp, Homo sapiens; identical to SEQ ID NO: 187

SEQ ID NO: 191 - DNA, 201 bp, Homo sapiens
cgtgcccgccggccacacttccagaagcttcaggcacatctggagcaactgcttgccaacccccactccctgcggaccattgccaactttgaccccaggargactcttcgcctgcccagcctgagtggctcagatgggatcccatatcgaaccgtctctgagtggctcgagtccatacgcatgaaacgctacatcctgcac

SEQ ID NO: 192 - DNA, 201 bp, Homo sapiens
gcaactgcttgccaacccccactccctgcggaccattgccaactttgaccccaggatgactcttcgcctgcccagcctgagtggctcagatgggatcccaratcgaaccgtctctgagtggctcgagtccatacgcatgaaacgctacatcctgcacttccactcggctgggctggacaccatggagtgtgtgctggagct

SEQ ID NO: 193 - DNA, 201 bp, Homo sapiens
tgtagaaagaatgtgttgcctcctaccttgcccccaagttctgatttttaatttctatggaagattttttggattgtcggatttcctccctcacatgataycccttatcttttataatgtcttatgcctatacctgaatataacaacctttaaaaaagcaaaataataagaaggaaaaattccaggagggaaaatgaattg

SEQ ID NO: 194 - DNA, 201 bp, Homo sapiens; identical to SEQ ID NO: 193

SEQ ID NO: 195 - DNA, 201 bp, Homo sapiens
tctgtcccctccctttctttcctggcttgaggtaggggctcttaaggtacagaactccacaaaccttccaaatctggaggagggcccccatacattacaaytcctcccttgctcggcggtggattgcgaaggcccgtcccttcgacttcctgaagctggatttttaactgtccagaactttcctccaacttcatgggggcc

SEQ ID NO: 196 - DNA, 201 bp, Homo sapiens
atactttcagacctactttcttaccccctctgtgaagctctgtgactgcccaggcctcatcttcccatctcttctgcctaggcagttgcaggttctggcarggatctaccctatcgcccagatccaggagccctacactgctgtgggctacctggcctcccgaattcccgtgcaggccctgctccacctgcgccacccaga

SEQ ID NO: 197 - DNA, 201 bp, Homo sapiens
gacagggaagaaggagcatgttgtgtttctgattgtacagaaggctcacaggaagatgagaaagacaaagccaaaaaggttacaagacagtcagggcatgsagagagaccaagaggccctccaggcagctttcctcaagatgaaggagaaatatttgaatgtctctgcttgtcctgtgaaaaaatcccactgggatgttgt

SEQ ID NO: 198 - DNA, 201 bp, Homo sapiens; identical to SEQ ID NO: 197

SEQ ID NO: 199 - DNA, 201 bp, Homo sapiens
caggagcgaggccgctggagtcccactgagagctcgtcagcctccgtgtcgcctgtggctaaggtctccaaattcacactctcctcagagctggagggcgrggactaccccaaggagagggagaggaccggcggaggcccgggcaggcctcctgactggacaccccatgggaccggggcacctgcagagcccacacccacg

SEQ ID NO: 200 - DNA, 201 bp, Homo sapiens
tccagaatctgagttggaggttgcccccaagggaagacaggagagcgaagaaccacagccctcatccagtaaaccctctgccaaaagctcattgtcccagstttcctctgcggccacctcacatggtggacccccgggaggcaagggcccagggcaggacaggcccccattggggcccactgtgccctacacagaagcact

SEQ ID NO: 201 - DNA, 201 bp, Homo sapiens
gactcccattttggtgtgcatctgtgtgtgtgtgcgtgtatatgtgcttgtgctcatgtgtgtggtcagcggtatgtgcgtgtgcgtgttcctttgctctkgccattttaaggtagccctctcatcgtcttttagttccaacaaagaaaggtgccatgtctttactagactgaggagccctctcgcgggtctcccatcccc

SEQ ID NO: 202 - DNA, 201 bp, Homo sapiens
ggcgatcctccctccggagccccccttcaaccctcccggaagtgaggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 203 - DNA, 201 bp, Homo sapiens
gcaaggggccgctggctgcctttgtcaaaactaaggtctggtctctgatccagctggcgcgcagatacctgcagaagggctacaccacgctgctgttccargagggggatttctactgctcctacttcctgtggttcgagaatgacatggggtacaaactccagatgatcgaggtgcccgtcctctccgacgactcagtgc

SEQ ID NO: 204 - DNA, 201 bp, Homo sapiens
ccctccggagccccccttcaaccctcccggaagtgagcatttgcaggaccagggatgctgtgctgctctcccatgagccagtcaccgagtcggtctgctgmagccctttctgaacctctggccgtctggatgctccactgtgcttgccaagatgaagtgcgtcttggtggccactgagggcgcagaggtcctcttctactg

SEQ ID NO: 205 - DNA, 201 bp, Homo sapiens
aggcgccgacagccgaggagacctccgcctgctgtgccccgcgccccgccaaagtcagccgcaaacgacgcagcagcagcctgagcgacggcggggacgcyggactggtcccgagcaagaaagcccgtctggaagaaaaggaagaagaggagggagcgtcatccgaagtcgccgatcgcctgcagccccctccggcgcaag

SEQ ID NO: 206 - DNA, 201 bp, Homo sapiens
ttcatttaacagagcttccttaggttgatgctggaggcagaatcccggctgtcaaggggtgttcagttaaggggagcaacagaggacatgaaaaattgctrtgactaaagcagggacaatttgctgccaaacacccatgcccagctgtatggctgggggctcctcgtatgcatggaacccccagaataaatatgctcagcc

SEQ ID NO: 207 - DNA, 201 bp, Homo sapiens
ttgtgaacgagttgttggctgctccctccacagcttctgcagcagactgtccctgttgtaactgcccaaggcatgttttgcccaccagatcatggcccacrtggaggcccacctgcctctgtctcactgaactagaagccgagcctagaaactaacacagccatcaagggaatgacttgggcggccttgggaaatcgatga

SEQ ID NO: 208 - DNA, 201 bp, Homo sapiens
aaccagacagcggcggcggcggcagacgcggaggctgcgcagtacagctacctgggttacgctgtggccgtgctgcacaagacctgcagcctctcctacarcgcgggggctccacggtacaaacatcatggggccgtgtttgagctccagaaggagggcagagaggccagcttcctgccagtgctggagggagagcagatg

SEQ ID NO: 209 - DNA, 201 bp, Homo sapiens
aacagttccgcaggagtggaggcagcagagcagaggcctgtggaagatggcgagaggggcatgaagccaacagaagggtggaaatggaccctgaactccgrgaaggctcgagaatggacacccagggacatagaggctcaaactcagaaaccagaacctccagagtcagcagagaagcttctggaatctcccggtgtggag

SEQ ID NO: 210 - DNA, 201 bp, Homo sapiens
tgggcagaggaggccaccaacctgcaggtaaattctccagcagtgaattcactcgatcacacgaagccatttctccagacatctgactcccagcatgaatygtcccaactcctctctaacaaaagttctggaggctgggaagtccaagatcaaggcactggcagattcgatgtctgtgatgtgaatgccaggaaaatcctg

SEQ ID NO: 211 - DNA, 143 bp, Homo sapiens
ttccagcaaaaggaaaaacctcatcaaagaagaggaagcagagaaaagtaggtccaactacacctttagcaaccacagacaagaagttcacagctgaaggrggagaggagactcctatagctcagcgttttcacacaccatag

SEQ ID NO: 212 - DNA, 201 bp, Homo sapiens
ccgagagcctcacacttgtgctcagtgccgcctcacccctggtggatccgcgatggccgcggattcccctggattgccggcgctgggcaggagcgccactyctaatctctcccgagactggacgcccggcgccttccacgcgcgttgtgtctttccgggcggtccctcgaagctggctaccccgcgggctgttgactgcag

SEQ ID NO: 213 - DNA, 201 bp, Homo sapiens
acttgctcttaggagtgcattttttgtagctgtgggtttttgactatctctgctgctttctccagcccctaccctcgtgactacaagggaaaacgtgcggygctcacgagagagcctttatgggatttttaaaaaatggggattgtgggaaaatggctccagcagtcacagtttttcagtttctcacaatcccataaaaac

SEQ ID NO: 214 - DNA, 201 bp, Homo sapiens
gagccagaccgctctggactgttttaattttttcagccttaatacctgccagaattttttttttactatgtatctttgtccttacgtatataaattttatrtacaattgagattatcctgtatttgcttttcccccctcacttttatatggtgacttttctcatgttaggctgaatactaacattttggaaactgtcggcc

SEQ ID NO: 215 - DNA, 201 bp, Homo sapiens
atcccataaaaacagagcaaccaggtaacaaaactaaagcatgggcaacatttacagaccactggatggtgaagaattcccatgaacccctggttcacacygtaaggacacactactcagcatgggcaacatttacagactactggatggtgaagaattcccatgaacccctggttcacactgtaaggacagactactcag

SEQ ID NO: 216 - DNA, 201 bp, Homo sapiens
gctgtcagtacgattattgcaactcctggtcaagcccccaactccagagctctctgccggagccccatgacaggcccctggccctgcctctgtctgactcmcagattcagtggttctaccaggccctgaacctctccctgcccctccccaatttccatgctgggacggagcctgatggcctggaccccatggtcacactgt

SEQ ID NO: 217 - DNA, 201 bp, Homo sapiens
gtgccgggcacgccagagagtggagcaggaacagctcttagcctcagggagcctgtcgggcagtcctgacgtggaggagtgtgctcccaacactggacagsgccacctgtgcctgcctccctcggagccctgggaccagaccctgggagtggtcaacttccccagaaaggccagccgcaagccccccagggaggagagctc

SEQ ID NO: 218 - DNA, 201 bp, Homo sapiens; identical to SEQ ID NO: 217

SEQ ID NO: 219 - DNA, 201 bp, Homo sapiens; identical to SEQ ID NO: 217

SEQ ID NO: 220 - DNA, 201 bp, Homo sapiens; identical to SEQ ID NO: 217

SEQ ID NO: 221 - DNA, 201 bp, Homo sapiens; identical to SEQ ID NO: 217

SEQ ID NO: 222 - DNA, 201 bp, Homo sapiens
gttccggcaggaagatgacagagggattacctaccggatcccagccctgctctacataccccccacccacaccttcctggcctttgcagagaagcgttctycgaggagagatgaggatgctctccacctggtgctgaggcgagggttgaggattgggcagttggtacagtgggggcccctgaagccactgatggaagccac

SEQ ID NO: 223 - DNA, 201 bp, Homo sapiens
gctgcctctccatgccttccagcttgccgttgacattgacagccaggtcctggacctgaaggagtacaaactcatcttcacagtgttccacattatcgccytgtgctccacttttgccaatccccttctctatggctggatgaacagcaactacagaaaggctttcctctcggccttccgctgtgagcagcggttggatgc

SEQ ID NO: 224 - DNA, 201 bp, Homo sapiens
agttcatcctcacaggatttacatatcatccaaagctgaagactgttctgtttgtggtgttctttgccatctatctgatcaccatggtggggaacattggrttggtggcattgatttatatagagcaacgtcttcacacaccaatgtacatatttttaggcaacctagttctgatggattcctgctgttcctctgctatta

SEQ ID NO: 225 - DNA, 201 bp, Homo sapiens
aaaattcaccactttttctgtgatattcttccactgtatagactctcctgtacagatccttctattaatgaactaatgatatatatcttttcaataccaartcaaatctttaccattgctactgtcttgatctcttatctctgcatccttttgactgttttcaaaatgaaatccaaggagggaagaggtaaagcattttct

SEQ ID NO: 226 - DNA, 201 bp, Homo sapiens
cagcggactgtcaccatgcacaaggacagcatgggccacgtcggcttcgtgatcaagaaggggaagattgtctctctggtcaaagggagttctgcggcccycaacgggctcctcaccaaccactacgtgtgtgaggtggacgggcagaatgttatcgggctgaaggacaaaaagatcatggagattctggccacggctggg

SEQ ID NO: 227 - DNA, 201 bp, Homo sapiens; identical to SEQ ID NO: 226

SEQ ID NO: 228 - DNA, 201 bp, Homo sapiens
ggaaggttgtagacataatccaaggccttgaccttctgacggccatggttctggtgaaccacattttctttaaagccaagtgggagaagccctttcacccygaatatacaagaaagaacttcccattcctggtgggcgagcaggtcactgtgcatgtccccatgatgcaccagaaagagcagttcgcttttggggtggata

SEQ ID NO: 229 - DNA, 201 bp, Homo sapiens
cactccagaaaaggtggatagaggtgttcatccccagattttccatttctgcctcctacaatctggaaaccatcctcccgaagatgggcatccaaaatgtytttgacaaaaatgctgatttttctggaattgcaaagagagactccctgcaggtttctaaagcaacccacaaggctgtgctggatgtcagtgaagagggca

SEQ ID NO: 230 - DNA, 201 bp, Homo sapiens; identical to SEQ ID NO: 228

SEQ ID NO: 231 - DNA, 201 bp, Homo sapiens; identical to SEQ ID NO: 229

SEQ ID NO: 232 - DNA, 177 bp, Homo sapiens
atctcaacaccatgttgtctgcaacacatgacagccattgaagcctgtgtccttcttggcccgggcttttgggccggggatgcaggaggcaggccccgacyctgtctttcagcaggcccccaccctcctgagcggcaataaataaaattcggtatgctgaattcaataaaaaaaaaa

SEQ ID NO: 233 - DNA, 201 bp, Homo sapiens
atttctgtgcctaggaggactggcttgtcttattgtaatgtttcttccagaaaagaaagacacaggtgtgtttgcagtggtgaacagccattccttgtccytgctggggaagctgaccatcagtgctgcctttaacattgtttatatctacacctctgagctttaccctacagtcatcaggaatgttgggcttggaacttg

SEQ ID NO: 234 - DNA, 201 bp, Homo sapiens
gggcatgatgaatggagggatgtcgctggtggcctttgtcttgcttaatgaatgtgtgggcaccgcctactgggcacttgcaggatcgattggcggcctcstctttgcagttggcattgcccaatatgccctgttaggatacttcatccgctcctggaggaccctagccattctggttaacctgcagggaacggtggtctt

SEQ ID NO: 235 - DNA, 201 bp, Homo sapiens
ggccatagccatggctactcccatgagagcctctaccacagaggacatggacatgaccatgagcatagccatggaggctatggggagtctggggctccagscatcaagcaggacctggatgctgtcactctctgggcttatgcactgggggccacagtgctgatctcagcagctccattttttgtcctcttccttatcccc

SEQ ID NO: 236 - DNA, 201 bp, Homo sapiens; identical to SEQ ID NO: 235

SEQ ID NO: 237 - DNA, 201 bp, Homo sapiens
gcccaaggatgggaaaggtgtgtttgcagtggatggggaattgatggttagcgaggccgtgcagggccaggtgcacccaaactacttctggatggtcagcygttgcgtggagcccccgcccagctggaagccccagcagatgccaccgccagaagagcccttatgacccctgggccgcgctgtgccttagtgtctacttgc

SEQ ID NO: 238 - DNA, 201 bp, Homo sapiens
ccaaactacttctggatggtcagcggttgcgtggagcccccgcccagctggaagccccagcagatgccaccgccagaagagcccttatgacccctgggccrcgctgtgccttagtgtctacttgcaggacccttcctccttccctagggctgcagagcctgtccacagctcctgtgggggtggaggagactcctctggaga

SEQ ID NO: 239 - DNA, 201 bp, Homo sapiens; identical to SEQ ID NO: 237

SEQ ID NO: 240 - DNA, 201 bp, Homo sapiens
ccaaactacttctggatggtcagcggttgcgtggagcccccgcccagctggaagccccagcagatgccaccgccagaagagcccttatgacccctgggccrcgctgtgccttagtgtctacttgcaggacccttcctccttccctagggctgcagggcctgtccacagctcctgtgggggtggaggagactcctctggaga

SEQ ID NO: 241 - DNA, 201 bp, Homo sapiens
cacagcagccaaggtactttggtcaataatgtccgactcccaagaggtcacaggctggaattgagtgatggagacctcctgacctttggccctgaagggcycccaggaaccagcccctcggagttctacttcatgttccaacaagtacgagtcaagcctcaggactttgctgccattaccatcccacggtctaggggagaa

SEQ ID NO: 242 - DNA, 201 bp, Homo sapiens; identical to SEQ ID NO: 241

SEQ ID NO: 243 - DNA, 201 bp, Homo sapiens
ctattaccccggttctttccccaccccaggtctgtctcttgccttttcttggggcatataagctactgagtggaacatggagctgatcaagaggccgtaayggtcatggctgtttcccagacctgaatattggggtgcttcttgccagtattctaagacatttgagtaattgctgtttgcacttactgcatggtcagacca

SEQ ID NO: 244 - DNA, 201 bp, Homo sapiens
ggggaaagagaccagccttggtccctaagcctccagaaacgtcttcttaatccccaccttttcttactcccaaaaaagaatgaacacccctgactctggartggtgtatactgccacatcagtgtttgagtcagtccccagaggagaggggaaccctcctccatcttttttgcaacatctcatttcttccttttgctgttg

SEQ ID NO: 245 - DNA, 201 bp, Homo sapiens
gattaatgtgacaaccttttcaataagcagaaataacgtaggtacacatcactctttacatttttctaagcattttcacagccgtttcttcatataatccraccacagtgggaggtgtgatttacccattacacaatgagaaaccagaggagccgatgagttacttaattgaggtcacagaatgaattagcaagaaaatgg

SEQ ID NO: 246 - DNA, 201 bp, Homo sapiens; identical to SEQ ID NO: 245

SEQ ID NO: 247 - DNA, 201 bp, Homo sapiens
ctctttgccactggtgccttctcttaagtaacagggaacctctcccacctgcccttctcttcagggacaaccctccataaatgtgtgccaagagggtctcytttcctgtcttcctctacagagaatgctgctcggtcctcctacccctcttcccgaggccctgctgccatgttgtatgccccagaaggtaccttggtcccc

SEQ ID NO: 248 - DNA, 201 bp, Homo sapiens
cttataaatacggacagttgtggcctataattggaaaactggaaatgtggtgaaaaggttcaaaggacatgaacatgagatcaccaaggtagcctgtattyccaaatccagccagttcttcagtgcctctcgtgacaggatggtcatgatgtgggacttgcacggttcctcacaaccaaggcagcaattgtgtggccatgc

SEQ ID NO: 249 - DNA, 201 bp, Homo sapiens
gggaaagataagacagttgtggcctataattggaaaactggaaatgtggtgaaaaggttcaaaggacatgaacatgagatcaccaaggtagcctgtattcycaaatccagccagttcttcagtgcctctcgtgacaggatggtcatgatgtgggacttgcacggttcctcacaaccaaggcagcaattgtgtggccatgcc

SEQ ID NO: 250 - DNA, 201 bp, Homo sapiens; identical to SEQ ID NO: 249

SEQ ID NO: 251 - DNA, 201 bp, Homo sapiens
catgacgcccggcaaacattccggagcctcggcccgagccgctaacgcaggagcttgggggtacagggacttcagaggcggccaaaaaaaggggtggtggsccactccccagctggtcgccaccatgccagtctctccggcaggcagtcacaagcagcagaacttcgggttgaacaatgccacacaaccaaagaagtctat

SEQ ID NO: 252 - DNA, 201 bp, Homo sapiens
gtgccgccagccaaccgcgcggccgcttgttgagccagggctccaccgtcgccatgacgcccggcaaacattccggagcctcggcccgagccgctaacgcsggagcttgggggtacagggacttcagaggcggccaaaaaaaggggtggtggaccactccccagctggtcgccaccatgccagtctctccggcaggcagtc

SEQ ID NO: 253 - DNA, 201 bp, Homo sapiens; identical to SEQ ID NO: 251

SEQ ID NO: 254 - DNA, 201 bp, Homo sapiens; identical to SEQ ID NO: 252

SEQ ID NO: 255 - DNA, 201 bp, Homo sapiens
ttagatggtacaaggacagggacgcacttatgaagagctctaaagtccacctgtcagagaaccccttcacttgcagggaaggtgggaaggtcatcctgggragctgtgacctcctccagcttcaagctgttgacagtgggcagaagccatattccaatcttgggcagcttccagaagtctgtaccacacagaaactcttcg

SEQ ID NO: 256 - DNA, 163 bp, Homo sapiens
aagactgttctgtttgtggtgttctttgccatctatctgatcaccatggtggggaacattgarttggtggcattgatttatatagagcaacgtcttcacacaccaatgtacatatttttaggcaacctagttctgatggattcctgctgttcctctgctatta

SEQ ID NO: 257 - DNA, 201 bp, Homo sapiens
cctctctccataaaggccactagaaagtactgtgatgccaggctgctccacatccaggcagcctgggtgaccactgccctttatgagaatcagaaaaagcsgtctcccgagtagttggaattacaggtgcatgccaccatgcctggctaatttttgtatttttagtagagatggagtttcactatgttggccaggctgctc

SEQ ID NO: 258 - DNA, 108 bp, Homo sapiens
atacaaaatgataatgagtgagtaaccaaaagccctccaaagcttacatcctagagtcccaaaatcccagatgccaggactgggcatggcatgttctttcrttcctta

SEQ ID NO: 259 - DNA, 201 bp, Homo sapiens
ttgtgagtttgccaaaaaaaaaaaaaaaagaagtatattgtgtctacccagcacaacaaaacgggggacttggcattcccccccttctcccgcctccaccmacactaatttatgcattctttaaagccaaaggaatcaaagtgaaatttcacacctagtctgtatcaagcatgtgctaggttaatttaaccttactgctct

SEQ ID NO: 260 - DNA, 167154 bp, Homo sapiens
cagttgtccatttgttctatgaagttgccatgtgtattagatcagttcgtctctctttttcattttggtacctgttttaatttttatctccaaatttttagagtttgttgtttataggattgaaaaaatctataagcatcttattttacatcttatttttttagaatgttaatactttatggagcctttttcaaatgctgaactggtgtttgttttttaacttttattttaggttcacggggtacatgtgaagatttgttacttaggtaaacccatgtcatgggggtttgttgtacagattatttaatcactcaggtattaagcccagtacccaattgttatcttttctaatcctctccctcctcccatcttccattctcaagtagaccccagtgtctgttgtttccttctttgtgttcataaattctcatcatttagctcccgtttataagtgagaacatgtggtatctggttttcttttcctctgttggtttgctgaggataatagcctctagctacatccatgttcccacaaaagttataatctggttcttttttatggctgcatggtattccatggtgtgtatgtaccacattttctttatccaatctgttgttggtgggcatataggttttcatgaaaagattccaagtttttgctattgtgaatagtgctgcagtgaacattcacgtgcacatgtctttatggtaaaatgatttatatttctctgggtatatatccagtaatgggattgttgggtcgaatggcagttctgcttttagctctttgaggaatcaccatactgctttccataatggttgaactaatttacactcccaccaacagggtgtaagtgttccctttttttcacaacctcaccagcatctgttattttttgactttttagtaacaggcattctgactggtgtgagatggtatctaattgtggtttatatttgcattctctaatgatcagtgatattgagcattttctcataagtttgttggtctcatatatgtcttctttagaaaagtgactattcatgccctttacctactttttaatgggattctttttttctcttataaacttgtttaagttccttatagaggctggatattaggcctttgtcagatgcgtagtttgcaaaaattttctcccattctggaggttgtctgtttactctgttgacagttttttttttgtttttttttttgctgtgcagaagctcttaagtgtaattagataccatttgtcaatttttgtttttatcatgattgtttttggtgtctttgtcattcaaaattaatatcattgacatagaaaattctcacattgttgcagcattttaaaaaatctgttactaagtataatatacactaagaccctaatttggtttactaattttttttaaaggaaacacaccatatgttgataaaggtttatctaggcagttaagattatactaacttttattttttctttgtatcacctaaattttctacagtaaacaattttttataatctgctttttttaaaaaataaaacatagtaggaagtcattaaactcgggtctagtcttaattgtgccttaagctgtgtttctttgcattctctcttcagccttatgtttccagtttaacttataaatttatcttccaaatttctgatccctctgaaatcttataactaacatatttagttttaccttttgattttgatttaaagaataagacaacatttctgattcactttttcaatatttcttatttgctattgccatatatttcagaaactacttgtggtttatttctgcagttcatgttctttggtggaatgagagtgcagatagtcgtgcagctgggagacataagtcccatgaggatcccagagttgtggcggctggtaagctgtttcactaagcacgaattatttttagaacaaatgtgattcaaccaataactgtatgccttcttatgaaatgtttttccagttcgggaaagtgtcaactacctagtttctcagcagaatatgcttctgattcctgcatcattttcaccattgaaatagttttctactgaaatacaaaacatttcattaactgctctaagatgtgtctgctaatggtgcttaaattctcccaagaggttctcgcttttatttgaaggaggtggtaagttaattagttaatttgctgtgcttcttgcatttttgaaagttacatattctccactgctttaagaaataattcagttcactttcaccttggcatttcagtatctgttacacattagaagtagttgtcactatttcatcatcttggtttttcatttgttttagaatacctcttctgtattttgataactcattgctttatagcattttcttttactcaaataaggattttacatttccttgcctgacagtatttttgaattatttatataaaatatctatcttttcatcatgtctatagttcctgagattttaaaaaaatttgcttagtaaaggttattttgtgatataaaatgggatttataaaaatattagattgtttatttctttactgtggaaaagtacaatgtcatctgtattaattattgcttttacattcattgattattagtcattctaacttggaaaataatgcaattgggtcacagtgttaaaaatctagaaaagacttgttggtttatatgctgaaattgttcatttataattaattttactaatttctacttagtttggatcactaacagagatcttgggacatttatttgttttaaagaaatatttatggttatggaaacgcttgccctaataaaaatcctgcatattcattgtttttttaaattcacattttatacttatatgatctctaaagctcttgctatgttgctataagacagtaatatagtgataatttaccaactttattgaaaatgttgttacatcaataaaatagcatgctgggaacctgagaaggaaggtttctttagtactgccacagatgtcctggagttttccttgaaacatctttcatttccattttacttgatgcctctacctactaaaactagatttggtacttccgatagtgtatatttacagctatattatatttacatttttacagactatcttctgataatctgtatttacagctatgttattttatatttttaaaatcttacagctataaaatagtaaattgtgaattagctgtccaagggcaatttggaaaacaaactgtacagtttcctctcatttatcaggctctaagcgatctgcagtttatctgggctattatgcaatgtgagatattatttatgagaggcaggcagtggcagcttaaacagacatacctcctcagcattcttttccatgcagagttcaaagaggcctaagacatctcacatttatgtgaaatagttgaggcacaagtatgtggttaactacacataaattaccaataaaattaaaagttaactaaaatactacagaagacatttaatattttgcttcagactgttatagtaccttagggttatgaacatcaattacctttgagccttactatatttaaagggaaggggaagctgacatttttatcttttttaatgggtacactctacgttaccttaaaggcttccccggtttaagcaaaaatagaattatgtggtttaaatcatataccttattcttcatacttagctccaagtagattatgacttttcctaaaacttaacatgacagagatttgccttccagggggtctaatttgaagaggaaagtaatttaaatgtataggtttatataatagcattgtatttttctctattttattcattctttcattctcttcgatgactcccagcacctgcgcgtccatcttcattcttagccaatgacctttccttttacttaacagagaaaataacaatcagaagagtcttcataagttcccaccccgtctgcccgctttctacagccaaccccacatgccctgccttctctcctttcactgtggatgaaccgcccgtgccccaagcaaagacaaaccctccacttgaacactcacttgctgaaggatgtggcttaggcagttttcctgtctcctgaagccacagtattccccttcaactggattcttctcctcagcatataaatatacttttttttcctatctttaaaaaaaaaaaagagtaaaatcaccccatttttttcctttacaatatgactcaaaagagtagttcatacttcctgcctccattttcttccctcacattatctcttaaacattctctgatcacgccagccaaattgctcttgtcaactcatttcccagttctcatttcacttgacttgttagcagttgacctctcctttcttctgggaagtttcttcgtttctccgaaacactcactgcacaagccttcatatctcctagtctccatcttgtctctttgacctctgatgtaaggactgagtccttggaccacttctcttttctatttatacttactccctgcgtcatcacccccagtcttgtggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagacttcccagccactagatctgtgagaaagaaatgtttgttgtttaagccaccctgtctatggtactcttgttacagcaacctgaactaagacactatccctctcccctgctttctttttctgttatcaccataattaatgttttacttatatatgatttgttaatgtatgtctcttcccactagaaaccgaattctatgacagcaagggtttttgttttcattattgtcatattacctgtgcctggcatgtgataagccctaagtacttgttgactgaattaacatatgagatctgtgagtctgaaaaaagaagtacatcattccttcacatgtcattttgagccactgttaacagattacataactgttattggaagtgcctcactactccatttggaaagtattcctggaatacacgatgaatgactcagtagaagttctggctatgggggagtgccatcaataaataaaaataataccattgtctgttggttataagttgctgtcacagactatgaaggtatttgaattgtattttcaggaagagaaacagatatgcaaccaatctgatttggttccacaccctgccacagaagtcccaaaggagaagcaaatgccacttgtagactcaaactctggacttcattctcagcaccatctcttaacctactgagtaaatcctatgaacctgactagggtggcaactgaagttgtagtactttctgtcttcaaaggagggtgaacctggagtatgttggaagaagtgttaggttcattagagacacctctttcataactgctgtcacctagaatgtctattctctaagcaccttcttgaaagaagcacattcccccaggaggaggaaatggtttgttttctttagtgacagttggcccaggatcctaaggtaaaggagtatgggcactagacaaaatgagttttataatagtcgattggaaggaatggaagtttttgaatcacaggcttctgccttgaaagggcaagtccgtggtggtcatgaaccacccagagtgtgtacaaggctcctgccagaagaaatgcctgtaggattaaaagcaaaacagcagaatcaaaaaggaagggcacgatgatgcccaggtgcagcctatattattaacagacaaggaaagaatccaaataaaagttctgtaaaccagctgttgtcctgttttctgtttcccttcaaagcaaaaatatagatttgcatatatttgcagtctccccttccttgcctctcagtcttccctgaaaatctattccagttaggtctgcatccttgtcatgctgaaatgactcttaggaaggtcaccaaggacctctgtcttaacaaattcaatagccattcctgcctttactcatttacattccttactcatcttctcagcaatgttggacataattgacaacttctgccttcctgaaacaataattctctgagcttcaacatatggcattatactcttcagattttactctctctcactggccagtccctctcaatttccctggctagcttctcttctaaatgttataggatctcaggctcaagaatgttccctatcttcattctctctaggtaatctcattcagtcccgaggcttaaatatatacgtaccaataacttgcacacttttttttttagatggagtttcgctcttgttgcccaggctggagtgcaatggtgcgatctcagctcactgaaacctccgcctcccaggtgcaagcgattctcttgtctcagcctcccaagtagcttggattacaggcatgcaccaccatgcccagctaatttttttgtatttattagagatggggtttcaccatgttaggctggtcgcaaacgcctgacctcaagtgatccacccgtctcggcctcccaaagtgctgtgattataggcgtgcaccaccacgcccagccaacttgcacacatttatcttattttccatcattgcccctgagcttcagactgaaatacccactgcatttttaacacaaccatctacctagttcaggtcacaaactagaagtcaccttgctagctctctttccctcagcccttacatgcagtctgtcagcaagtcctgctggatctatctccaaagtggatactgaacattaccatagctccctatctgttgctaccatcttagttcaatccaccattatctattagtcttcctactgtcctttcttcccatagtagccagtgttctttctgaaacagtaggtcacaccactactgtttaaaactctccagtggctccttgttgcactaacaataaaatccaaataccttaaaaaggctggcgagatcctgtgagatgtggtccctgctatctctccagttccaccccctgccactcttgtccttgctaactcagtacaagagacattagtacagatagctcttttaccacctcagcttgccaagctttttcccactggggcttttgcaacacttattctttcttccgggaatatccttcgcacccaccttgaaaggctgctcctgctctttttattcgattctgagcatgtcactcctcagaaaaggccatctctgacttctctccattgttatccaattaccatgtcttattttcttcttagcacccattgctgtcaaaatacattagatgtgtttgtccacacatcatctttcaccactgaaatataaattcattagagcaggaattctattttcttctacattgtaccccctagtacctagagaagtatctggcatacagtaaagttcaataaatatttgttaaattaatgtatattgatgctgatgtgattttacaaggtcaattttaactgatacctaacttcaacaaaaagaaccctctgccacttgactgaacctgtacctttggacgagtttcttatccactgagctgtaatttactcatatgtaaaatggtactttttacctcatagggcaggtgttgagaattaaatgaagtgcatgacaacacagtaaacacttgaaaactgaagctaagtgggttttttttttttttttacttaatgtaaacattaccattacaaagtgccaagttttttgaatctggaaaagttcttttgggcttttctacagatagaagaatgttttagtcaaggctcatgggtagggccaggcaaggtggctcatgcctgtaatcccagcactttgggagcccaaggcagaaggatcaccttaggtcaggagtttgagaccagcctggccaacgtatagtgaaaccccatctctactaaaaatacaaaaattagctggttgtggtggcgcatgcctgtagtaccagctacttgggaagctgaggagaatcgcttgaacccgggaggcggaggttgcagtgagccaagatcatgccgctgcactccagcctggacgacagagcgagattctgtttctcaaaaacaaaaacaaaaagcaaaaacaaaacctcatgggtaacatattttcatctaaattacctgcctttttatttttcaataaagttttttcctctccctcgtcattgttcacgaagaaacagtgttctatgatttcattaaagtcactataacatgaacttcaagataggaggatgaagttgtgatgctgatgctcagggggcatcttggctcacttgaagccaagatttttctgcacacaaagttcagatctgtgccacaggaaaaggactgctcacgacactgtcacagccattcctgaggtcacaaatagagacagcctcttgtacttcctcaaaaggactgtttgacagggattcttcaagtagcaaaataagcagacatctctttctgaaactgattcttaatgagctatgaaaaatacatttacatttatcagcactgctcatatgttgtctgcacagcacttattacaggaaaaaaggaaggaatcaccgatattagtatcatttctgtttccatatctacttcgccttcctgctcaccattgccaccacccccagcaccttcccagtataactgctacattgtgtccttatatttttggttgaataaacaaaaggacactgaaggctgcctttgtagcttcccctataccaagtgaacatttattaaataagctcagctacagagcattttcagaaatctcagtgcagcttcataatcattaagcagaatatttatctaaaaacctctaacacttaataccagttactcagtatcttaaccaacatgaaaatacaaaacaaccttttattttcaagtagtcccctcagttctcttttatgattaagggaacatttgaatcttttctaaagtttttccttttgatccaaatcacttcccctctacttttctaatggctttataacccttcaacagtaggtggtgccacaaatgcacaaaagtaaatttctgtagaccaacagaactgtcacagctttattttgtgactcattatattacaacatagaaatatgcattttaatacttcatataaagttattgacatacaaaattttttttcttttttccttttaatgaaaatgatttaacttagaaatctgttgtgaaacttttgtctagttttgcaattctcagatattccagtgcaaaaatagatcccattacagacagcgtaaagtgcttggaatgagggccaatgatgaacaaagagcacaaaaacagcttcatcttagggtataagaagggataatagcatacctaaatccttatggaaatagaaacattctaagggggatgcaacaattttgaaaagaattagagcaatatttctacagtattacattattactagtagataataacaagggtacaaattaatgtctcaatatcaaagtggttcagtattacatgacacatggctctttggaaaatattttacctgatatatacaaccacaagaagaaaacacagacaaatggctttagtcaatgattactatacagtgaatgaatgatgtgcaacatttaatagtcacaaagcatttgctttcagtacagataatgaaatacagtagtgtgaggtttggttgttttttaacaatgaattgtgctgggcatttatgtatagagggcttattattttcttctgtatttctcatattcacagttgttaataagttttctgaggtgtcccaaagatgcaaaagcagaaatttttgaacacgtattttgagaatttctgaaactcacataggtacattccacagggaatatacagaaattttgcttgattgagtatagagttggtaaaaatttctaccacaattaggtttacacaggaaaatgtaaaaaattactattttaaaaggtaacacagtattaatgaagatgtataactatagattgtttctagcttcagaagaggtcctttcaatctgtattaaaatgttgtgttttcttcaaaatagttcacagtgccttttgattttttaaaatatggccttgaaatcagaggaaccgaagtaaggagttgctcatagatttactataatgaagaattagaatacgattttagtaaaatgaggaaaccataactttgattttgaaaaatattaaatgaggagaaattattctataaattctgtatttttgaagatactgtaaaatgcaacgatgccatatcactagttattggaaatatgccttcattacttatatttaaaatcaatattgactttaacttctaaaacaatcatttttttctttttcagcagtgggttatataatattctgtaaatttaaaaaatatagaaagattaatttgaaatctgaagtcttacacctttagcgttaatattcaaattctggaaaaagtggaagaagttagtaatgatattgaaagatcacttgaacttccccaaacaatagttctctcatatttttcttttctctcaagacagttaacagtaagtattagtgaaacagtatttttacaaatgtttactgactagaaaaataagactgggttagaaaactctgaaaaatgctccatatggaagtatttgttgtttttatatttttcttgactagtgattgaagagatgaaaaatttgagactgtcagatttaatggggtatccaatatctgcaaagccaattatttgaaggtactaaatgccataaacacaagttgtgtttttcagcaagttttcaagctagctgttttccctgttgaagaattcattgtttagacttgtgacccttatactttcttggcttttgcattgttgcaattaaaaaaaaaaaaaaaaaggctgcccagtattgttacagtgggctcctacaaccacaagacaacctatatttgtaaaccagtgagctgaataacatggcacaggaagtgtactgagacttaatatctctctagtcttatacgtacgtacatactctttcagctacagcatacactcaaaaaatatttgattgatgaagtgagattaagagtatcctaaatgatctgaaagaaactcaaatataatgtcatgagatcctgaccatcacattgctttctaggcactagtcatgactgatatgcaaacttacataagaaaataaaaatagtggggcagtggccatactcctctataccacagggttctacaaagaggccattctaaggattcagaagtcactgatagaacttaaaattccaaataacattaaaaagtacaaacatttttgtcaaaatacaactccatcttttcattttctagattaattcaaaaagccagaaataatacacttgtgtcagataaacatcttgagatgcagtgtaccatgttagcagacagtcaggacaaatgggcacaggcttccctaggtttgaacgcacaatctctttaatcccatgccctggcttcagcagcttgcagccccagcagtttggctgttgattctttgcctcttaccaggatctaagtatatttaagagtctcataaggatgaccctgtagacccatggctcgaagcataggacaatataacaatggaaccaagtttcccgtgcctggagacacccacatttttgttgcatgttactgccaccagaacagcttatcagagggaatcaaagcaggatgttagccacgcatggcaccattctgtcaactgatattcaatgttgatagactctgagcagagcagctttcacaaaagtgagcatgacacaccatggtgcttcaaactttctgaaaaacttggcactaataactctggcacactcattgccagcaatggatgtgtcaccgggaaaccagtctcctgggcatggcatggcttagtgaatgaggatgtgcattaccttttgattttgatcaataatcgctggccatgattacttgatgaattattgttgcaaccccaatgagaatacacaggaacaaaaaaaaaaaaaaaagtgtgagttcaaacccatatgtccattgggttccataatagagtttcacataggtataggtaaaaaactaaattcaagtctttcacttgagagccatacaagacataggctacaaaggcactgcccctgtaatggaattttgttttcattgcattgaattgcattgcattgaatagtatcagtacagtatccagtttacttcttcccacatcaacttctggctcttttctccacaacacttcacatggtgcaaaggaaagtctagttcctctttactttcagccaccccgtatgaacaggattcttcatacatagctttctttcactttctcatcctgtagaaaagatgtgagaactgcaacgtccactactgtctggtttttgtgtaatgagaggtcttttaagtggtcatcatcactttggtccttggcaaagttcacaaatacctgttaaaagattaagatggacctttataaataccactcaacttgctcattctttattctagttctatttttccagatgttgaaattaggtcaagtaggagcatacagaattacataaatggattaactagaaaactgtgtgtgaaggagggaagaatacttgaaaaaagcaataacaacttaaaaatagactttttttccccccttgaaatggggtcttgctctgtccccaggctggagtgcagtggcgagaccttggctcactgtaacctccacctcctgggttcgagcaattctcctgcctcagcctcgcaagtagctgggactacaagtgcgcaccaccatgcccagctaatttttgtatttttagtagagacggggtttcaccctgttggccaggattatctggatctcctgacctcatgatctgcctgctcctcagcctcccaaagtgctgggattacaggcatgagccaccacgcccggccaaaaactgactttctatatcgccccccacccctacatcaccaactgctcagtcatccatttactttggcacatacggtcttgattaaagggaagagggaagaaaatatttactgagtacttcttaagtgtcaggacctatttggtacttttttatctaatttaaataggattaggcaccaagtaaaatgcctggcccatggtaggtgctcactaaatggtagtttttatggttattattacagtaaattctcacaataatcctatagagtacataggcatcatctcccttttcaggttcagagaggtttagtaaaaagcatagctaggaatagtagatcaggaattcaagcaccaattcaagatacaaactgctcttggacctatgggcgggagtgtcggggcaggaatccacaccctgagaagtaaatctgttttgacactcaaagcttacttggtcaagtgttgtctgagaaacagagtagtcttctatgtggagtcgctttttgctctgggagaggatgctgaatatcctggccagagaagataatgaagatggaagctggtattgtagcatgttccggtgtttctcttttagaacacttccaggaaatgcaagtccaaagaaatcctggacaggcttcaggtccgggttggaccctgctattcgtacaactattgtataaccatctccaaacctgaaagcaggaaaaaatacccaaatggaggatctccagaaaactatttaaaagaatactgaaccctgggaacccaacttgtgccatgaaaaagggcggcccctggcaggcccagaaataagtttctgagagaaggaaccagttatcatttactaaatacttattttatgtgaagcaccatgccatgtgctgtaaatacatgatctcctttaatcctcacctggacccatgaagtctgacagatgttacagagaaactgaggcccagggagttagtcacttgcccatggctcagagctcataattggtagggccaggatgcaaacccatttgtgtttgactccaaagcttgcgctctcaccagtactggcacatgtaaatttttttcatttcatctatagcacaaagctaggaggtagatcttccagggaaactaactcttacagtagttaagtcacttgcccaagagtcacagaaccagtaaatggtaaagacagaatttgaatgcagttcggacttcaaagccctcattctttccactatactgttttgctcagttttatttccctttatgttagaggcaccatttatatactcacaaaagaataaatatcaagccttctcactaggcactatcccaaagaaattatctttattacctattttttagatgctggacactgccaaggcacctgaaccttccattgaccatgattgccatcctagtgcaaagagcttcacattcttccatactgcggtaaaacagaaagaggttttagttttagagagattctctgtaaccatgagaacatcaccatgacttccagcattccagcttcctagggaattgtattctgttacaagtacatgtggatatagggatgatgctgttcagtgtagtggtgtttacaattgtgaacaagttggaaataatccaaatgtctacaaaagggggaatagttaaataagagtatatcctaatggaatactatccagctataagaaatgacacctaaatgcactgacttggaataatgtttacaatatattaagtgaaaaagagcagtatttatactgggcttgcatttttgtaagaatatgcatatataatttcaggtaataattgttttactctttgcttttctgtattttctaatttttacaaaatgatcgcatattctacttggaaagttaaaacatcccacagtgaggaacccaagactttactacggacctatgagatgtaagcactactgatctcccctccttgacaacacttagggcacaattccacaagaaccgccgggctttgggatccatgcctgtggtgggttcatcctgtaattagaataaaataagtcttatttgctggggggaaaaaaaatcaaagataaatttgtttttaaatgcagaagcatctttgaaacagcttaaattttaacttgccattctagttatttcttgatgaatcaaagaattagagtaactttcaaattcatttgtaaacaaggtcattattataaatgtcttattgatgcaggaaactcaaatattctgagtacttttttatgtaattaaatttctccaaataaatagggaaggaaaaaggccatttagttgtaattatcttttcatgactgataagtatatacaaaacaactttttgtctgaaacctctattgaagtcagtataagattggggtgaaattcctttttttttttaattccagctcactcagattaccctagtatattgcaactgttagccttacagaaacaaattccagaccgaggtggaatacataaaagcctcaaaggcttcttcccgtaataacatcaatgctcttatctacagaagaaaaaaggtcaagggccacttcccagtctgatctgtttttcatctatccgtgtgtaaggaactatgacctagttgctaccttggggattttaaagctgtgtccacactcttcattttcagggaatgaacacaaagatgattagaaagaatgttccagagaaagatcaaatcacatatccagcctcaatcacgctaagaaacaaagtgcttggagtgcctctatttgggagcatctgcaggcatggtacagccaccccagtgtgtgccaagggagaagcttccctctgcttttccaaggttgctctgctgtccctgggggaagacaagccaatcatacaacagccctggacatataggacttttgaacagtcatgttttccactcaggccagaacaacagttttccatccacagttatactcaccagaaacaccacaggaggcccgccgatcaaagccatggctgtagagagcttgcgtttgttgcctccactatagttaccagcatatttttctccatacttcacgaggcccagtttccgaatcgcccactcaccaacctacagtgataaaaagcaccttgactttggtctggcttgggaattttatcatgctgtcctacacatacatgtatgaaagttctttcactgagtaggactagattctataatcataacctgacaactggtgaggagccaaagcagggagaagggactcgtgtggtgggagcagcactccctctctgcccacccagccctgccccaccaccgttacaggtttccaccctgaaagcagatacaaagaaccagcattttgtgctgctgcattcatgaggaaaaacagcctgaagtcaatgcgtgtggaaaagccataaggtatatattgtcaggatgccaaaggagacaggctggctttcaggtgcccacagtaccttgccaacttctttctctgggactcctctcaaaagggcaaagaactccacgtgttctctcccagtcaacagctctgtgatggcatcaaactgagggcagtagcccatgttctgatgtacttcatggatgtttgataagatactgcaaaggacaagaaaactacttagattttaagcaggtagagatactctggttagacaatctggcctaatgttcctgtaaagtatgcttctccattacaaagataccaatacatctgctgctacttgaaagcacagcctttctgcccccaggatgctagctcttcctggcaggcagggttcctgcctctaccctccccagtccttgcacctccctggctctctgaacacttcagtctgcaggtgcagtcccatttcagaatttctgaggtcatgccaaccactgcacattctttaccaacaatctcagtcacactaccccagggctttaacgctaaggccccatcctagacttcactcatatgcaccattcacatgcaccaaatgagaaggcccagaaattttgagtgtgagcaacacagaacctagagacacaatttatgtggtggtggggtggctttggggttctatgaagccagtcaagtgaagaatcacatgtgagagaagttcagtgttcacgttccagactgatgactgcacctcagccacagcggcattgccatgaacttggccttctggcagcattcattcctctctgtgtatctaattagcacccccagggtcagcctttttcagaattaggattgaggcacacgtggacaccgtgccaggccctcacagctataccaaccaaatcagttcttacaaccagtccctgtgacaaaccttactatgggctggttattactgccactgctatatgcgtcaggagcttggtactaggagcaagcctaggaaagcagttgtgcagcgctaggcctgctattcccagaatgtctgttctcttaggattcctttacattgctactgcaaaaatgtaagagacaggagaggagatcatgaatacattaatttccttgctcttttcaattttattggctatccccctgtccagtgtgttcaaattgtgagtcattgttcattagtggtttgggaaataaatttagtgggtcatgaccagcacttttttaatgacgcagtataaggtagaataagaaatagcagagtgcactacaattagtaacagtaggtactgctttatgaaactttaggttatacatgtgtctacatgtctgtgtgtacatactaggttgagatataaaatgtatttcccacaacggtcatggtcaaaaaactctgaaagccactgccttgtactatctctccacataataagtccagagaagccgggcgcagtggctcatgcctgtaatcccagaactttgggaggctgaggcaggtggatcacctgaggtcaggagctcgagaccagtctggccaacatggtgaaaccccatctctactgaaaatacaaaaaaattaggcaggcattgtggcgggcacctgtaatctcagctactcaggaggctgaggcaggagaatcgcttgaacctgggaggcggaggttgcagtgagccaaggtcgcgccattgctctccagcctgggcagtaagagtgaaactccgtctcaaaaaaaaaaaagcccagagaagccccacatatttaaagtacttagagtaacattatctaagaagcctataaaatgtagctgtattcccaaagatcagattgctttgtgacctgtgcagtctcagaaaatggcctaacggtggctcagtcaatttgtatgctctttagagagggcaatttactttgtaggaattgttcctgaggaaataataaaagatgtatacagggacatatttacatagtgaaaaatggaaactaatgtgtccaacatttataaggaatttattaaataaattataggtacatgtacatagggggattttatgtagcaatgtaaaattccacatcttaggaaatgtaacccactgggaaatattcataatacactcattaacaataaaaactaattttaaattctacatacagtatgatctcaattgtatggcacatttatatgtgtatataagacagatgtggggtgatggaaaagttctaaaactggattgtggtgatggttgcaaaactctcaatttaccaaaaatcactaaattatactcttaaaaaacaagcaaattatattgtatgtaaattatacctgaataaagctgttaaaagaagagaatgagactgaaaggaaatgtaaattgtgattatctctagatattgaaatcatggatgattttatgtgcttctttaccctttactatatttcaacatttttatgaactctaaaaataccactgtaatcaaaaataacaacctatttctttaaataaattaaaaacaaagtctttgcagcaaaatacaagccacttcttttctcacctatttttgttaaggaaagcatctcctctggtaacagtggtatctcctgttaacatcttgaaagttgatgattttccagccccattaactcccaggagcccaaagcactgaaaaggaaagattaagttgtataagcaaactctaaaaacatgaatataaatgcccctaacacgtaactacctcaaaccttcaattcttaaatatcagagaagaatcaaatattttcttggttttaacacatcgtatagatatttaaatatgtatttcataatgggaccattttaagtgtggctgtatttataaatattatttgagttgtcaagttgaggccaaagttaatgtgtgaaaaacagtaatgaaagccagctagccaaattgcaccacctactctggcaaaagggcataaaagaacacaaacggaaaccagaaaggagaaaatctatttttaaaaaactatttgaatgtcatcaccatcccaaatggatcacaaaagcatgttttagatgtgcgtgctttttctgtttttgttgttgacatgagtctcactctgtcaccaggctggagtgcagcagcgcaatctgggcaacctccccctcctaggttcaagcaattctcctgcctcagcctcccgagtagctgggactacaggaatgcactactatgcccagctaatttttgtatttatagtagagatggggtttcaccatgttggccaggatggtctcaatctcctgacctcgtgatccgcccacctcggcctcccaaagtgctgggattacaggagtgaatcactgcgcccagccccatgctttttcttaaattgtattggattctctgaaatcattctcttgacatacagggtccctctcttctcgatgactaattgctccatcctggcataaatacagaagcctttaaaatccacttttacctcttaacgagcatcgttgcttgattgggtagagatagtctgaactaatagggacaaacgcaatatagacaaagtgtctttacctcaccaggaggaatgcccacgcaaatcctgtcaacagcaggcttccgcttccttctatatatctgcaacaaacaaaatgtaaacattcataagcctcagtgactcacagctctcccaagcaactgtggaaggcaggactataaaccacatacactgcaacataagacttgtcaataaccctaagccataggcatatttgatgtgccaagagccttggtctgcgtttgtggcgactggcttctgaatgattctgaagctcaaaataaaagtgaacttactttttaacctgtctttttagaaccgtatcattcattattatctacataatttttcatctattcaacatatatatgtattgcaggtattttaaaaattaaattccacagagtagaaatttgtaataaaaatattgcaaatactgtacagattccaaaaaagtaaaatttggagatgctggcatctagagggctgatatagaccctcttgaacacaggcaatatatcagctttttggactatgaaactcaaactcaaaatcaaccatttattctctctacctcagttttgactagatatacaatattagtatgttttaataactaacacataaatgtaagcatataaaaccaatgtattcgagaatgggaattcatatcacaaaagaattctcagtaagaattctttaagaagtctccatggtgtttttaaaataaaattgacagaaccttggtatagatgtacattttgggaacacatgcccttttattaagcaagtcagcaaactgctgggttacagcacataaagctgaaaaaaactgaagatgagctattgtaacctgtactctctcaccttcgtcaactccttgatttctaagatgtcattctggcctccaccatcaagaattctctgtctttcccgcctcacatcttcatcttcatcattcagaggagatagctttgcatttacaggtcttgggggaaaaaacaagaaaaatgaacctttcaaactatttttcaggacaaagattcagtctctaacgtagtattataaaacctacttgccacagtctccaggatgggcagggagggggctgcgggatgcccacatcaggaaaatcagttttatcacatattttgagttcagttcaatgcaacccccattggtgagtgtttccctgtgcgcctcctctgtgaccctcaaccaggtgctccacgggttctaagaaaaagctcacctgggcctgatgaagaatctgtactggatcagaacagtaatgaggaagaacaccaccccttccacggccatggcgaagaggtttcgtcccaccaagtcccaagataatggtgacacaaagcgattctcccctagtagacacaatgcagagatccggtcagaatggagggatcaaaaaccatggcccttcctcaaatttgggcctatgttccttaaaattcaccgatcttccaataaacacaaatggctatcacccatgacaaggaaaaaagagtaacaagagagtgatcactttccaagtctgatttgggaaaactttttatgacccagtatcaatcagaatttcagagccaatgtgtattcgatttgtaacttcactgaagatatctagtatttctttttttaatgagacatgccaaaaatccttttaaaaaggcaaacgacccaagtaattttcacagtcagtatttttaataaattctaagttttagtaataataaatatcagaaagcactttaagcagattcccctttcagtagcatatatcctagtgaatcaattaaaccactagattcaattaaatctagttccatgtaaccattccttaaattccttacatatctcctttgtagcccaagttgcaaaaagcccctcttctatgaacagtaaataacatggcccatttgactatattatctaatggatgaataataatcatatggctaccggagaaatatttttaaccattctaaaggtagaaaaagatgtaatacattataattttatagactgtgtaaaagataataaatgacctcatctgcaggcacatgattcgcctaaaagagccaaagtttgcatctttccttctgattccctgatcacctaattctcaaagttatggtttgacttttccagtgcttctaaccaacccagacagtggcatgagccagtggatccaagcaaatgccactattttccttaccttcaaaactgccctttcacttttctcaatgctatcagagacacagacaaatggttgtgtcacaaaacccatgccacaaccagctgtgttggcatgagccctgtcactgggcatgggggtgggggaacatcctgtgcttagtcacctgcttctttccaaaacaaagttcagggtaccaaggcctatgcagagtgccatctccattaaagcatcctacagccactgcttcactcaccaaacctttccagggcatcagccattgcctggtttttcaccatgtcgatgagccctcgtcccaggcaaaaatgtgggaagatcaagaacacggacttcaggatatcattgatattattcagcttctaaaaaaaaaaaaaaaaaatgggagggaagggagggtgagggagaagaaacgggtgtcattcatggtttatcctaaaaatgtatcaagttctgaaatatgggagtgaagaaaaaatttgattctctagggacaaaccagaccttttaattcagataccaattaaatagcagcaggcatagctgatgatatgtagcaataaaattctattctttagaaaatctggagaaatgctctgagtatggagaaataatgaataaagcttagaaacaggctagatttaattaaagcaaatccattaaaaatcccttagcatttgaaaagcaaattgctcatgtctgggtcaatatttgagtttcaggattttgtcagaattttagaaattcttctcaaatacatcagaacttatgatcccacaaggcaacagtggccaaatatctaccaactgaataaggggctatacgctggatgcactgtgctagggcatgggagaggcaaaattattaagaaacagactccactccgagtaggaaaagtatgtaaacaggaaattaccatgtaagtggatgtacgttgtactggaggcatggactaaggactctgagagcacagagaaaagagagaacacctcccagcaggtaaggaaagcttcacattttagctaaatcttgaagggcaagggatatactaccagaccctgtgacagaagaagggcatttcaagccaggcctacaggagcatggtggttggaggcaactcatctgaagcttacagctgggaaagggtgtggtgggtatggacaggaagagttgtgcaactgtaaaaggccttgtgtgctgtgtttggacaaaggcaatgacaaccggaatggagaggaagccttattttagaggtccatacctggaagaactgacaacataaccagttgaatgtgggaaatctgcaacagcaaagcaagcatctaggataactctaagagccagcttgggcaaccgagtggatggtagtgccactgagtgtgacagggatggcaagaaaagcattaagttccaaggggaaagaaaactaggacatatccaggttggggtatctatatactatctaaatggagcaatccactaggcaagtgagaatttgagattagagttcaaggttatgatcaaggctaaaggcattgatcttagagatgacaataaaaacaccaagagaggtgatggtaaaagccttaggactgaatggcgtcgcccagctctcatgtgtaaagtggaaggcagaggagctactcttggtaagagcaacattgaaaaaagaaagaagtaaaaaaaactgtcaaaagaaactgaaaggcttgaccagcaaaatgtaaggcacagcaagaaagaaaggtgctttgccttctcagggaagacagactctgaagacaggacaaggcagtcagcagtgtcaataccactgacaagtggaataagatcacaattaaacactgtcctctggctcccagagatgctcatcccagcaggagtgttctctctgcatgactcacattgtcggtgaacagctccagcacaaaggtggccacgctgccattaatgccaatgaagaggttcacgctggtgagcaccacataggctgtgctggggatcttgaacacaaaggaggctgggtacatgagaggtgtgattgaccacctgttgagacacaaaaagataagtgtctactgagagtccctgccctccttctgacactgggcaccaaatgccttatccactgtgcagctccctcactcagaggtgacttacccatacagcaaaagtagaagggctagcacaggcagattggtggaggacacataggacttctgctggaagcagatgaagatgataatgaccagtgtggcagggacaacgtaattgcactaaaagtgaaaacaaagacatccagttcacccctaaatcaaatatacaatgcatcacacaagttttcaccattatcagacaagaaagggcagataaacatattggagagtaactctgaattaatgaagccacataaactattaatcaaaatacccgacaatacattttgacaagcattttccccttggctgattttataaactacatgccctttctgtctttccaacagtcaagccaaggtgtcacactcagtaaacttactgaacgatggattcccagtcagagtaattttaatttcacaggcagcaaataagcctctattcttcttcccgaagatgactgtgtctgtttcgtcattaatgctatattatagtctgcccaagttcaatctcacatgtaatctatttatgaggtaactgctcataacatgaatgtcagaattgtttcatcgcactgagaataattttaaagtctgtcctgacagtgtatcaagcagtaaaatgcagaaataaagacttgacgataggacaattatgagaattcacagctggcagagcaaagcaccagcagggaagtgatagtggggcttgtcagccgctagaagaactgcagcttcagactacagggctctgcctcagtccaatcctacttgatgtgtttatcaacaacttagatgaagacatgcttctagcaaatttcaggagctctaaagcagggagggacagataatacccaggaagacaagagatgggttcagggacttgacctttcatctctgaatcacctatgcctggcataagtcagacacacagcactcagtctgtgtttactgaaaggagtaattactgaatcaagataaaacaaaaataaaacccatgtaatttaatatggataaatataaagtttagtttcaaaaaaatcaaatgaatttgtatagaatgaaggagacccgaatttcacaatcatttgtgtgaaatggaggttttggtttaccactaagttgccagtaagacggtgctccttccaaaatgcaaaatctttgtgctgcagtaatagaagtgtgagctaaagatcaactccctctggacccataaccattcagaccacagcctgaacacaaggttaattcttggctttgcttttgaaaacggacattcacaatatacagcatggccatacaaggacaaccggatcagaagagtgacacagtctaaggggcttggtataaacagcaaagatctcatcatcatctccaccatcattgctcacatttgtacagtgcttcggaggttacaaggtgtattctcatatatcatcttatctgggtaatactcaggttaaatgagagtatgagagttatttttaaatatccagggacttgttcggtgggagaagaattagatttgctctgtgtagcttataattaatagaagttacagggagatatatttcagggagatattgtaaagtagagttgaaatataattagaacttcagaattccttcaaatcccccatattggtccaaatagaagcaatatattgtggctggcacaaaaacatatttgcaatggatggataagctgctgataaaatgtacagagttttcaaatgacagatggctttcctagtaaggcaaagaacattctgactctggaggttaaaacccatcagagaagttagaggcattgacttggagttttgacttgtatctctctgattcttgggaaagttgtcacataggaacttaagtggtagtggtattaattttcatcattgtgtacagaattttccctctggtgtgacatgaactctggtacccaatgctgtgtttggtgtcatgaaagtgatcacctgcctctggctatttctttttcatacatctttagagtagctggaacatttcctgatgatagccagagctctttctttcttatccatatcaatccatggccctgacagacatcagaaagatacagcaggcctgtgtccttaccatatcccagacaaaattagagagccagtagatgacaggcttcactccactgatgaactgcaggtgttttgctttgctgacccgctcctggatcaggaatacgacaaagctggctgggacgaaggacattgcaaagatgacacagatggacacaaggacatccactgatgtggtcatcctggagagaaaaagcgtgtgaaaatctgaggggtctttgatgcagttagggctcaatcagtgaggacatggacacacagacaaacacacacgtacacacacacagagatatctgaggcacagcccaaggaaaaacatctgttcaccagacacattttattcagggttaagatgatcatttttaagtctaaaaatatgacaatgtaaatgccaaactggtattactgaggtcaaaagagtccactgtcacaataaaactaatgaaggaagtcagagtggttaatggcattcactttggtccactgttcatgaccttgtaagagcagtaagttgtaaattttcacacacaaaggactagtggggcttgaaaactaaatgagagcagaaatattactctgtaactactcaaataaattaatatttctggctgtaaatcaacttgaaaataacagtatgcagcctattgatctaacacatacaaaaattctgtcagatttttataagaagaatggtctcataagcccattacatggggtcttggtataaagatcctagtgtcctatattagtatcctgtaggagtaaagcagaaacaggaactgccatgctccacatacaggaaaggtatctaatgtgtgtgaaatatcaactctgtgctgagtgctgggcttggcaatttacatgaactgcctcatttaatatcatacatctataaagtttagagaccagattcaaacccagatctgtatgactccaaaggctgcatactttaaactagctcatcctggctttaaacttcacacacacacacacacacacacacacacacacacacacacagcttaatttaggaattaaagatacaagctaataaaaacatattccaccaaatttaaaacagtggtttttaaacaaatcaaactgattaaacacttataattaaattataatttaattaacaatttttgaactcactttatatgaattcactaaatgttacgatttttacatatcagtgtcattttctcttctgcagttcaagaagcccaaccagccaattcgtaaacttatcacttctgcccagagcctggatcaatccagatttatcataatataacggtctctgcagctgttcccctacaatgagattcacatttttctccccttctccataaccctctcccttgccccactccatctatacagacacagccacacttacagagccacctctgagagctgctgcttggtgagattcaggggatgattgaaagcagtaattccataatggctagggttctctcccttttgcaggttggcccggagaatggcattgttgatgacattcaggaaagagctgattgcatgccagcccttgttattgaaccacacctgaaagaaaacataccaggtacaaggtaatgcccccaaaccgggctcctgcaggcaggtgcatacccaccaaccatgcccataaacctcagaaagaaattctagtcacataccaaggcaaaacactatgatcagagaatatggcgaagtaattacagtgttcaggacatagtgatcactgactatgtgggcaggcgctgtggtgaggaccttatacctttaactcattgaattctcacaacagtttggaaatagctatgattactgtctccatttcacagatgagggaactgaggtttagataggttaagtaacttagtcaaggttacctggtatgtctggtggcaaagcaaattctctgaatcactacactacaccgtactgcctcactggtaaagttaatagtttgctcttttctgttgtgaatgcccctgccaactttaccatgagttgaaagtactccaggaaacataaggattattgttcatcaaaaagctactagaacaaagacagcggtttaccttgacattatttttggtgtccagtcctgtcataaatcttcccaagctgttgagaaatcgatctgcagaactgtcctgtaaacaacagaaacctgcctcagttgtgactgttcacatagataaggggcaacagtcaatctggaacctgtggacaacaggacggccctgtgaagagcaatgccactaccttgttcactgaaattaaatgtgaagccattaaataaacggctcctgagaaccaagtgactagaaatctacagcagtgatgctgccatgatgccacaagtctagaaggaatcacagagaaatcctgggatgcaaagccccaagattttaatgtctggttatcacggtggggtgaggactcctcaaagtgctccaccggcatcatctgaagagccagaaccacgctctgcctgcagatgtgccagatacatgggcccatcactcaaaagcagacttgtggactctaggactatcactgctgtccacaatcctagggtctgttttatcagagccccttaattctcacctaaaaatgggaaacctgagacacagagaaatgaagtgagtacttatcaggtcctacagaccagcttgccagcttaaaaaaaaaaaagattcatttcctatttagtcagtgattgtttcagcaaagtatgtttgaaacccagtttatttaccaactgaccaaatttgtaaacctggttgttctgagagctttttttgagatggagtcttgctctgtcgcccaggctggagtgcagtggtgcaatctgggctcactgcaacctccgcctcccgggttcaagtaattctctcacctcagcctcccgagtagctgggattacaggcgcacgccaccatgcccggctaatttttctatgtttttagcagagacagggtttcactatgttggccaggctggtctcaaactcctgaccttgtgctttgcccgcctcggcatcccaaaatgctgggataacaggtgtaagccaccgcgcccagcctctgagagcttttaaatctctggatttaatttgttttttgagatggagttttgctcttgttgcccaggctggagtgcaacggtgcgatcttggctcactacaacctcttcctacagggttcaagcaattctcctgcctcagcctcccaagtagctgggattacaggtgtgtgccaccaagcccagctaatttttttgtatttttagtagatacggggttttgtcatgtaggccaggctggtctcgaactcctgacctcaagtgatccacccgcttcggcctcccaaagtgctaggattacaggcatgagccacagctcctggcctctggatttgtttttgacctacacttttaaacgtacaactaagtaattcagttttgtctggctcaaatcgctaaatgccaaagacggctctgtatgccaacatattcagaacaatgagctgccaggtgatccgtttaacctgccaactactcctatatcccagcagctacatgcccatttttctgatacatcttacgatagatattttaccttggccagctttaggtgtttcttcatttgtttgatggcatcattaacttcttgactcggaggaagtgcttgagtattactgacacccagggaaaagccgccatacctaaaagaacagcctgacattaaaacccagacagtggggtgcacagtatcatcagcagcagactcagtgcgagtgtgtacaaggttcactgagtcaaattcctgttcaaaggagggctaaattttgcctcagagaagttacacgtcagcttcctctaataaatgttggcaatctcttaactcccatggtttctgcccagcagggaggacctggcctgattacacacacagttagatagctgagacattgaggaaagaatggtgtttcatctcacagatgctcctccaacccagtggctcgtgtgtgaatgtgggtctggaggcaagcagatggggagttgggagagtgggaaccctgcactgtccagagtaggctgcgctggccttatacacaggctccggctcctttctagcatgagggctattataggggcctgcgtctgctctgcccagagatccaggggtcctggcccttggggaaaaggcagagagaaaagacggaaatcagtaacaaggagccttcgggccccctgacgtagccacatcacctatctcattttccatgatggacaaactggcttcaagaactcttctgtccccagtcccacctgttccttcaaaacccagaaggacaaatgggttgaaatacagtgcaaagagatggttttggcgcttcttatttcctctaagacctttttagtcccgtgctaaatgcctagaaattgtccttgagtccttaagaagcctcgggaatctggtttggggggaaagtacaagtaggtattcccctcacaacactacttacttgaaatccctagacacctgcaggagatttctgattctcctcaaggaaatcagtatatcaaatatttcagaggcctctggaggggctgctgggcactgagccatgatgctctaggcagaaactctataaagcaggcctaatctaaatctgtctgtgcccctgtgtgctccacatgttcacagggcttctgtcctcctcacagtgagatggcacccacaagtgtgtgagtgacaaacaatccccaaggctttcttcaatccaagacacctacaacaccatcctccccctgagctaaacgtgccagaaagacagcaacttacctaaactcattcacccagatcttgttctttaagctgcagagacaaagaaacaaaaaatcagttcaaagaaagcactgagcctattcctaatgatgcaaaaggagtaaatatccacctgaggatataaggaacggacagaaataaccctagaatcagctggccttgtagggttgtgctagagaaaagaagcctgtgttcaggcctcttccagccttctctccatcataaataccctattacttatatgagaaccaggccttgggttaaaccaatttacaaaccaccttatagaccaagatgtaaccaaactagaagctttttctttcttttttttttcttttgggagatggtttcgctcttgttgcccaggctggaatgcaatggcatgaactcagctcactgcaacctccgcctcccagattcaagcaattctcctgcctcagcctcccaagtagctgggattacaggcacgcaccaccacgcccagcttattttgtatttttagtagagacagggtttccccatgttggccaggctggtctcaaactcctgacctcaagtgatccacccgccttggcctcctaaagtgctgggattacaggcatgagccaccgtgcctggcctagaagctttttcaattaacaataatatttcaattgtggatgacatatggagaaattatgcttctttcttagaaactcatggtcactatcactccagcatgcccatgccatttaaagtcactgagatactcctaactgaaagaccccaactgaccaagttgatgggaaggaaacgagaacaaacatttgctgagccaagcattcaacactaggctgccatgtcctgggaagctagaaggctctcccaaggctgcagagccaaggcaggctcctaaaccttcccagagctccctccatgagaccacaaattatcatggagtcccccatcagagagtacccaaggcactctatgtacaccatttaatttagtcctcatgacaaacttataagagcaacattaatatcacaatttagataaactaaggctttaaaaggataaccagttacctggtcaagttgctactaagtggcaaaatttgacgttgaatccatttctattttcattctagaccaggctgcctcagccttgaagctgacaactgaatgttcacagtccctctcgtcatcttttctagtttgggataatatcctaaacttccaatagacagaatcaggccataatctggcatttcccccactgtttcagtctgttatttgtaggtctttaattcctctaattagtaataatacggcaggggccaagtttagtaaaaagtcaccttttggctatgatctgcacatacgtcttcaccagataatccgaaatgtttcttcctgtcaggtcctgaaggatatctgcagtgttttgttttctctgtcatcacatgaaaaccaagcatacgggtctttatagacaagaattgaaacagaaaacaaatcaaggacaacagtgaccatgtccacagtgtgaccggaaacctgactacaggtcccagacactgccctcagtcaaccagcactgagacttggttcaccctgccctcggcactggtaattcacttacaccaagccaaggtctttcccaagaatttattctgaacatctaaacaataaacattgaaatgagattctttgtagtcaagagatttttaggaagcaccatcattcactatgcctaataaatcttctgttcactggagttatactgatgactagattagctgttattttattcattttattttttgatatggagttttgctgtgttgctcaggctggagtacagtggcgcaattttggctccctgcgacctccacctcccaggttcaagcaattctcctgcttcagcctcccaagtaactgggattacaggcatgtgccaccatgcctggctaatttttgaatttttagtagagacagggtttcgccacattggccaagctggtttcgaactcctgaccttaggtgatcagtccacctcggcatcccaaaatactgagattacaggtgtgagccaccccgcacctggactagctattattttcaagagtggtaaccaagccttcttttagttcctgtactcatttagaattgcttgtcctcatcctgcaatttggttgctgataaaagcagcagagagctatcataagcactcctcttcctgaaattctcaagaaaaaaaaaatggctcaggactccttcccaaacagagtctctaagaataccagagttgacaagatccacaggagttttctggtccagcctccctaattcagaggtgaagaaacaggcccaggcctgtcaaaggctaccagctcatttgttgcagagccaagattggaagccaggcctgccacagtctgtcctgtgactttactgctgtgggacaggcatgggcacagtgtggtccaaaccttctcccctcaaaactcacatgctttttcttatgacaagaagcgagttaaagactgaaacagggctgggcgtagtggctcacgcctgtaatcccagcactttgggaggccgaggcgggtggatcacctgaggtcaggaattccagaccagcctagccaacacggcgaaaccctatctctactaaaaacacaaaaattagccagacatggtggtgcgtgcctgtaatcccagctactcaggaggctgaggcaggagaatcgcttgaacctgggaggtggaggttgcagtgaggcaagatcatgccacagcactccagcctgggcgacagagcaagactccgcctcagaaaaaaaaacaaaaaacaaaaaagactgaaacagaccctcccaacatgatatctcactcattcctgcttccaagcggaagctaccagcccatcctgcaccccttctgcccaatcaccccctgaaagtgactcacttgtggaggaggcagcccccctgcccctgggggacacacaggcagcatcttcttgattttgtcgctgctacactggcatgcaggtgaagggttctgcattgtccagttcccattctggaagaggtccatgatggtctggggaactggggcagtggtccactcttcctcccctgcctggcagggcgtgtctctgcaaagggaagacagcaagagtaggattaccagagatggcctggcctttctgttgcctcaggagcacaggatcattccgtaacaaccacaaacatgcatctattccctcaccatttggaaaagacaagcatgatctcatttgattgcttgatcccacaacagccttgtacactgtgacatcatttatatcatcattatgtatcattttatacataagtaaaatagaatgcaaagaggccctaaatatttacatactgaactcagttcaatccaatcaaccaaccatttgctcacacaacaaacattcgttgagcatctactacgtgccagatgctgtccagtatattcgagggcctaaggtgaaaatacctgccttcatggaggtgtatgcccatggaggagacgaacaacaaatacactaataagataaccttagatggcccaaaataaagcaaaataaaaagacagtgactggggagaatgaacctactaagagaagacatttcagccaaaacataacaatgatggagaacaagctgggcaaaagcttggcaaaaagaacattctgagcaaaagcgatggcaagtgcaggtacaaaggccctaggaagaaatgcatttctattttttaggaataataggaagacagcatggctggagtaggataagctacgaagaagagtaatgataaaggaggaggagaggagccagatgagagaggcctgggaaagagtctggatcttatgctcgatgtgctgaaaaatgagtagagactggcaagatccaatttatgttctcaaatgagtagagaattgggggatgactggggtgagaatgctcgtcacataaagagctacgctgtctacaaattttccctggagataagacacaaagccttcaacctcatctccagctctgaattactgtgggacatcagcaggtcccctgctcttttgggggcttattttttccactggcaaaataaaagtttaaaatgatttgattcaacaagtcatttccagttcccttccagtttcagaattccacaatttaaagtaaagttacagcaattatttccttattattaaatattaaatataattgccaggcacgatggctcatgcctgtaatcccagaactttgggaggcgaaggcgggtggatcactaagtcaggagttcaagaccatcctgtccaacatggtgaaactccatctctactaaaattagaaaaattagccagtgtggtggcacatgcttgtaatcccagctactcaggaggctgaggtaggagaatcacttgaacctgggaggcagaggtggcagtgagccaagattgagccactgcactccagcctgggcaacagagcgagactccatctcaaaaaaaaataaataaataaaatatatatatatacacacacacacacacacacacacacacacatatatatattataaatatatatttttaactatttcttattgttttcttatgtattaaaaattcaaatgaagttttccagattgatctctaattgtctccttaaagcacctgaactgaccagaaaagtcacactaagacgcgctgccctcctgaagcttacactctgaacattcaaaaggggattggctgagacaaatttaaatacagctgagacatgctcctgtcaaatttccttcaggtccaccatttttttgcaaaacctaaaaatttgaatttcagtaagaattgtaaggataaaggctcttccttccaaccacctccggcagactgtaggtggggctcagacatcatgtttgaaccctctgatgtcagggccgggcctcttttgtctctatgggctggctctcagcccagttctggctcctacagagccttcctaagctagcatcaatccatgagttcatatggttcagctggccagtgatgaatccagataactatattatcatctcatctcatgcttctatcttccctacacaaccttcatgtggaaaatcaaaggcaccatgaaatccagataggccgtgtctgtgtccttctctatccttgtcatctggttatttgggaaccaatattagctgctaggatttaccacccattatgtactaagtactaacaagtatttagtaactatccaatactaattaagaacaaacaagcacacagtagctatccatttagaaatctgctctagaaccttgtataaacaggttatcatgctcactgttctgtggtgtgcagagtcacctatcttcccattgaaacttgaaagtcaagtttgccccctctccaattctccagcaccttcccaccttgccataatttttcagagatcactgttgtttcatgacctcagctgagattctgcctaaacctggaaacactaacccacctctaccagccttgagcacggcctcataagatcctcacctctccaccatcttcactcacagtgatctggtgacctcccttcccctacactcacttaagggtcatatggatgcttcactgaatttatttatccactgcttactttttaaaagggggttttgaaggaaagtacaataaaaatatacaatttgagaagaagaaagtgtccctttttataaaaattcatatgccatcttttcagattataaaagcgaagaagctgataagcaaaacctaaaaatcatatataatgagagcctattgaagcacttaagtacaggggctgggagagaaagaaaggaaaagcatttcatcagtaagtgtaaagtgctatttaaattaaatattaaggttctaaatcagtaaacaaatgtctgtaatgacgtgctttgcacggtgttagaagactctccaaacgtttgttcctagataatttagttcggttactaccttcgctttttgtaaataaaacataataataattcaaagggcaaatgctggcggtcacaatgtggcatgcagttgataaatgcagcatattagaaatcaaaccaggcaacaagcacaagaagcctgcttatggctaaagtggcactcacgggattgggtttccttccatacagcgggtcccgaagccagggtctttggtgagggcgtttaagagttccagggttcccgtgtcctcaggagcatcattgctgtgggtacatgagaggcagccagcttagtaattcattaaaaccagtaatcgagagataaaaatgtttttataaattaaacattttaggaagcatttctctgtgacaggctcttaaaacagaaatgaacaaaacacagaaaccacccagaaggatctcagactctggccctgtattcggcatcagggtgacgtagagcactccaaagtggagcttgttttaaatgggctgtatgtataaaggtgtgtatgtgtacacacatgtacatacacatatacatttatatattttttttaatttgaagaaaatcaactcattaagtatttcaaaagtgctttcacaattatccctttggcacagacaagcaggattttccaagaaagggcaagaaaactttgtactctttgcatgcacaactagaaagcacaaaaataacaggcacaggtcacaaacacatgctatgttccacaactacgggcaatacagggtcagcagccggaaaggaaaaaataaagtaaacctgaactatgtaagaagaaaatgtgggcttagagaaaaagaggccaattcacattacatatatatatatatatatatatatatacttttttttttttaaatgcttcccttttgtatcactgacacagttcccccatctacaggtctacaaatctttcaggactgaagaaagctcctgctaacaagacccagaaaaatcctttgtccttttctttgatttaatgtattgttacagagtgggggatatttttatctaaagaacaaacactacctaacatcccaaatataacagaatagataataattacatgaattatactttgcagaaaacaagtctctggaggttctatgctttgacagtgtgccctgtgactcagttacagaattaaaacacagctccacaaatccaaatattttataacttaatcatggatttttgcaagggtggattatttcacctaaaacacatgtggctgttcctgacaacagtaggatgaagaggagagaggctgaaaggctcaacagaagactggcctattattcagggttagttcgctgctgttctatgcatgcagtattagcttatacagggacctgagccgcagcagtaaaattcattccaccgtgtaattctgaagtccattcccttggccctcgtaaacatctttggtctgctcgaatcttaccccctcctgggatgtagaagacaaacatacctgacaaatgtgtactgttcgttgtacatccagggctgaagttccaggctggggtacttgccaaagggtggcacgatcaggctgaacacaagggcaatgcagacaaacacagctggcaagacaatctttacccaggcagtggagggggcagggggacagcaggaaacggcaagtgttagaaacaaggccaaggggcaaatccctacgagtccagcccacctccccgaccaaccagcacggcaatgaggaatgcagggcctatgactgtgctgcaccaaggcattcttggcagctgggaagcaatggagcctgaaaactaaaccttttctctggcaacacaaggccagaggttatggccacctggcagaggcactaagccaagaagttcacgaagtaaatagtgctcacattcagggtgactcagaacactgggtcctgcccttcctcctcctgaagactgagaaagactacattgggccatgaacccaggaccaggagccagaagtcctgaatcctggttctgtctctagcacaagtgtacccatgtgaagtcacgctccccactggcctcagttttctcattttaatctgaggtctgagaacacatggcccattcaaatcctacactataataaaaccaactctacagcaacggctccaatcatggacaaccatagtcattatctcccatgatagtctcagaaagaataaatatccaattccttcttcaacctcctaagactttctaccatatcttctctgaaaaaaaaatgacttgggtatactttataagttaacccaaaactccttccatttattgctgagaaatgtattccttataaccttaaagattcaaataatgcccccaattctaatgttctgggatttcaatgcagaaaattaacattgagtgaataattctgtataacaactactataatgagaactatctctatgttgtcattatttatggttgtgttatcaatggtcatcatcaacaaacaaaggtaactgaggatcagagagactaagcagcttgcccaaggtcatatagccaataagtagcaaagtcaggattcaacttgagctctgtatgctccaaactcccgctcttaacaatatccacatcatcaaatgaaagactctctgcagaccttttctctatatttcttgattttatagagtgaaaaaatttaacctttctaactaagcaagttagcatgcaaacactgacatgcagacaatagtctaacaagtcttctctgttggccaactatattctgacctatcttttctatcagtttgagttaaacatcaactcagagaaaaatcatgtttctaataaattcacatgtcaagtgcatctgggcataacaactctcatgttatgacagctgaatacacccaaccagtttttctacactttgtcctttttatgttctcctccaaaataaaaataacatatacacacacaaaactaagcacttactaatgtcaggccccattctaagcacctattcatttttattttcgtaacaaccctgtattgcaggtaatattattatccccattttacagatgaggagattgaggcatagagaagtaacttgccagcggatacacaactggcaaggaatagaactgggattgaaatacagataaatctggctccggcatccatatcttgaccaggatgctatcctgccttcactggtcacagagcctgcagcccacccatgaagccagagtctctggcgaaaacagcacgtctcacctgagcaaaaaatcctttccgactccgtctggcaattagcagtctcttccacaaaagggccacaaactgttgctgtgtaagtttccagcctttcacctggtaggaccctttgccatccatcccactgagcaagtctgtctctctggattctgcaagaagccaacactgaaggtcacctattatcttaggtgttttcggcattgccatgctccttcttctggtgtcttcaacaactatcttgaaggcatgtgtctgaagctagaagtttctcagaagtaaagggctttcatgacaaagctatgtccaaggaaaagcttgactcaaaatgtctaacagtagcagtctctgcctttcagtccttgtctgataagtacagaaaagaaaggtgtcttgagacaactgaaaagaggtgttcatgcgtaaccaggtgttacagccagccattcggatgaatcaagtcatcaatttcttatagactactctatgaaacaggccatgtacgtagcttgacatatttgagaatacacaatggcaattagcatctcagcttctcaccctattatattttggtaaaacgtggacacatttcaaatgatctaagtactgatactgtatgaagtcaggcagttatatataatgtaagagccatacactctttgagcaggggtgagagaactggaaagttttctgttcctaaaaattttctagaaatccttgtcctaaactaatgatacctaactgatgtgcttttacatcttaacaatatttgtttgatgtcttagctctcctctccatctcagttaaacacacaaagacacactcatccaaaatatctaattctttttttttcttttttgagatggagttttcactcttgttgcccagtctggagtgcaatggcgcaaccgtggctgactgcaacctctgcctcctgggttcaagcgattctcctgcctcagcctcccaagtagctgggatgacaggcatgtgccaccacactcggctaattttttgtatttagtagagacggggtttcaccttgttggtcagactggtctcaaactcctgacctcaggtgatctacccacctcagcctctcaaagcgctgggattactggcatgagccaccatgcccagcctcaaatatctaagtcttagggtacaattaactctaacagcaaattcccctttctgactctttcaaaatcactcatctactcgaatgaatatttgttcaacaattaaacacctaatgtatacaagaaactaggaccccgcagaaaagataataaatacatgggttcagaggattgaggcaccatctttatgtctttaaaggaagtgatatggataggctctttcaggtttgatcacatgcacgatgctgcaaagaacaagtggcttttaccatttcctcacttctctttggactctgtagggatctatcaccttggctaaaggccatccaaagaaaacaggtgagagcatgagagagaatttcacattcaaacagtaggacactgtttgatcttgccctaacagacctgggtctatgtcagaatcatttggatcagcagcatcatcttcagtgaacgggcgaagacagctctgcttgtccccgaaggcccgcctgtttcgtcttgctggcaaggtaccatctgaaggcacaaggaaagaatcccatactttattttatttacaacaaaacaaaccttccccatctgcaacaaacctacactctacaaatgagaatgcaatagaacaattcaaagggaaaggaacaatactcgtgcactgagaaagccagcagaaggcactatcttaagtgtgccattctccctcaaggcagttacctgaggtctcagcatccaccccactctcttcggccaccttgaggaatatctggaaaatgagagagatgagaacattataagcaccaacattacgagagtagtcaccactgccacgattattatattactgagtggcatgttagccccgtaagacagagaaagtagaagccacatttcttaataacactttctcagagttacctgggagagaagccgtttttgccagagaacatttcctcagtggtgagagctatcaagctagacaatcattttcaaattaaagttatggctgagcgctgtggctcaggcctataatcccagcactttgggaggccgaggcgggcagatcacctgaggtctggagctcgagaccagcctgaccaacatggataaaacccatctctactaaaaatacaaaattagctgggcgtggtagcacatgcttgtaatctcagctacttgggaggctgaggcaggagaatcgcttgaacctgggaggtggaggttgcagtgagccaaaatcgcaccactgcactccagcttgggcaataagagcaaaactccagtctcatcaaaaataaaaaaaaatttaaaaaaagctatgacagacactgcgcagaagaaatttattctgaacctacagggaatgagtcaagtggcttctttcaggactgtggctctaaatctttgagtaggctagtactatgataagttatccaagacagaatgagcaggaggaaatagagcactagaaatatgatggcagcaattcaaacatcagaagagaatctgaatgagcgcaatcatttccaaactctagtctatagaccactgtgtccaaagtatgcaatagaaatacagacttcaaggcctcacctccagaaattctgattcacaggccctgaagccaaaccttagtatgtttatttttaataatatccccaggtgattctgctgcactgtcaagcttggagaccacttggccagacagcttttatatccccttcagccttcaaggtctgtgatgttgtatctctaaggggaggcattacatggataaagagaggatggactttgaagccccaaacccctgattctgaatctcatgtcagcattcctgagtgttcattttttcatctttttttgagaattaaatgaggtcacagtgattaaaaaaaaatcaaaaaacaaaaaacaaatctcagcacctggcacaagtagactatccatccataaacgtttgtcatttcctatgtatgagaatccagttgatacctggctgtgacacagtcacaccagagaattgctcctgattctgattcagtaggtctgagctgggcccaagttgctgaatttctaacaagttcccaagtgatcctgatgccgctgttcctcacactgtacttaagtaaagaggctcattaaagggtaaataagtgcataggagtttaaggttgggatgtaaatgtgttaggtaccactggtttcaacacacaaatctcaggcatgtactgtggtacagaggaaaacacttctttcctgctatctcccactaccatcttaaatggctcactggggccaacattaatcagatgtcgatgacctaaaaactcaatgactaactccatgataatcctgctcccaatgcaggctactggtctggccttaggacatttggccttgctatatattccgacagtcagccacttaacttacttcttccagggtcgtctctgagatgccataactagaaatgcccaggtctgagagccggtcatcaatctcatgaaagagttccacaaaggctccctccttagcagcttcatatggcagcacataggtcagctcatgccctatgtcttccaccagccgggcttcagacacatgcttcctgatgaggttggagatagcagagacatctgcagggaccagaatgcaaagatggctcaatcaactcagaggggcttcggagtgagggctggccatcccccaccctctcatcagaggcctgccgctcatacaccacacctgttccaggtgtttaggtcattccacatgttcatctctggtctgagggttgggggcaaaggaaaggactatgtcttattcacctttgtatcaccaaagccaggcacattataggtactcagtgtagaatgggtggacagctggatgggtggatgggtgaatgggaggatgggaggatggaaggatgggtgggtgggtgggtggatgggtgaatggataactgaggctcaaagtctggtgtctattgcctaagctctgggattcttcaaaagaaaacttgagtaaaggaatcttaaaagattcttcaccctttcctatgcttataaagtaggttccctcatttacctaaataaagggttaatctaacagtccatggaagcagaagccttcctgggaaaagccagccattaggactaggcagagatagcaagggtcaagacttctgttccacatatgctactggtgacactggcctcctacacacgctacccaagaaaaatctggaaggctgttcctcatctcctgggctctcactcttcttatgtactaagctcaaatcccaccctcctggcttggccctcagctcctcatccctggtattcagtgtccactcccctaagggattccccaaaccccaatcatctcagctctctgggacactgccctgctagctcccaaaccgagccccaggcaccccagcaagcattaggccaacccgccaccaagctgctcccacacccgcagccacccagccccagcccagcagcaaaccttgagtcagcgccaccagcctctgcacctctcctcctctgcctccactctgcccagctgggggaagctcaggcaccacctgaataagaaaccccagagtccttaccgatggtcagcgtgtcactctcatggtcgctgcccaggccagcatcagaactgctctgagaaacactgtcctcctgatggcaaagaaggaggtgagaacgggtcagggacggagcaaggcagagccaccagcaccttcgccggggagggcttccaagaagctctgttgtgtgagaactaaaggaaaaagctttccctgggacacatgcactggcagccgtggcttcagaggaccctgtctggcatgtgtgtgccgtgtgaacagcctcgcttcctgagggtgaaaggtcaggaagcagagctgccaaaagaactgtggcctgccaatgaatgctgcaatgaggcctttgccaaccatctcaggcaaggcctttacctggctacatgtctagttcaatgcttctcatgctttaatgtgtgttcaaccactcaagaaccttgttaaaatgcacagattctgattcggtaggtctgagctgggcccaggttgctgaatttctaacaagttcccaagtgatcctgatgctgctggtcctcagactgcacttgagttaagaggctcattaaaaggtaaataagtggataggagtttcaggttgggatgtaaatacattaggtaccactggcttcaacacacaaataaatctcaggcatgtactgcggtacagaggaaaacatacctggtaattgggtctggtcccaccactgttatttacctgctgggtgaccttgaatcagctaccaattccctacaagcctcacttccctcatctgggataataaatatagttaccttcttcccagggtctctctgcactttaattgagatgatagaggttaaaaaaaaaaaaaaggttgtaaatggtaacaacgctatataaaattaactattatcattactttctttcatgcccagagtgtctctggcatgaaatcagtgcctaataaatattggctgttttatagtttaaaagttaaggtcaatgagattgaaaagtaatgagcaggaacaccaggtcatttgtagccaaggctcttacctcttgacaagtctcttttctttgacataataatgtcctctaaggaccttctccatcactctctgtgcctcataggaaaaggaaaacgggattcaacagaactagcacaatgggagcagagggccccttagctttccatgccttaagtatgatatgatttcaaaggggcaacagagcagggagatggtggtttcaacatggcaaaaggggtggagatggagaaatcattcacagccagcaagtcctggctgcccagacccaacaccagcccagcaccaagactgcagctcacctttttcaggtatgacacagtgctactactgtttctgcaggaactgagggaggattccacatctttcttgaccaaggtcaggtagtagcctgttcccagctggttcttcagaaacagggaggagcccacacagcacagcttcccatgggagatgatggcaatcctgtcccccaggacgtccgcttcatccatgtggtgtgtagagagaataatggtgcggcctgccaggcacaaacacaaggatgtgggacaggtgaggcctctcagttctgatttgtcacagtgacagggactagagagatattagcaggggtaagcactggaagagacctggaagccacctttcaccctgtatggctatgacccctagaatggcaaagctttgtatatataggtaccacatcctcacagaggtaagaacagtagcattttatttgggaacttgctatatgccaggcattgtgctaggtggtttgtgtgcattctcatttaatttaatcctctatgaggtaagcaccactattattatcggcaaagaaggtgaggcaagttgtgactttcccaatgtctcagggccagccagagttggctccaagcctgcctgtgctcctcatactgtaccacatcagatctctaaccagagagcccaatcgtcttcctgcccctctccgcttccattcatttaagcatccaccctttcaactaaccataaatttagtgcaccatgttggggacaaaaagatgaataaagacacagcatctcctctcaggaatctcagtctcaatgccctttatctcttctgtgataacagaagagtatcccatggcttcacagaagcctagccatgagatacagccacacttctcaaaagccccccgctctctctcagtccatttactcagaataaatacacatcaggcaccttgtcggtatttcagcagcagctcccatattcccctgcgggagtaagggtccacaccagctgtgggttcatccagaatgacaaccttagatcccccgacaaaggccaaggccacagatagctttctctgcattccacctacaaaaaaacagagcaagacaaactccaggaccagccccagacagtgagtgaaggcagaggacctaggggcacagccagggacaagtttctgttaccaaccgcacccagcctgggaccctggggcagtgctgattttcctccgcatgtgtgtagccggaggaggaggggagagggatagggaaggtagctctgggccgcacctgacagctggcttgttttgcttttcagcttgcttgatggcaaaccaacatccagggccatctgctccatctccgccttcacgtgcttctcagagagccctttcaagcgggcatagaaccagatgtgttcttcgacagtcagcctggggacagggaggcaggtcagctctgggccctactggataccccagaatacagtgtcccctggcccagaacagatgagaatgggcatatttttctctccccgtgctttttaaaataactttatcaatttctgaaaaataatcttcaagattcaaggtagaacaacagtgagcaaccacatgagctgctcaggaaatcaaagtgaaaggtgacagatcgcttccaacctgtttccagcaggcctggccaccatgcaccaggcagttacaactttcaatttcagggccccaagatgtggtctttaatgggctgtccccacagcacgtccaccaagaagtcagctcggcactcacctggagcagccttcctgagcctcaggggacctcaggctctgaaagcggggaggaccctgcacatgagccccatgtgttcactttagatgaggagggagcacatgagccccagctgttcactttagataagaagaaacataagggaaaagccttgcccaagattgcagagctcaggtctctctctgctccatcacacgggctccctgggggccttatggctgatgggacaacctgagtgggagcaaatgtcttaagcagcaaatataggtccatcataccagggccctgaagcactaccaggtctgggaagtctgctccaggcctcaataaggagggtggcgggggagaggatgggctaaagggccctccagcatgacaataatgggaagcaatgtttcccaagcccccatccactggctgggctgatgtcacctctacagctcaaccattcacctcccacttctcctaaaatcaaagaacaactaggtctcaaggtgttcacggaggtgagcctgccatattcaaagaaagtaaaatgtggccagacacagtggctcatgcctgtgttcccagcactttgggagaccgaggtgggcggatcacgaggtcaagacattgagaccatcctggccaacatggtgaaaccccgtctctactaaaaacacaaaaattagctgggcatggtggtgtgtgcctagagtcccagctactcgggaggctgaggcaggagaatcgcttgaacctgggaggccaaggttgcagtgagccgagatcgcgccactacagtccagcctggctacagagcgagactccatctcaaaaaaataaaaaagaaaaaaagaaaaaacaaaaacacagcaaagtaaaatgcttaagtcccactcctcccatgatggcatgacacacacacatccagaaaaggcctattcttaacgtgctgctggtactcacatgtcaaacagcacgttatgctggggacagacccccaggttctgccggatggtgctcatctcagagcgaatgtcttttcccaggatgtaggcggtgcccgaggtcggggggaacaacccggtcaggattgacctgaggacaaaaatttagaagtacagaagtcagggttgacctacccttaactctagatgctccattcagtctgcagagagaacagaacaccaaccctcccaccgcccccattcctttctaatgaaccctaccagacccacacaaagcaaagctgtccttttgcttcggtaaataactacaagtgggcctatgggttagaaatgccaattttagtatgagcattttttaaacgaagtttccaatctgcaatgaaagtattctttaaaaaatgtattttgtatgcctaacatcgcatgcatggaaaatggacaaacaagaacatattattcaaagataaaaacaatttttgtgttaggtagtaggatttctgactgccttttaaaaatcttctgaaaagctcataatatattaattctatgttttaaaaaaagattaaaaagaaaacaggaaaagaatgtcaccccccaaagatataccctttggaatggttagaatggttgaggaatcgtgctggaagccactgaggctaacgctggtgctttacagcccctgacccctcctgatactacccactgtaaggtccttgaggtcgcagggaaggcaatcaagccagctgcccagcttgattgcgtctcacaggtgcttctcacatctgcttagagacagagttcctgggaattaccaactccctccaacatatgtaatctatcttttcgtggctgcaggttccaagaccactgcagaattctgtgaactacatgggaaaggtcatctgaggccccagcttgttttaggctgaagaaataacatctagcaaactagcacgtggaaagacactcatgattagataacatgttcacattcggcaactcctcatgtgctccttcccttggcccagggatcagcatggtttcctaaggtataaatttctaactctactgcagaaccctcctgtggctgattctgcgggaaccacaccctcttcttacatggtggtcgtcttccccgctccattgtggcccaggaaggaggtgatctggccctcataaaaattcagtgccaggccatcgacagccaccttcatcccatctcggtagacttttaccaggttctgaatggacacgcccagcttcaagtgggtgggttcctcctccatgcagactgtgacaggagagaagacagaaatgaacccacagaaagcactgaggagtggagtgtaaggacacagggcactgcgcttgaactttcagaagtgccttctctccatgtccaccctggtttctcaggcaggcaggaggctataaatgtttatttagggcctatttgggtactgatgttggtgatgggaatacgatgataaaggagcattcagagtctattgggaaaaaggacttgatgaacaattaaaatagaggatgctgaaagctgtttaaaaaatacatctaaaaatgccatggaactgtgatacacccctcccagggaacactactcagcagtgaagaggaatgaactgttgacacacacaacttggatagatctaagggaatactgctgagtgaaaaaaaaaaaaagccagtatcaaaaggatacctactgtatggttccatttatgtaacattctagaaataataaaactgtaaaaacgaggaacgcattagtggttgacaggtgtcaggaactgaggaagaagggaggtggctgtggccattaaggggtagcatgaaggagctttgtgacaatgagatatttctgcagcttgactgagctagtaattacatgaattcacacatgataaaattgcatagaactaaatacgcacacacacacacaaatgagcgcacataaagctagtgaaatctgaagaaggtttgtgaattgtacctatgtcaatttcatggttttgatactattctacagttacacatgctgctaccattggggaaactggatgaaaggtttaagggaaccccctcatgtaatttgtattacttcttgtgagtctgtaattgttttaaaataaaaagattttctttcacgtgccatggaagttcagggcagagagtgactgactacctgagaaccaaggagggatgctcaggggaggggatccggaactagatcttggagagaaaggaggagttgagaagataggcaagttagagagaaagttctcctgtgagagcaaacagtacctacaaaggcatggaggtgtggaagaacatgacatattccagcgactgtgagcatttctaggtgactgaaacaggagctaggtgtaaagaggaggtaggagaagatgattaggaacagcaggcaagcgtgctacactaaggggcatcatacttttaccaagggcaatcaggggatgggcacagaagagactggcagaaaagggacctattaaatatttaggaagccactctaagcacaaagaacccagaaggcagagcctttgatgagctgtggacatctctgtctgcagttaagagccaagagaggattagggatctgggtaatgattacattatgaagcataggctgagctctgtggtagccacttggtctcagcccacacaggctgatacacaggtcaccatgtcacaggcaggcagcgaggctatggttccacaatcacgcttgtctttacctctttcttctagcttgttaggagaccatgaaatgtgtgtttgggagggggcaagtaaaagatactcttctagaagccaagacaacaaagaaaatgtccctcagggatcgagaccgtgaactcccaataggtcaacagcattggacataaatggcatgggaggatttggaaagggacactgcatgtgatttctctgcccctggagtggtttcacagtcttttagaaaggcaggagacatcgcttgcccccaacagttagcagaggcagcagcactaggttaaagaaagagcaggaggtcaacagcacttactttctgatattctcttctggttggaaccagggtggctcttctcatcactttcctcgccaaaccagtaggacttggtgcaaggaaaataccagggcctgggaattccgtactggcctgaaagcaaagcacaggtatgagccaagctcagcatcatcccagtattctgagggtttcccagccaggtccatttcctccttgacacatcctttggagaaggaacagatttgaatggatgtggggaaagagggagctaacatttgctgaaacctgctatgtacaacgtacattctgcacctctgtaagtccttccaacaacccacggggcaggtgccatccccattttagagatgaggaaactgagggataaggagcctatccaaggtccctcagccagtaagttaagactcagaatttaaatccagaatctgcatgctgcaaaattgcatattcaatgaaagaagttcaggcaggagtaataaatatttcatgtatacctccttaggggaggatcagaaggtgaaccaaaaagggttaaatcttgctctctcagaatttgatctcatatgaaaactgtccaacgcaggttcctcttggacttggtcaagaagatgtattatattaagaaagaagtactaaagaaaaattcaacatgaatttttattgaatgctaattaaatcacaggcaggccttagagctagtatatttaattattaacaacctgtactcaggaaacagaacctctcctagttgtaccccctctgaggacacagaaatacagaattgggtgagcattgggaggattcgcctgggcttattgacccagtgtaaccgaagtggattcacctccacgtaccaacatttaacagttgtgtgaccaaagctggttacttaacgtctttgagtcacagttctctcatttgaaaattgctggttattatagtaactacttcagagtagccttgtgagaattaaatgaagcaatgtgtataaaacattttgcatgctgcctggcacacagttttcaagaaacaagtgctgtacaagtagtgacaattgtactttcagcatcagctgcctgtccttggactatctgtttactatagatctatagcccaaaccacttcccagggaagcccatgcactgcagagattctagcacaaagaaaggacatcagctagaagtcatattttccaaacagatgcccaaagcagtgtacctggaaagacagcctcaatgtaccaggtcatcaccccatagaggaaggtgtcaaacagcatcatggagaccgaagtggtgagattgaagccatcttcctccacaggactctcaaacaggttgtcccactgcactccaatgccctgctcctcaaaaagggcaaagtactcacagccaaacccaaaagccacaggagacagcaggctctgtgagaaacaggcaaagtcacctatccatttcctggtcagtctcatttttctatctcttctagtgtaaattatacctggagaaatttgaatttgcaaaatggatcaatcataaggtgcagaagtagtatttacctatagagtccctttaggggagtggtgggctaccaagtaacatataaaatgattccatttgtaaccactcattatatacaaacatttcagaaatgcatatacagtgaagcataaaacttttaaaactttatgtttccaaagatgccccaaggctcagcaatcctgttcccccacacacatgcgcatacccacagtcttctgaggctccctgctcagccaaggatggctcaggatcagaggtgcctgtttggggctgctgatgcctatgaagcccagactgaggcaacaggagcatcctatgagtcactcttagctttcctgataagtgacctggggacatctgacaacttgcacttgtaggggctcacacactctccaagatatccccctgctctgtacgagggaaggaagtgtccaagtcaggaatttgtgggatgaggcacctgctcctcagttgtgcttagttcagaaaacattactcaagcaaaacaccatactggacacaaggaagacaagagaggtcatctctgacatcaagagttttcagttctatttgtggccttggctttgtcatgagcttaacatagccaacagagctgggagataaagggcagagatggcatctgttgcctgaagccattcctcaatgccatttatccccagcccagttcaagatgcagtctggctctcggaaaaattccattcaattcaattcaaccaggattcactgagaagactaaaggtaaacaatttaataaaacacaatgcttgcccttacccttaaagagcttagaatctagagctaaggttcatgtcccattggaaaagacaatcatcttctgttctcaacttgctgcttttattcagggactccaaaggaaggtcaaatgcctacagccactgaagaaaggccagaggtactcacagcgaagatcttgagtgtgaagcccacgtagtcctgccatgccacacacaggacgtagggcaggtacagcgtgaagtagatgatgcccccacaggctgctgccaggttggctctggagaagagtgtgctaatcaggaagcactgcaggattgtcaccacagcaaacacggacaggaagacaaacaccacgctgggatcactgtagggcagcaggtttcctaactgggaaggaagagacacatcaaatgtgctgcctcaacaatcccaagcactcacttgtatgatctacagaaaaaagacagggtttattcctactcatgttagagacaatgcagaggcgtaatgctgttcatctttctgatgaggcaactgatcattaccatcctaaagaagataagtgacttacccaaaactacgcagaaaaataatggcagagttatgaatacaacagagtccagggctttctacgcatttcagtgggcgagtttgctctttgtttcttcaataggtaatttcaactggtttctccttatataaggactatgactggtggcaccacagaagagctgtgggagataatatcccacgtaacttttctgtctaaaagccaaggaaaatggccaggcaacttgactttccctcttgatcaccatggattctgcattcccacaatcatccaaactcttgtggatattttgagcctatctccggctgatgggtacatgtctgcaggacccaccagcatgcagttgtctcagagcagctcttatgcaccaaccatgggaccactacctctgccactgaccttccccttgcagttagataacagagcatgagggaggggttgcttttagcaagaactgtatcctactgtggaacctcaataaagtccttgaccttcctgagcctcatttccttgtctgttaaaagggttagtgaggatagaagaagaagcccatgtgatgtgtttaaacagtccttggcaatcagtaggaactatttgtaacagatggtaactagtattaaattagttagttcttatctctttgtactccttttgcttcaaaaacatttatttttacctgatgtgtctttatatgaaatgcttgcagagaaagaaaattcggatataaatatattaatgtatggttcagacacaaaactgcactgcccagagtccccattcagggaagccttgttgcccagctgtcagtagacggcctcaggcatcagcaactctgggtttgtcacagcagcagagagccatgtaggccctggggcacgaccttcccagggcagcccacatccagtgattgattgagagggctgaggtaggtggtgtcaggagggaggccttgggggagcacaaagggctggatgtttcagctcgatgaagaacaactccaacaagctgcatattctctagagtgccccacggggttggccctatatcacagttcaactcctccctctgcccaatcctgcatcttccatatctcttccataggtattgagccctcataaatacccatacatcaaactctatttcagcctctgcttccagacagtctaacctgcaacaatatatatccttctgattattgttcttagaaacttaggaagaatcgccacccaatatatctaagaaaataaatagctttcagatgctgccatgaaccactaccaatgagacagcatggcacagttgagcatgtggttatctggaaagcatgaaccctgcactctcatcctacttagctgctacccggctgggttgaccttgggcaagtcactgcccctctctgggcctcactttccccaactataaatggatgaaattgcaggaaatgacaggtatgaccccttctctaccagaggcttggattttttttcttcttctcctcccttagcccgtgttgagctatttcggagtttcctggcagggaagagcgagtgaggctgccttaccttcaggatgaccactagcaggccagcgctcacaagaagaggaatgaggctactaatgaaccagctaaaccagaggatgctgttgtccaggcccatgatccgcatggtctctttcagccgtgcctccttctcatacacgatgcccttgatgatcacagccactgagtaaatccaggccagcgtcatgaagaggggcattgaccggctcatcacccgcagaaagctggaggccccaaggaaggacaaggggagaaagaaagacacacgtgagccagggtgatgggccaaggcctctgagcctgcatgctagagggagcaccacatctgggccacagaaggacaggccctctagactctgaaatgtacgtatgatccaatgcttcacgagcaatgcaatgtagagagaaaaacgaggctaacaaagtgttgccaaaccaaatttctttgggggcttgcttcagtaactaggtaactgtgagcgatacttaaactaaaggtagattatgttaaagtactaaaaaccaaaacaaaaaaacaactcattctctcacaaaagttcaacatctccaaggtcatctcactattgacttgcttatcgtaactctaatcacaccacagacatacatttcaggcagctcttgtcaatgtttcagattccaagctagaatagaaaatgcagatgtgcaaagtaaaaaggcacacagattttggaccctgaacttgaggttcacgtcaaagctttaccatgtaggcacatactcactacatgacaacaggcaccagctcttaatgcctctgaactcctgtgccctgtcttaagacatcctttctagagtaaaccttagcttaggggtctttgtaaaagtcttcctttgaaaaattccagctaattgtttagaaggtgaaaaacaggataatttctggtgaccttgaaaagctatagatagccatacaaggaaacacactattcaatgcaaaacagagaaccaatacaagcagaacccagctcctcccgcatcctgatccctacacacacacacacacacacacacacacacacacacacatcccaccaccaccaccaaccacagagaataagagaatttccagaatctggaagaaacattacatatttcagatgtctgcaataactacacctccgcccattgtcttagaagaaatcattacatccaaaggcatagttcccacaatgagaacttggcagcttagtgactcagcactgaaagattttctaaaaagtctaagaggaagaagctttgttcagttttatttgggttgttttgaaatgtggtttaccacctagggagaagaagtgcacacatttacataaactgtgcttttataagtttagacgctgtttctgcatctatgtgtgagtatgtgcttgcatgtgtttgtcatgacacattttaagcttgcagattgagcaaattttgaccaaaagggtagagtgtaaaaaattaaagtggtgggctgggtgcagtggctcacacctgtaatcccagcactttgggaggccaaggagggtggattgcctgagctcaggagttgaagtctagcctgggtaacatggtgaaacctcgtctctactaaaatacaaaaagtcagccgggcgtggcagcatgagcctgtagtcccagctactgtggaggctgaggcaggagaatagcttgaacccgggaggcaaaggttgcagtgagccgagatcgagccactgcactccagcctgggcgtcagagcgagactccatctcaaaaaaaaaaataaaaataaaaagataaaagtggcaaccatggatgagaaggaaagaggtttactagtgtgtgcacatatatctatgtctgtcatgtggctgcaactgttgacaacttacatctggcatcttatttccagatcattcacacatgcatgcacatgcacacacatatatacacccccatctggcacagtataaactggttaaaaacagtggcttgcaggtaacttacatgtcatcaacgtaacagggatagggcatctgttgcatatagacaccagttttcttctcggtgcccgtcagcaccctgatgattgcctgctccaccacatcctgcaagtaggcgaagcccccccagacgtaccgcatgtcctcaaaggggtcagctcgaggaccagggtcccagtacctaaaaccaaaccacaggtaatcaaccattcctttagaaccatacaataaaaaaaaaaaaaaaaaaaaattgcccaaaaccctactacccttaccaagcccctttttctatttttgtatctttttttttttttgagatggagtttcactcttattgcccaggcgggagtgcaatgatgcgatcttagctcactgcaacctctgcctcctgggttcaagcaattctcctgcctcagcctcccgagtagctgggattacaggtgcctgccaccaaaattcctggaattaattcccttgagtagaaatgctaaatcaaaagatactgttattttatgacctatgaaaaaccttccagcaagtcatgtaccaatttcaccaaaatcatgacaccaagttgagtttttttgttgttgttgaaatttctaccaaatttttagttaaaataaagtacctcttgtcctaatataataggtgctctggacctccccaagaccaggctggtgtgatgggattccacttacccatccttgattttatttgtcctctccacattgtcaatgtccattcggatcttgtacttgacatgatggggcagctcaatgctgcctggagtaattccagtgaacacaataccagcccagaacttcctctcatccagcagctccatggacttgttgatgagccagacttctgttgctatgggttctagcttgttcaggttgacacactgatagaagaacagccttcatgagaacgttggcagccaggacaacaagcagtggctgagacaaatcctacactaggaggcaagggctgactacacgattgctcatcctctctctctaatcctctctaacgtagttttccaaccttcaaccaagaatgaaggattttggtttttcactgcaatttaagagaaattctaagagtaatttagggatatgttatttattgattttgtggaggaaaagaggttaaaacaatgatcttatcttacttttctgttttcttagcaattctgagtcatagcaactaaccaaccaaccagaccaaaacacctcttacccatccctactaatataatttttaatataaaatttcaaaaatttaattggacccgaattcgattttagataagtttcacaaataatgcctttttaagggaatgctttgctaccattagtcactgagataggaaaacctagaagaaaatgggtagaaatattctcttgagcctatatagaataagctagagttaatttactaaagctagagtttatttactcattcaaccactcaactaacatttattaagtgccttttgttatcaaatcctgtgttaggcttgagggatagttttgtaaatgagactatacattatttctaaacttgcctcctgcctgaaccttattgtaacgtctcagagaaagaagccgttaagtcttttctaaatgatcccagcaacagattcacctccatgaagcgagatatggtccggattgcctggttagtctcgttgaaagcttctctccaggtgtacacagaaccattactggactggacatcctctgggtgcttggccaaaaacgccacgatgtcttgggctgtccaatctaagccatccaactgctgttcccaaaagtggtcattgtccctgctgtccaacagcatctgccattccagtgagaaagtacaagtagtaaacaccaactaaatcttgaggagcactacaaaatttacaaaatacttgcatatacactgtcgttgttttatcctcacagaaaactgaggtaaatgacagtgtccctattttatatgtgagaagactgaggctgaagaaaaaaaaacatgattttaaccagggcttggtcatagtattactagatgtggagctgagactcaaagtcagaccagtctgaattcagagtccatgtgctttccactatacgaaacatctcacttaatggtattaactacagtaacaacaacaatacttcctttatatagttactatgttgaatagtgtatatgcttcaccttacacaactccataaagagggcacttttatttttttgccttttgttgttgttgtcgtttggattcagtgtctcgctctgccgcccgggctggagtgcagtgatggaatcacagctcaccgcagccttgacctcccaagcccaagtgatcctcccatctcagcctaccaagtagctaagactacaggtgcacaccaccacacctggctaatttttaattttttcatagagacagagtcttgccatgttgcctgggctggtcttgaacacctgggctcaagtgatcctcccacctcaacctccccaagtgctgggattacaggcacaagccaccagcccagtgagtatcctttaatatttcccattttatacatgagaaaatggaagttcagagaggttaagtctctaagattgggtcacacagctattaagtagcaaagccagaatgaaagcataggccctctgtttctagtgcacctccccctccccactgtgttctatcaccttcctcttttgagacccagtctgttgatcccacataaaacctaattccttcttactgcttagtttagaaaaataatgctgctggttaaaccaactaaagtacaatcttttccaattgcaggatgtacaggtcatgatgcaaaggaggcctatttccatttcttgttcccttgccagttggttcctcacatgggtcaacacgaaagagaaggacagatcaatccgctgctcaatcagcagatccagaggggccgaggcagaggcctgcacagatgtgctgccggaaaaacagcagctgcaaactcagcaaaaaggagaggcatttgcaactcctgtcacagcttcgacagagaagatgaagctctggttctaccgaattggagtctccaagggtctgaaaactgctgctttataaaaaaatcagtcttagtttcactaacattataagcttttccccccttgcgcctttgtatttattatttcaatggcagcataatgattgtatagagtatatgtaatttcattaattattcctatagtgctgaacatttagtctatttccaatttctcacaataacaatatagcaataacattttctctcatatggtgacttctttaaaattatttcagtaggctacatccctgggggtgggtggaatggaggtacgcaggatagcatattttaaaatggttctttaaattttcattccaaattgctttccaatagagaatagcaatttataccatcaccaggaaggtatgtatgtatttttgttaacataacagacacaaaattgtacctcacaagttcacagaggctagggttagcaattctgaagccactttatttggaacaaacaaaagcagagtgaagagacgcagcctttagggtgaagtcggccctgcccagtatggtttctgaacaacatggccaaaaagaatagcaagactagaaagatgcgcccactgagatcactgagcacgtggcctctctggggtgctcgtgaggggcaggagacctaagactgcccgcaggggtggaggcagagagaaaacaggtcccgaggatgggtggctaaaagcagctcagaaaagagagcaaatcagtgtcagagggttccaagacttgcccgagagaggtgccctgggacctgtggggtgaggcaacatgggtagacagtgccagagaaagcagaaagatcagagctaccccagcagaagcagaagcctcagccatcacctcgtgtaggagatgccaggctacagggggtgacaagctcatgtttgtggaattaaataaacactctttaagagagggaagaaaggccgggcgcggtggctcatgcctgtaatcccaacactttgggaggctgaggcaggtggatcacttgaggtcaggagttcattccagcccgaccaacatggtgaaatcccatctccactgaaaatacaaaaattagccgggcacagtgatatgtgcctgtaatcccagctactctggaggctgagacaggagaattgcttgaacccaggaggcggaggctgtggtgagccaagatcatgccactgcatttcagcctgggtgacagagcaagactctgtccaaaaaaaaaaaaaaagagaaagagagggaagaagcaaagaaaacagttggaagaggttcccttttcttccacccacaggctgatgactccctcatcatctgtctccagcccaaccaccctcctccactgcagacctcagtagccactggcctactggacatcgctaccacccacccagctagaaatcgagactcactttgatgcctccctctctttcactgctctgccactaagcagtcaccaggcctcatttcttgctttatgccttggccacttggagagcctcctccctggtctctgccttcattcttgcctcatccttcttcaattcatccaccccatcagagtaacgtatctacatctccccttgcctggtcccctagagcttaaagtaaaggtcctcagcttgacacacaagtccctccaaggcatgcccatgcctttctctccagccccagatccctcatttccaagcatacacactggattttcccagctagattcctaatgaatgccattgccatgtttacaaggatcttgtcctttaagaactgggagcttatgaagaattgaagcacctaaggcaaagtcaatttcagactagggaaccatctacttgcccacaaatcaaaattcactgagtcacttcacagggcctcctataatcctctgagagccagacaaacagaaaaagtccaactagtagaaatatggattccaaggagaggaccaggaagaacaggtctgaaaccacacttaggtctacggggctagatcatataaccctcctttagagaagagaccccactttaatggcatgagctatattagtcagtgtgaatccatacaaatcactgtttatgcttttctcagtataaactcctttgtttttaaagggacttcctcagtaacctgcctcccagcggatcagggaatagtcctaaacttcggaagtgttccccctaggtaggtacagtctctaaaacccagccgcccttaaagtcaataaggttcaaaacaagaaacctggcaaaatcctcacctgcttcttaaggggagcagagacaaaaggaagaggcctccctcaccatggaaacaggaaatagtctaatgattctctaactcagcccaaggcaggaagatgtgattaacagcactcaggctcaggcaaaggagacattctgttcttgctcagcctgctccacatttgaacccaattgtctctagagcacttatccctttcaagtggctctgaagcactaagtgcatttcccctccacacagtaacagcagctcatcattcacacagtgccctgagaatgagtatctcaggccagtctacatgtaacatcatgcttttgctcccacacttctttccaaaacctaccaagacacagggagatgctgtggctggctgagaggctgcagccaaaaaggaaaatagggtactgcaattactcaactccacttccaaacaccagccctcactaagttttgcagaaaactgctatttgaccgtgagtggcatggatgctgatatgcacagcgttatctctgcaccatggcctgtacttctggagaggtggtgccctgtgactttagctatgctcactacattcccccagctagataaactgaaagaattctcacctcactcacacctgggaaagtgaccagaaactcacctctccagtatcaagcaggcacatggtaataatgggagggacactcacccggacaaggtccatttcttggctgttctccatgaaggtccagatcttggggctgagttcctcccacatgccttccagatcatggaacacagccagttcctggaaggtcttgttcacctggagtcaggtggggagccagggaccgcagaaaaaggaggagaagcacagacaatgagcgtttggctcctccctgaaaagataccccatcacagcagccctgtgccagtcctccccatccccaagaaatgcctgcttgtaactatgattctatacccacgactggggagctggcccagctctggtctgcatcagacttgaggttttcactctgggaattccagaagagccgtgagtatacttagcgcacacctctgaagctaccttgagttttttgcccccagttctggggagattctggggagggagtcttgggctgggggcagcttacctcagccatgacctgccttgtggctggagtgtcaggtgtatacaggatcttcccaacgagcagcggcttcagagctttccagataatgcgggaaagaggactagactccaaattcttcatcaaatcattgcagtaaggagctatgaagaagaggagagacaaatgctcatatgcatggtcatatactgatagaaacttacaagggctttggagccagagagttcttagttgaaaccccagctctaccactactagtcatataataagtaacttatctgagcctcagttggctcctctgtaaaagtaaaattcataacatctatgtggagagatgtggagaagattatctcagattaaactgagatatctataaagaatgatgcttgataaataatcagagcttattataacgtcaatgacggataactcacgactgagctgatctggaaaaatgttttcatgaagcacaagccctcccatccagattcacactctcatgccagcctcaccattgttttcactgacaactaacatgaccaacatttaaactgactcttgaggggcaaccagaaggctgaattcagacctcagttttcaagcaaaaaccaaaatttggggctgggcgcagtggctcatgcctgcaatcccagcactttgggaggccaaggcgggcgaaccacctgaggttgggagttcgagaccagcctgaccaacatggagaaaccctgtctctactaaaaatacaaaattagctgggcgtggtgacgcatgaggctgaggcaggagaatcgcttgaacccaggaggcagaggttgcagtgagccgagattgtgtcactgcactctagcccgggcaacaagagcgaaactctgtctcccaaaaaaaaaaaaaaaaattctcaacagggcgcagtggttcacgcctgtaatcccagcactttgggaggccgagacaggcggatcacgaggtcaggagatcgagaccatcctggctaacacagtgaaaccccgtctctactcaaaatacaaaaaaaaaaaaaattagctgggcatggtggcgggcacctgcagttccagctactcaggaggctgaggcaggagaatggcgtgaacccgggaggcggagcttgcagtgagccgagatggcgccactgcactccagcctgggcaacggagcgagactccctctcaaaaaaaaaaaaaaaaattctctttaattaacacaaactagtatatgtacacttaacaaaaacccaaatacaaaagttgtaacagacaaatgggtttggttatccagcaggatccctgatttttaaaaattcattctaagtttttcagggatttttagataccaagtatcttctatatgctggaaagataatagaatttttttttttttaatgaggatgccctcacaattaagtctgtcatggaaatgaaggcttccttgggtcaacttgcaagctgggggagaggaggagatgggatttaattaaagttgcctacaataccatccttttaaggcttgtaaagcaacttgcgaatgtctggagtgctttactccagagaagaaaaggttcttgtgttacaataaagtacaaaacctgcctcactcagtgtctgaaagacacacctgtggttggaaatggagaaaggttcccctgcatcaagttttcaaggaaaaggatgccactgcctaaaactgtgacattggatccctgctgccacgaggcatacggcacacgggcccacaaaagtgcttaagtgtggggagtggatatggagacacagggttctttaacactgccttgcagctaagaatgggaaacaaagggcagatcaaatgtctgagtgtgagaacacacacgccaccactaacagttatcttagagagcacagatccaggcagatttgggcttgaatcctggctcttgtggattaactctgatgtggctctaaccaaggcacttaacctctctgagcctatgaaatgtggggttaaagaatcttccctgcagggttatcatgagggtaaaatgagataacttaaacagaatgcacagtgcacaagaaattctacttaaatgttagttctttgttgttgttgttgttgctattatcattactgttatttctttttatgttattataaagcttatctcaatggtaatattaagaccagtacatcatcctttttaaaaatgcttttctagcttttttgagttacaactgacaaataaaaattgtatatatttaaggtatacaatgtgatgttttaatatatgtatactttgtaaaaggatcaccacaatcaagctgttaataaatccatcacctcatagttgccttttttgtgtagtgtgaacacttcggatctactctcttagcaaatttcaagtatactatacagtgttactaactatagtcatcacgatgtacatcaagatcccaggaacttattcatcatgtgaaactgacactttctaccttacatatattccatatataagtgagatcttgcaggatttgtccttctgccattatctcattcttgatcaccctggaagccacccttccacatcccccagaaaaccagaaggttggctgtcaatcattcattccattgataaacactactgtgcacctgagatgtgccaggctgcattcagagaactggggacaggtagctattcaagagaagcctctctcctctaggaagagctcagtctggtgggcaaatgggcatgtagacatctaacgctgctacagagggaggagatgacacaggccaaggccagaactaagggagggatggggttggggacagggctggggtctgcatggacactcacttgtagagttgtcatagaaggtttcagcatcttcctcagtgccattgcctccaaagagggctttgtagttgttgtcctcataccagttgagagacttgatcttcagcccccctccctcgggatgcccgcagacaatacgagacacagcctggtagatttgggtggaggagctggagctgttcacattggtcagaaacatcacctcctgtcgcatgtcactccagcttctcatgctgaacagctggcgtcagggatggggacagaaaggagggtaggggaagggagaaaagggcagtgcaagggttggggatgagaagagaaagaaacatcttattttcttgacctctcaaaagccatgtcccagaacatattttgtctgatgtcatctcaaagccttgggatgagcttgccagaacctggctacccaatctgtggtccagggacgagcagcatcagcattactggagacattgttggaaatgcggattctgagacccctctgccgacctgcagaattcaaatctacagcttcacaagatgcccaggtgattcctatgctcactaaagtttgagaagcacagcctggagttagtgaagcccctggggctgggcttcgtttcaccgggattatcttccagtttatagataaaagaatgctttctctgaacagctacatctcattgtggttgagcctatcaggaactgctctcatcctcgataactgactcatttctaaaactccccgaactctagtgtagaaattgaacagccctcttccgccttgggagaaaaggtactgtatgtgaagttccctatcttggtctcagtaaagtgtcaggcaatgaaaaagcattaagatgaaaaactcgagtctgggccgggtgcagtggctcacacctgtaatcccagtactttgggaggtcgaggcgggtggatcacctgaggtcaggagttcaagaccagcctggccaacatggtgaaaccccatctctactaaaaaaatacaaaaatgttggccaggcatggtggcaggtgcctgtaatcccagctactggggaggctgaggcaggagaattgcttgaacccgggaggcagaggttgcagtgagccaagcaccactgcaatccagcctgggcgacaaaagcaagactcagtcttaaaaaaaaaagaaaaagaaaaagaaaaagaaaaactcaagtctgaaccctagctatgtccctcgtcagcttacagcctttgaaaagtcacgtcatgtctctgagtactcaacttctccatgcttcacggagctcgctgagacacaacttggcttggttttggtaaccctggggggcagtagatgcttataccatggcctggacactgccctctactcatcatcaagacagcaaagctacaacagtgtgtggtgaggcacaaatcctatgccacacaagagggtgccctgcatagaacagtcccaacagcgtgagtcagaaaccctaggcagtgtctgtgactgccactcaacaggcatcaatgacccaggcagcgttctgtcttacatgcaaatgtattccggcactttgtggagttctcagccccaatgctattatgaaatatttatagagtactttgtatttccaaacatttcacaagaaatcattaataaatccctgtattcctggaaatgtcactgcgtgttcacaccgcctgggaagactgagctatagagcacagaggggaggggaagggccacgaggccctgcacccagcctggaaagctccatatgcctagctttcaacctcacagcctgctggttcctgtgagtggcgtggtccagcactctctaggtcctaagctttgccttctgcctccagaagggaactaggctctccagaggtgggtcagaggccacaaggattttttttctccagagagggggcatctagcacactccacaagaacacaattaggtgaggtggacagcttttcccaactttttcttttcataacctgtacgaggcatacagacagaaaggggacagagaaccaggccattttgccttttgttgcttattggaacagccctagagatttttaaataacagtgagtcaaaacactcacttctctttccacaggcagcctcaccaccaacccaccactccccaatcaaaaaaaaaaatttcttcccacataaagccagcaaatctttctaaagaagcaccataaattattgagttattccaaactattgactcttcccagcacccgtttcaggggtaaactcttactctttctcctacacctcagctcacactccaaactttatctgggaagtgcttcctgactctcagggagggatggctcttcatcctttagcccacggatgatggtggtatttgaacatcatcggttgagtgaatgaatgaaactgacttactgctttctcaatccagcacaatgtcctttgtcctccctttcccccatcccagtctcttctcaacccaacaaccagagtgtaaacagtctaaactctagatcacatcatgtcccctccctcaagccctccgctggattctcatctcacccagcaggaatccaaagtcttgccaggcctgtatggcactcacctcctcctgctctgagctcctctcctccccccaccacttgctcactttccctggtccttaaacacattccttaggcatgctctagcatcaatgtctttgtatctgccattcttcctgttcggagtttccttccctcaccacagacatgctatcatctccttcaggtccaactgtcaccttagagagagctttcctaatcaccccctttaaaaaaagcaccttctcatgctctatgccccttaccctgctttttcttcactgcatatatccctcctgtggcattgtacactgacctgtttgtttctgtctctcaccctatacgtgccccaagaaagcagagaagttagcgtgttcactgctgagtcctcaacacctagcaatgccaggcagctggtcggtgctgggtggacatctgagatgctgcctccctgtcctcccttcccatcacccagatgtgaaactcaggtcagctttcattcatcttattcctcaagtcctcatttcctcccaatttccaggttctgctagtgcgtattttctttcttggaaggttctcctttctattccagtcgctactggagtttttcacgaagcaggcaacaacacaggctttggaatccaacagttctgggtttgaatcccagttttgtcaattaactcattgggtgactggaaaagttgcctaacctttctgagccttggtgccatctgcaaaatggacatgatgagacccactcaggtttgtcatgtggagcatacagggaaatgggtgacactgtctgaacctaggcagcttctcagaagacattcactccctttttcttttcctttcaagggttgtgctttggtcaaaattatcaactttccacacgctgactggacaaacaagtgcatttattgatcttctcccatttatctcacagaaatagcaagtcagacaatgagtaacttttgatcaaagggatctggaggtgttctattgaaagaggcagatggtccttgcttgtcctggaccaggagcaagcagggcacaagaaacagctgccaagaaaaacgtatattgttcacttggagagtttccaccacatcagcaatgggaacatcacctgcttccaatttttttttttaatgccagaaaaaaaaaaaaaaccagggccagtgatgtaagtgaaaacagctgtaaccaaaccctgagtttagaggcagcctcccctgttacagaccctgctttgctttctctaaggccagaaatgaacaagggacagagggctgcgaggggatctgcagagcaatgcaaggcatgtcaatgtcagctaacagggccctagagaaatagctacggacttgcaaaacagtttctctttctcattctccccctggaagaaccccagttggtccagcttctctacctagtaaaaaaggttaccagccttcataaccagggtaacaaatggcaagctgaaagaaggcttctcctctggaaaaggaacccaaaagtcagacctcatcagtcagaaacacgtgagcagaattcaaagaaagaaagtagaacaggacaggaagaaatacactaacgtatcaatagtgtttgatctcagcatttttgtattttccaagtcttcagcattttccacaatgaacatgcaatactttcattgttagaaaacataaagttcgtttttgatatttgaaaaaatgatgcaagcaccaaaaaatgggtaggttagatacaagcaccaaaaaaagaaaaacggattagagaagcagctaaaaataagggtggaccaagtctgagacaatttccccacaaattattattttccaatatcctacacgttaaagtctgtattgtttgtgagcactgccccctggctcagcttcctatgctgggggacaccagacagttcctcgcttccaagcctaatttgagacaaggctgggagtcagaaaggtggagtgtgcactggctgggagtcagagctaactgcttttgcaagtgcctacaggccctctgatcctaggacagagattactctgatacatttgtcaacatgtggacctaaaaggcaaactcaacttaatgttcattaagagaccatattcccatagttgaacctcagaagccagatgctttcaagggaaagggctgaattaggggtaccacgttattcctgttagttagcaagcatgtgtgttggtaaaatgattggccttgctactgaagaagcaatatggagaaattgctggtcagacaaaagcagtgcatgggcagtggcagagataattctcctctttacaaatgtatgattacctaggggcaaaaagaaaaaatggagaaggttctaaactagatatccagctgttagccactaaccaattagctctgagacatctatgagttttaggtttcttcatttctaaaataaggaaatcaaaacattattgtttacatcacttatactttgaaaattgatattacatcccatgtgatattcaactcaaaaggacctcttgccagactcaggaatgaaaatactgatacagtggatgatccgcttcctggtactggaaagacacaacttacctcctgggccagagtcccaagactatgcagcaatgtttttgtggcttcagccagctccttgctcgggaagggagatgtagagtttagtgttctctgtaatgagaaagaaaactttgtttctgaattcaaatgtaaacctgaaatctctattggaaataaacaagtgaattaaaactgttcacaatcttgagtttaacaaacaagaaaccgactcctaaccaaaactaaagacactacaattatttctaactgtaagtttgcattttgttcattttcaaactcattctttgattaatggttttaaatgaagtaggaatattgtacttaaaactagttaatatgcaatagattaaaaggatctcatgtgggctggggggatgtgtccaatacaactctgaccgcaaattcccaaatctgtctgcgtctgcaagatgggtaatacgggaatggctttgagaaacaagttaatgacggctcacaagaaaggaagaaaatataaagtttaaagctgtcaaaaatagggaaagatggaattctgtcactctgttcaagtcagcactgtttctaacactggaaattgaatgtagaacacttatttttacatcgagttttagtcaaatctttatatgtaccaattcatatatttaattgctgttatatgtcacctaactgcacagcagatataggacaataattcattagaacagggaaaagataaattagggcagaaagcataagctaaagaaaaaaaagaacaataatttacagactgtgaagtcagaattgctatagctgaggagcctcaagttgggttctgagtgttcaggcttccaaagagaaaaagacgtgagatcagtttcttcactgttatttgtcaagcaggaaaaaagtatccagggaaaatccacctttcttgatgtttctatgagcattgttttattcaatatcatatcagacatctctgaagtttagagaaggttgggctattttgacatttgtcatatcagagactgctgtgaaattataatgtagactacacaagaaaatgtctagaagtggctgggactcactatctctgagaaatagctgcctgggatgttttctttcaaagagaattccaaatgcagaagggattgagtatcattctgatcatcacaatatccaagcataatcctcaatgtgcatttctaagaaaacctgcctaaaggttctatgaaagaacttgtccagctcattcatctcttctggaacgggttcttcaccagagtcccaggactcccacattcacagtcctcaaagggacctacgcggtctcccttaaacgtcagactcagataggcctctgtgatacgcagaggtgttcatgattgttccttccatagagagtaattcatgagcaaaaacaggtgaggtgttttgtttctactttctctctttgggttcactttataactaaaggttaacacactagaagccgaacctagggagaacttgcctggaaaactattacaaacacaaactgagagatcttaattgaaagctataggaggtaaagtgtttttgtgtttaccgttaggcctacaagatgacagatgttcaagacagcatagcaaaaacaaaacaaacccaggacaaaacaagaaacgccagatccacataacctaaatttaagaaaaacttaaaaacgtggtagttaatccacttcttttataaggactcaatggaaataagattgttaggattcttgtcactcactctcccccgccaccctgtgccccaattctccagtcatgggaacctggggtagctatagaaccctgggcaaatgactcaaattccccatccttccattttctcgactatgcagcaaagtttaaaatgctgtgcacatatcacagagtttttataagcactaaaactagaggatatgtacaaagcccctcgcacagtgcctggcacatggtaattcctcacaattgtcaacaatgtcatcccctgcctttttcttcccttgcatgaaagtttactgccaaaactggagggcttttgtctgcaaacagggttttcaacttcttaaaaagacaaacatcctttctctgtttctcggcaaggtcttaaactttttcttctattgaaatgtccttcctctgctaggcagagagctagagctatcatcacacagcatatcagccacactccaatgtgctgtctctaattgtataattactccccaccacaaggtgaagacatcctcatcctgattcctgaaggcttgggataaaatgcctttctccccttctaacccttttcttttactgagcatttgccaaacggcaaaataaaagataatactaagtggatgaaatatacatgatatgcataataggttgtgtatagatatactatatgcatccatgtatgtttttacgtatatgtctatatgtatagacatacatacacacatatatcttacacatattaactggcctcaaagttgacatttcagttgaaaaacctgaaggaaaactcaatccctatggtaggtatgtgtatacttatatgtgcacacacacacacatatacatctttatcttaatgtatattcattatgtaccttctctttaaagcaggtgatgtttttacagcagtggtatagcttcccttgtaattaaatttaattatccaaaagaagtgacttaatttaaaaaatatattaactaaaaatgctaccagctgcacttgaatatgaccaaaatcatggcagaattgtaaatgactgggattcactaacactgtgaggtttggggagctactgtatcagaatcacctgtggtgcttgttaaatatgcagattcaggctgggcatggtggctcacacctgtaatctcaacactttgggaagccaaagtgggtggatcacctgaggtcaggagttcaagacgagcctggccaacacggcgaaaccccctctctactaaaagtacaaaaattagccaggcatggtggcatgtgcttgtaatcccagctactagagaggctgaggcaggaaaattgcttgaacctgggaggcagaggttgcagtgagccaagatggcgccaatacactccagcctgggcatcagagtgagactcggtctcagaaaaaaaaaaaaaaatgcagattctcaaccagctaacacctactgaatgagaagtttaagagtgtgatccaggaatcctcaggagactcttttgagcactgaggtttgagaaccagcaccatgttcacaaagcctcccttcccagtatgctttgcgccaacgtgcttggtggtatattctgtgtctggtccgcatactacaatctgcttcagactctgaagcagtgaagaggccactcggttcacctggccctgagtaggacccaagatggtgccaaacacatggggtgccaggtttgtcacaccaattagatacagtagtcaccaagtgcagatgtttctaaaaaccccaaacccaacattcacccattgtcaccattaccggtcatctgtctcctgaagggtacaaatcagtgaatgggtctgttgtttgtataaaaggtcttctccaacttaatgaatttacatcttcaagggcaatagtttttccaacatctttaggacttttagtttaaatttcttaactctggagcaagcttattctccttctcttaaaagccccacacttcagcaaaactccaggcacacagcagggcctaaagcatgactgtttaacccaggaatgtaattgagcatggatgtaaacataggtccttattaagtttgctgtgggcatcagatttttacattagcagacacaaattcaatgccatatcttatgatatgaccttcttatcagtagtctgtatgttgggtttgactgcttgtttaatttgactgtttttggttttggtctccaacagaaacattggctgaacccacccatgagtaataaggtagaacagtcaatgccattgttagaatcatttttaaactagttctttattcgagattaagtgctcagcatttactaataatattggcaatctgtagtcaatataaacaaatttccattttcaaaggaatattggttggagttacacaatcaggcatggattgacatcacagggttaacaaaacacacatgattcaaattctacatcaagtttaaagcttggattatccagatattttgctcatgacttaattttacttttctgtgcatccaaaacataccataacctgaaaaaataagccaaagactagaagcatggatttttaaaagtttagtataaaaatagaatactatggcaaaaattaaccagattccacatgtatcaacattgataaatctcaagaacataattccaaatgaagtggcaggccaatatgcacacttatacaatgtgaacacatttaggccagtaccaaatattgttatacatagaatgtaagtatacatgatatagaggattaaaacatccaactgcaagacaagagttatctctgaagaatgagctagggaaacagaggtggcatcagctgtacctgtaatgttttatttcttaaatagaacctggagtcagcacggcaaaatgatggatgatggtacaggagtgttctttttgtttgtttgtttgtttgaagacggagtctcactctgtcacccaggctagagtgcagtggtgtgatctcagctcactgcaacctccccctcctgggttcaagcaattctcctgcctcagtctctcacgtagctgggattacaagtgcacgccaccatgcctggctaattcttgtattttcagtagaggcagtgtttcaccatgttggccaagctggtctccaactcctgacctccagtgatctggctgcctcagactcccaaagtgctgggattgcaggcgtgagccaccacacccagccaggagtgttctttatgttattctctgtaccttttttcatgttgaaactatttcataattttctttttaattcaatgaaaagataaaagaggaaggacaggtgagcaggaagaaaggaagggtaaagaatctatgttggcctgagcacatatcagatctaacagacagataacttccttgaataaaattaaccccaggaaagaattcatgccttgaaactagaacacaaaatacggtctgagaatcatgtgtctgcacctgctattaactgtgctctcctgctcatgcttacttgacgaaggcagacaaaacttgccaaatcctatttccaaagagcttcagtaaaaaattcacagcttggaattcctactattatttttctaaccaaaaacattctcttggctatgaactcacataggtctccattgcacccaggagacaagtgactttcttatacgaagtaaaggaaatgggaaaaagaaggaaaataaaacctttagtgagggactatattttctgagttaagataacaggaattcatgtatgactcaatattttcagatcataactgtaatgtcattacaggaagaatgcacaaatgcttactgttattattcaaaagctcccacccacttctgcaaaatgtgttaatcacaacataccatgtttcctaaaagcatggcattctgtgacattggccccagaaagataaaggctgttgtgccccattctttctgggtctaagagatggcttcattatattctttccatcctcatgaacttagttctgctccaaaggccattcacattcacagaaatgctctgtttcgtattcacctcatcaagtcactcagcctgtggagcctttaatggctccctttactctgaggataaggccctatatcctcacatggctcgtgaagaaagacctgcctcagccgacctttgcccacctctgcaggcatcacgtctcatcgttccttctcccatcaaactccccacagctatatctgctccatgctgaactatctcaatcaggtacagttcccctaaatgccaccttctcttccctctcctctctggaccaatgcatatactatgtcctctacctggaacattctactccctgttctttacctggctgacatccattctttaggtccccacttagaggatgtttccttcctgactggaaagactgcagtaggaggccccatcagggactgtatcacacccagcagagcgtctcctgctctatacggcagctgctcctttcctggtctgtcccacccattccccaaccaggaatgaaacagagagggctggaccttgcacatgactacctccctgggccagagcatggcactgattagggctcagtaaatgtttactaaatgaatgaatgcatttgttaatccattatcactacacgaaatgaacactggaagataatattacaatgcattaggagtcacagccaaatagaagtagaaaacacatctgtgcaattaaaatgcaactgaaaatattttcaacttataaaaatctcatctacatctaaatttttcaggaattctatgacaaaatgagacgtgggtatacatatattggaatagtattttcaacacaatacacaattttgttttcctcctgggaatgcatgttacaatgtgttcattgaaacatttcaaatgtcctttaaatatcttcataaagtagacaaaaatctctacttcactttgaccatatgcaaaatccaactcaggctgggattagtatgttttagttcaaactgaaaacaagtaaaccacaaatcaaagactatcaccacccaggagtaattgctatctctttctggtgatttctatgacagtaaagatttcctctgggaaacattttaatattttttattgaaatacgaaattataagactacatttctaaggaatattctaatcttttaaaaaataaatcaacaacctaaatattaactttcaaattagatgtgtttaacgcattcaaacgcttcattttttgctgtttctaaacatagttaaatacatctactaccacataattcagaggaaaaaattaaacctgtatcttagatctggcaacaatatttaatgaagaaatagtataactaaggtgaaaatgtctgtgtaaatggagttgagcagtcatattaacacactgctatatctaccagctagtgctcttcttttcccataagaatgaggtgaacatagagtctgaagagtaaatctacacagtgtgtcattccacccattaccaacccatggggattgcggctgcttgctgggagaaagcaagtaaacaggtgggcagtcaaatcacacaaagccaaacaaaatctgatactttccaacaatgtccgggttccagacaggagaacacgagcaagtgttctctcctgcaaaaacccacacagacgctttaaggactgcatgtaacaagctgaagtatctagccctaaaaagccatgaggctgaaggtaacaacaagccccatctgtattctgggtccttgtctaagagtcaagaagaagctaaataaagacccctcaagacaaggatgactttgttcactccttatccatctgcttcttcgatctgtacacagctcagctgtgacattacttgtcttctgggagcctcggggcaccctcactttcccttctttccctcatgaaccaagatccacttggtgggaatgtgctaggcacactggaagacacgtggacagtggaaccactggttccacaaaaaccacttcttttttttccccacgttattgagatggagataaatctgcatgcctggacttccaaccttaaggatcagacaccattttcacatcactgaggcaatggtgagtcaaggacagagcccaaacctagctcattcaaccccacattcctcccactacagcccacagtgtctgtgttggcaaagactgctgtgagggagctggtcgagaggtcatcagtgaaactggaacgaggacagctctcactctgtagacccaggacctacaaagaattcctcaaattcccagactcagccttcagcctggatctcaatgcccatcagaatgaaagctccaagtgcatcacaactgccttgttggtggtcgaacttcagtgcctagaacagtgctggtataaagcagacatacaataaacacttgatggatttttttcgatgaatgtctcatacctagttcagagatgttctcctcccaaagtcacctctgtttggtttgtacattaaaaaccctaataggtgatgcttattatgctttagagtcactttccaaatatgggcaagaaaaagcagagagctgcagaggggtcaacaaaagccaaaggcactgagggaacacttcaaatatatgataaactattccttccaatcaagaaagctacagcagactgaatatcccctgcaaagatgtccacaccctattcctggagtctgtgaatatgcacatttcatagcaaatgcactgtgtagatgtaattaaagttatgaacctcaaaataaggagattatcctggattatgtgaatgggcccaaactaaacacctgagcccttaaaagtaaagaactttctctgactggagacagatgtgacaggaggcgtcagaggtttaaagtgtgagagatactcaacccacttgtgggagaggagtcacatgaaaagcataagaaggaatgatggcaacctttaggagcaaaaaccagcccctgctgacagccagcaaggaaatggacttcagtcctacaactgcacgggactgaattcatctgatatcctggatgagctccaaagcagattcatcttcagagcccccccaaaaaaacacagccccacaaacaccttgatatcagccctgtgagcctctaagaagtagacctaggtgagctctactgtatcctggcttctggccttatgaaataataaatgtatgtggttataaactgctaagtatttggtgacttgttatagtagcaataaaaaaaaaaagtacaatcggaagcaaatcaatctctcgggccaaaatttgctggtccactactatggctccttcctgcagtccaaaacagattggaggtttctgtgagacaggaaggtggccctctcctcgctctgggaaaggtacatgctgctttaggaaggacccaagagaaagttaagaaaagttcacctgcccagcacactctacagcaaaatacaccttgctgagcagcaagacaaaagaagcccctgccaggtggccctgagctcctcctagaagttgttaactcaacagtacaaatacaatgagcgcactccataacaagtctccctcatgactaagtgcatttatcccacagataatatttcatatatccacccacctttgttctcatcaaaaggatatcttttgagttgagtccagctcctagaaaatacctgacacataataagaactgaataaatattgctcaatgcatgagtaagatttttaagtaaaaagcagagaacacctaatggaaactgctcttaaccccagggaactttaaaaacacaacagcgttctgacatccagtattaattttcacacaaggtacggactgagacataaataagaatctttgggtgaaaagtcttgacaatatctgagcaagaatgcagtttttcactgaaatactcaccaggaccacttcgcttggtatgagttctaacactgatctacagaagaaaacttctatcttttttttctttttctgagacagagtctcactctgtcacgctggctggaatgcagtggagtgatctcagctcactgcaacttccacctcctgggttcaagcgattcttgtgcctcagcctcttcagtagctgggattacaggtgtgcgccaccacgcctgcctggcaaatatgtgtatttttagtagagaggggatttcaccacgttggccaggctggtcttgaactcctggcctcaagtgattcatccgcctcggcccccacaatatgctgggattacaacagatgtgagccactgtgcctggctgaaaacttctatcttgacgcaattgttttcaaggacataatttctactactcatgtcaattaaattatcaacttctatttattgagcacctattgtgtgccaggccccacaccaggctcttcatatgtgtaaccaataatcacaacaaagagtcaaatatattatgtgtatgtagaagaagagaaaactgaggcttacagggactaaataatttatccgacatcaatgctggtaaaatattcaaatgcaatattcaaacccagacccagctgaccctcccacactgccatactttccccatgttgccaaaacactgctttccagagcacccagattctgaaggaggcccaggagaaactcacaatacccttggctggaaacagggaaacactcacgcacacacaaaaggagaaatgtttcaaaatatgtctctcgtgaaattccacttttggtacagaagcacatattgaaagaagagtttctctccccatcatgttgggctttgcatctccggttgctgctactgctgcacttcttggcacagttaactgcccatgtgcaatgtcatcacatgtcacatccatctaccatcacaaatgttgaaatttcaaccaagcagcaatagaaaaaggctgcttaatgcaaatcaagtatcagtcccagcattccaattaaggccctgcttaattcaataagtaagagtcacatttcaaaatgtttggaagtcatttcatcctaaagccttcctcagaaatcatctttacacaaaacaatcctgatcactcattctactctaactcaagagccccattttgaagagaggtctcttggtaacagcagaggggcagaagcagaacctgagtgctccacaaacccgagatatgcagaaagcacctggtagtagccaccttaatcaatacctggtcataaaccaacgcatccacaaggcacaaccacaacacagcaggatgggacacagtgtagctgacggttctgaaggtgcatttccctgcactctgtcacgctgctaatcctcccagagagatactgtcaggttgaaacctgagctgttaattatcagatgatgagggctaaacagtcattctactatgagtataattcaggcattgtgtgagtggagggattttaccgggttgtgtacacaataggtgtttaatgagtaaacagaagtgaaatggaatgaatgggcacagcaccggaacaaattacaatgtcttctaaaaacacccatcttttccaaaatttcaatcattccagctgaaagggtgagcatttgtcatgcagtgaagcagcccaaaacagtccaagaaaatggttttgtaacaaagttttgtaccattcataataacctttcaccctctatgattcacagcacaaaaaagaccaacaggctgcaaatgtctgcacaagtcagcttctctaactttttaggccagttacttagggttgcaaagatccctgtagagaaatataccttactttaaaattataacatgggaccaggcacggtgactcatgcctttaatcccaacactttgggaggccgaggtgggcagatcacttgagctcaggagttcgagaccagctgggcaacatagtgaaaccctatgtctactaaaaatacaaaaaatagctgggcgtggtggcaggtgcctgtagtcccaggtactcggaggctgaggcatgagaatcacttaagcctgagaggcggaggttgcagtgagtcgagatcgcgccactgcactccagcctgggcaacagagtgagacagatctcagctcactgcagcctccacctcctaggctcaagcgatcctcctgcctcagcctcccgagtagctggaattacaggtgcccaccatcacgcccggctattttttgtatttttgtagagacagggtttcaccatgttggccaggctggtctcaaactgctgacctcacgtgatctgcccgccgtggcatccgaaagtggtgggattacaggcgtgagccaccacacctggccgatacaaaaactttttgatggtcaatcaaaggtatgaatcctgaagtgtgtttctaaggtcacattctagggtatgatctgggaacagggtccagaaactgagtattcttaattctctgggaggaccaactctctataaagaattcgtgctgcacaaaatccaagagtattacaatttcattttattataataaggaacatctctttccagatacatccttcctccaggaatctttccctggttttaagagaatctatctggtgagtagaaaaccagaatcctggatattaaatgatgatgtttggggtagcgagaggaatttcaccagagctctcagaacacctagagacatatttgttctggaactatataaaacactctgatgaccaaactgctcaggctcaccagtattttttggttaagaatgaatgggtattctcatagagtgcttctctgaactattgattcctaggctgaaaaaacttcgtcggaatttttctttgcaatgttattactaagtaagctaaatagtgtggtctcatctaattccagggccttccaactgtgacagcccacaatgtcatctttatgatgggtttttaaacataaatagatatccatcttcccatcaatggtttcaagactttttttttttaaatatgaagaactctgttttcaaatgagctcttgcttagtattataatagtaaaaacatgaaaaagcaggtcttctctgattgaaacaagcacaaaaaacttttggcttaaactcagccacacccagcttattcttcccattcaccctttgggagatggcccaaaagtctgaaagaacactaagaacacttagaataccactgaactaaattatatcacaaactcccagccagccgtacttttctacaaaacaaagtcatgctgtccaaggaaaagcctcacattccgaaagcattagtgcttgaagtttctccagtgagcaagtctactcaccaggattggcttcaggatgtccatgttggaacgaagtactcgctctgctgcagccagtttctcccttggtaggccacaaagctcagaaacttcttggtcaccaagttgaatcatctcttctgattttgatccattgcacagacttgtcaaatgtaactggtagccttgcaaaaatacctggaagcatttcatgcaaagagagacaagcacaagaggattatgaagattggaagctgggtccttgaagtcttttggagaacttcatatcaatacagctttgaagatcttaaaacaggttccattgcaacagtccaatgcatcaggtctctttactgaaactcagaatgtatcaaagcacaaggcacaatgacaggacacttaaaacctgcaagttgcattaactcagtatctcccacactcttgtccctcttgcaaagaaaaatccagagtccaactcgttttcttaagagtgggacacatgatttggcaaacaggaatccagagtctgaattcctggaaccacttttattagatgaacaacatcctcactattttgcaatttatgttgtctttaagtaggactgggctgaaatatggggagaaagcatttatgctatttatctgtaagtgtagatatttaactaagacacagaactatgttctaacaatttcagaatttggaattctccattttacttgccctagagcagagtgccagaaagccaggcctcttatctcattgataggccaattctaaatcattcttatcttttctttataccaaacccactagagagcctcttcttggtcatattttacttaattgcctttctggacctaaactattctacttcatacgtggtccagtggaccacaagctttgaaagaagagcctgtttatcctgctcactttgcatccacagtgctgaaacattatagccagtatttgttgaaggaatgaacaatgcagactctttattacaccattactaactgccctgtttaaattggggcaggctgatgtgcttgtagaacaacctaaggtgagtgatggaccaaaagcctctcaaaacccatgcagcttttgaaatactgcagaacatttggcctaccatgattcccattaagtttttgctgactgccagagatactcaagcacacttcagttctactcatttctttaactggtccttgctgctaggctgtcagcctacagttagtgtctatgtttaagaatactgacaacaggccgggtgcagtgggtcatgtctgtaattccaacactttgggaggccaaggcagacggatcacctgaggtcaggagttcaagaccagtctggccaaccaacatggtgaaaccccgtctctactaaaaatacaacaattagccaggtgtggtggtgcatgcctgtaatcccagctactcaggaggctgaagcagagaatcacttgaacctgggaggcagaggttgtagtgagctgagatcacgccactgcactccagcctgggtgacagagcgagactccaactcaaaaaaaaaaaaaaaaaaagaatactgacaacggagggcctttgttgatgtcatcttctgcctctgcccaatcatgctttgttccctttcctttccttacacaagtattgatcccaagaatttttcaataaatgtcttgtatgctcaaaaaaaagaatactgaaaatacagaaactccaaggaccatccaaggaccatctccatgcttaggatgccccttattttaaactgattagatgtgacagatatgaaattggcagggggcaatggaaattatgctaaatgcaactactttcaaaagcctgatgcctttggcccatctcctaaccacacaattggtaaacacaaggcatattttcctagtttcagaagggcacgcagtaagcacatttttctaattttaaaaattctagatcatgtgaagcaaaaagcttattttcaagaataaacatttccactacttctgcttcttgtaaagacaagctagtatgcagacacgagataggggaggaagcagttcccctttctgccagagaataagctcaaaaagtgtctctgaaaaatcaataaccatgcaagctgggtctggtgctacccactgcacaagagctgtctaataatgatgccagaggaagttttctatgattctaaagttaaaattcaacataaacactaatattatttcctgattttataaaattctttttttttttttttttttgagatggagtctcactctgtcagccaggctggagtgcaatggcgtgatattggctcactgcaacctccgcctcccaggttcaaacgattctcctgtctcagcctcacgagtagctgggactacaggagcatgccaccacgctgagctaattttcatatttttagtagagacaggctttgccatgttggccaggatggtctcgaactcctgacctcaagtgattttcccgccttggcctcccaaagtgctgggattatagacgtgggattacagacctttgaagtgatctcgtccatcccacctgagctttgtgacactagtccgttcatttctgtttccccagtgccatctcacagagctaaaattggagagatttaaagccttattcccacaagctgcagggactgatctcctatttaatgcaaagcaagcaacagttctcaactcagtgccactgcgtccagcccttattttataaaattcttaaaagtctccaaatacacccttgtctaaagtctcctgtcctcaattttttagacagagctcctccagatcaataacccttaaccacggttattgcctcagaactgtgaatattttttaagtttaactcaacttaaaatgtatcccttgtaggaggaaatcatcacaaatgccaagtgataagccagaaatcaattttattttaaccagctggcccatgacgccaggttgcatattccactcctggatggtttggcaattcctgcctgaatagggaagtaaaattaagtgaagttgtattcaaactacctccctccccttcaccaccattacaaggacaagggtttattcatttctttccagtagctgcacaacgtaattgccatcagccctactgaggaagctggaggcatcagcttaccttgtggagaatgacatcagccctcagcatcttgtccacagtagactttgggagagagaggttgtgatacaggaacccagagaaggtttcattgtccaccaggaaatcttgaagcttcaagtctattgagaaatagtgttttatttttatttagtaagtaactcaaaaaaaaaaaaaaagtgggcacaatgggacagtggagaaacgttatcataatattgatgatcaacagttgcctggctaaacacacacaggaatgagataggggagcatcgccatatcaggagaggcatgaaaatattgctttctggtaacatgttgagccacactcagcatgtgctcctcaactcaaacagtgtgatggtgctgttacacacacacacacacacacacacacatacacacacacacagcctttccttttctttttttttttttattttgagacggagtctcaccctgtcacctaggttggagtgcaatggtggaatctcagctcactgcaacccccgcctcccgggttcaagagattctcctgcctcagcctcccgagtagctgggattacaggtatgcatcaccatgactggcaaatttttttttttttatctttagtacagacagggtttcaccatgataggcaggctggtctcaaactcctgaccttgtgatccaacctgccttggcctcccaaagtgctgacagtacaggcgtgagccaccatgcccggtctttctcttctaaatgatctcacccaccccacctgagctttgtggcactagtccgttcattcctgtctccccactgccttttcacagagctaaaattggagagatttaaagctttattcccacaagctgcagagactaatctcctgtttaatgcaaaacaagcaatggttctcaaacttaagtatgcatcagaatcacctggagagcttgttaaaatgcagactgccgggccgggccgggccgggccgggccgggccgggccgggccgggccgggccgggccgggccgggccggcccccacccccacccccacccccacccccacccccacccccacccccacccccagagtttctgatacagcggccctgggatgcgactggagaatcacttacaggtgatgctgatgctgctgacctggggaccatgttttgacaaacactggcagagtgcattacgcatatcaaagtgccttcacagacatggtctcattttcattccaaacataaaacatgtgatacaaagctccaaaacccaggtctgccaggctttaggaaaacacattaacatatatttaaaccatcagccctattaaatgatttgattgctaaaggatttcatacggaatctccctaaataataggccctctgagtacagttagaaaaggcttcaatccagtgcaacaaaacagaaaaagcagcactaagaatccagaattttagtttctagagttggaggctgtgtctggtggcgtccctgcgtacctcatgtcatctttctgaacctcaatttcttgatctccaaaatgagaggtttctgaccagatgcttggtaggagccctatgactccgaaacagtatagttttccctgactcatctcatttggctgtctacctcttctccttccaacccactctcctaacagcctaacttctttgtaataaagataaaaccagctcatcaggaccacatgaactgagcccacatggccaggcactaagcaacctctagagggcaaactttgcaaactgaaatcatttaccagaagagaaacaggtttgatctgaaaatggggctacagtgtgaggcttaatgaggacaggagttaatccgcggagctaagagggtcacatgcagagataaagtaacaggagggcctgacagcccagccagtctctcataaatgctgtatgatccaggtgtattctgctttaggcaaacttcagtaatattgagttatatagacagaataaattgagcaagatttacatcgctagagaaatgattcactgctacccctctatggctagctcctagttattcctcatgacagccagtagctgttcttaggcccagttagtgtccctcagaatcagtgctcctgcaaactgctacctacctgatgcttcccatcacatgtgactctacactgttagcattaggctctctactgcagttgtcaaacctcagagcacctaagcttcatttagggagcatgcgaaaatgcagtttcttgggcccagtccccagagattctgaaatagtgggtctagagtgcagagcctacaaatctacatttgaataagcatcccttacacttttaatgttgggggagggaggtgtggaaccacagtttaaggaacattgttttacttgcatgttgtctctaccagactatgcctataggatagggaatatgcgttcttagtaccaccaatgcccagatcaggcctggcacagaattactgcccagtgaagggtagctgaatactaaacactaggagatgggattagggctgacaaggttccaaaagtatctgagtaccatcataggagatttccttttagctggccaggtccaggaagagcccagggatgtcaggaccatccccaggccacaccccaggagtgaacaggacttctaaccactggaactgccttcccaggaacagaaagcgacatccggggtcactttctgttcttgggagaaacaggaaggaaggtgtaagctggtgtcttcagttgaggactggtgtgaaaaggtagacattaatcactgtacaaccatggaaaaagcaccaccctgggagtcagaaacctgggttctaaatccatttatttgtcgagtcatttcatgtagttgtgcctccactgccttatctataaaatgaagggtcaaaaaaggcctctgtgaaacctcaacagaaacagaatacacgtattagctaaccctcactgactaggtgggccatagcttcctcctgagcagagccagagcaatacatcatattgcaccagggaacttcaaaacagctccctccttcccaagcagggtggcagaagtgtgggagggcgacccaggccacccctgcaatgggcctaggtcatcctgcaacactctccagaccagtgagtgtgctcagcatgtttataagacttctgttatgttaacaggctctgaagatgagaacatctggatgtgatcaagctccagcctcctatcagtgaatcccccggatgagacataagaacccagagactgattaaacagtcaacaacccttggctgtgcacgtgcatggtgtggtaggttcgctgggttgggaagcagcagggagggccaaagatcctccactacaaagaacttgcagcctgatcacgtggatatccacccatgtaggcttagactcacacactagcaccaacctgtgtgaaaacaggaaggcaacatggtgtagtatactggttctcaaacatgactgcccgttagactcagctgggggcttcacaaaaatcccaaagcccaggccacaccatggagcaactaatgagaactgctagggtaagacccaggcatcagaatttaataaaacctggctgggtgaggtgggcagatcacttgaggtcaggagtttgagatcagcctggtgaaacccagtctctactaaacatatcaaaattagctgagtgtggtggtgggtgcctgtaatcccagctacttgggaggctgaagcaggaggatcacttgaacgtgggaggcagtggttgcactgagcagagatggcaccattgcactccagcctgggtgacagagcgagactctgtctcaaaaaaaaaaaaaaaaagaatttaataaaatttttcaggtgattgcagccaagtctgagaaacaatgatgtgggggaaacatcagggtttgggaccagaaaaacctaaatttgatactgcactctcctgtgaaatagctgtgtgactgtgagaaagtgactttacctccctgagcacaaattttcttaccaattaagtgaaggtaatagtatccacatttcaaagatatgaagatcagagatactcatcatggtaggtgctcaatatatggtaataatttgtgattatcaaaaagattttttcactcaactttaccaatgtacaacaatgccatttatagaaaagatggggacacagtccctgccttcgaggaactttcaaggctgaaaggggagataaagaggcaaatcaattcaagaaggcagaaggaaggataagcaagccaaaaggagacagtaaatggaagcactggcccaagatgaggtttatctgtaagtgcttcatggcgagcaaccagactggagccaagttctggaaaaggacagagtcaaaaatccctagaagtggctggagaggaaggggtaagacctctcatgatgacaacgaccaggacattttgtggtcataatgctatgcacatagtagattctcaacaaatgaatgaacaagcagataattagagaagagatttctcaaaacctcagatctgggtagtaggaaggggagaaaaaaggagggggtgaggacagagtacagtggctttgtatctgctggtctcagtcttctcccctatgttgctggcaggaaaatgggtggaaagccaagaatattaagaaagccagatgtctgaaacataccttctcctcttaccccatcctcatgacatggcccatgagtcacctcctccaggaagcctgccctggccttcccatcctcaagctgggttaggtggccagcccttttttgtgactttttttttttttaatacagagtttcaccctttcacccaggctggagtgaagtggcccgctcttggctcattgcaacctccaaagccccaggttcaagcaattctcctgcctcagcctcccgagttgttgggattacaggcacccgccatcacgcccagctattattcctttttgtatttttagtagagttggggtttcatcatgttggccaggctggtcttgaactcctgacctcaggtgatccactcgccttggcctcccaaagtgctaggattagaggcatgagccaccgcgcccggcgttttgtgactcttttgtgcccaacatcctatgttttccactagtaccacacagatcaagctgcagtcacccatgtaaatatcctgctcccagaagaatagaaattccttgagggccagggtttttaattccaaagccagcagtgcctggcacagaggaggcactcagtaaattggatgaatgaatgaatagatggatggatgaactaatgaatgaatgaatacaaatgagtgaataaattaatgacctgatgtgatttggggaattgccgattgcagagaagaaaattcaccttgcagtgagttagggaaaagatgaagcaggacatgaacttgaaacaaaccaagtaaagaggacacaagagttctgctaaacccactcagccacgtcagcccagatcaagaggagagtcaggtgagtggcagctagaagcagagtggggaacaggagagaggaaggctgagttgattaaatgataaaatggagatgacaatggcatccacctcattggactgagctaggtgttaaatgagcaaatgtacctgcagacctagtataatgccgggcactgagtaaggtgcccggtaaaggatggctaatatcatcatcattttcaggaatgactgatctgaacagattcatggctaatttaaccttaaagcatattcagaatagacaagacacagaagtggctttggcggctaagttgagatgttgaatttgtgatctaaggtatgcacatgtgtgtatgtgtgtgcatatgtatgtgtgtattataatacatattagcctggctgagttcctaagacagaattattgagttctttctgctgatactatctataaggtaaaggaaaggttgaagctgactgatttgtctactcataactttatgaaagaataaataaatctagtattttacagggaatcaccaggaatgatcatatccaccagtcactgcaaggatggatataggtggaagatgacctggacgaaagaccaatcattccacacaagacagggaatacttcctgaacaggagagtcatttagccacttaactttggccaatgagttaatgcggacctggattttataatcagtaaaatgtgtgggttggagaagatgatctctgaggtcttcttacctgacactgaaaggaacacagggcaaaacaaaatcagcactggatacagcatcacagggtctgaattcaagagtcagctctgccatttcctgactgtgtaatcatgaagctatactttcccccctatttaaatctccctaagcctcagtttccttggatataaaatggggctaatacagcactttgggaggccaagacgggtggatcaactgaggtcggaagttcgagaccagcctgaccaacatgaagaaaccccgtctctactaaaaatacaaaattagccgggtgtggtggcgcatgcctgtaatcccagctactcaggaagctgaggcaggagaattgcttggaggcagaggttgcagtgagccgagatcacgccattgcaatccagcctgggcaacaagagcgacactctgtctcaaaaaacaaacaaacaaaaaaaacggggctaataacattcacaggttgttgtgcaaaccaaagatcaagaacgtgaacgtgctgtttcaggggaaaaagctgacttgctccaagtgttcgctcgggtaactggaaggtatgacctctgtcacaggatgcggagctgggctactgctgccagcagaagagaaagtcactatccagcagaaggtcaagagggctctcccaccacagtctcttcaatacagaccaaaatacttgacctgctgagctcagcctccttggttttgcctggaggagcaaacagtgacctaccaattagccaagagcttctgtaaagtggggcaaaggaaaggaaaaagaacaaaaaacaggtgacatgtgtgtttgtgggctggaagaaacgaagcagaaccctcagcttcttgccacacatccaggcctctgggaccaagccggggaaccagctgggacctctgggacccaggtccaggcctctgggaccaagctgaggaacacatttgcacgtgcaggcggaggggtatgacgcggggtgggggcgaggtcctgctttccaggccattcagtgttccttcagttctctgagcatagaggacaaggaaggtgggaggagggaggagagggaagagaggggtgaaggagcttgggggaggctgggaaagaaggaggaaaggagaggagggagagcagctcaggaaggcggaggaggaaagccctttgctgagctgagctgagccagacggggttactctcggtcagtgccctccagtccccagctcaggtttcaagatctgtcttctcttttgctcaacatgaaaaggaaccagagcaatcagctgctttagaagtgggtggaggaggcaaatgaaaaaaaaggagaagtagggaaaatcacatcagcatcccaggcccagatggtcttcttcaatggacccctggggtgggggtggggtggggcctcccagcctgctaggagctgtcaactgagcagggcctgggagcgggagacaaattctaactcgtggttttaatcagcctgagcttgtccagccttacaaataagaccttgaaatacttctctgttatacaagggctggtaacaaatacactccagtgtctttatggtatttttttggtgttttgttttcctgatgctctgctgtcttcttgaagaatagacgatgcctgcttcaccaatagctgagcactctctgggaagacctggttgttgggtgctgaggagaaggggtgaggcggggtgatgcagctgctccttcaggtgactccttagagcaggggagagtaggccaggggtgtgtggtacacacagcctaaggacacccatgctgttcatcccggcctgggctttccaacccaggagacacttccttctctacagagaaggctcaccgagggataccaagacatacctgaaaaaactcagttccagaattttccagttatgtggccttgggaaagtcagttaggctctctgagcctccatttttctgtaaatggaggtctagcttcctatacgtgtgggttaagttatcactaatgacactaagtgtgttaagtactctgaatgctgactcacacatactccttgagaaaatacaagctgaaaattaaacatgttcaaaataaatgtggataaagtcatagatgacaagctgtgaagaattcccaagagaaaccaggatatttaggcttatgctccctgaaccttccaaggcattaggaagccagagtcttctctttcaaccaatgggaataccataactttaggaaccacacattccttctagtattttacaaataatataaacttgtattagttcaacaaacttctgaatggctacagtacccaaaatactagtgttgtggttcaaagggataatatttttctcagtgctccttgaaggcaggagctagcctataacaaaagaggcgctgtgtaacaaaatccctgcccttgcattctaagaggagatggccagagggtcgggtgagcagagcggtgagcctccaaccctctctgccactccagaatcagtcagcactggaatcaggggtggaacgagacattactcatcttcccccagattactttgctagtaaggcaatagcacacctgctatgatttgaacgtgtcccccctcaaagttcatacattgaaacttcatcaccaatgtgacagtattaagaggcagggcctttaaggggtgattaagttatgtgagcagtgccctcaccaatagcattagggcccctcacagataccatgagtttcatgtgcgtctgtgtgaagagaccaccaaacaggctttgtgtgagcaataaagctgtttttttcacctggctgcaggtgggctgagtccgaaaagagagtcagcaaagggagataggggtggggccgttttataggatttgggaaggtaatggaaaattacagtcaaagggggttgttctctggtgggcaggggcagggggtcacaaggtgctcagtgggggagcttctgagccaggagaaggaaattcacagggttaatcactcagttaaggtggggcaggaacaaatcacaatggtggaacgtcatcagttaaggcgaggcagggccttttcacttcttttgtgattcttcagttacttcaggccatctgggcgtatatgtgcaagtcacaggggatgcgatggcttggcttgggcttagaggcctgacaatgaggacccctataaaagggcttgagggagaggcttcagtcccttctgccagttgaggaaatggcgtttgtcccctcctaaggatgcagcaacaaggcaccatcttagaagcagagagcagccctcaccagacaccaaacctgccaacaccttgattttggatttcccagcctccagaactgtgagaagtaaatttctattgtgtataaattactcagtctcgagaattttcttctagcagcagaaacagaataagacaatacccatgtcttactgagaagagggaaggtgggagaagttactggaagtccctagaatgagggttgaagaccctgaatggtaacaattcccccaaagagccagtgcagccccagagggaaaggatgtcctggtcacactggccagggcgtggaagggcacagtcagcctggctttgaagctcagaaggaaatggaagataacactaagacataacattgacccaaatgaattttggacctgaacagaatgagaagaagaaacaaagaaccaacatcagaaaaagcaagaagatagctgagatgaaaactctacctgaagaccagagaggcagaaaaatgagagaggacagctggaagacaaaaggagtgaaaagaaggtaagagataggaagtatgaagaaacagagtccagaaacaggaaagactacatcaaacagaaggggaagagagaaaaagaaaagagagtttgaggcattcagttcccaaggatgagctggtctctcactgaaaaaagggaccagacacttcaaacaccacacaacatgggactagaatcagcctgcagggccctgagaagtccaggcacaaaaagaacggaaaaagatgagtttacaagttggggatgagattcttcctaaggctggtctagggaagaattaacatacacaatgtataaatagtttaatttttttctaacttttaaaattaacaaaatttattaagggacatagtagtgctttgtgggcacagaaaagtgactcatatttaccaagcattaggcacactattagcattattttccagaatctttaagaacagcctataaagaaacgtattattattcccatttttcaaatgaggaaacagatctggagaatatcttgctcagggtcatagaacaaacaagtggtaaatttgaacccaaacagctttgactgcaaagctttggttctttccactatatcagcaatttaatgagatgttttaaaaatgcttcatcgtgatattggcctcaaaagctggggatggcacctatgcttcctaatgttggaataagcaacatggcagcatagtgtggggagaaaatgctaagcctaggagtcagaccccgattcaacgtacaactttactctttaatcttggacaacagacattaccctttcgagcctcggtttcctcatcaatgaaatggagataataataccaatttgcccctgctagtgctgtttgaagccttcaatgtaataatatatgaaaaatgtaaaatggtatcattatccggtgcaacttagtctgttgaatagtgtcgcactgagattgccttttggtgcctcaatgcaacagtgacaagaggaccagaaatgggaaagctttcaatgagaaacaaactggactcccaaattgctctttgccacccacagaataaataaaccttatgctggaaaagcaggagacacgcaacactgttcttgatgttaacaattcaaaactttttaaaggcagtctgatatttgtggggatacacactattctgtaatcgaatgcaattgtgttttctattcttgtctgagtaaagctgatctttgatttgatttagttcaagtaatatttcaacattgcagtgcagcgttgctccccacccccacctgcttacagcccagctgggcccaggcccttgccctggatggaaatcaaagacctggtttctgagatgcagcctggctttgacaggtctgggaaaactcatggtagtggaaaggtttccaaatataaaattctaaggcctcaaatcaaaacttttgacaagtgcatacatacagaacgtgaattgcaatcacctaaagatttcaaagaatttccattttgatgacataatgttgacacatgtatcaccagatctcccaacaagatgacacactggggttccacaaggacagaaaatatagtctgaggctgtaacctcaactttagcagctgcctgaatgggtgagggggttcagacagaaaatgagaagtggctgtgagtcacaggatgttctttctagatgggccttgggaaacattccatcggtgcctgaagccaggaagtggagtgaatctggcatttctttcagaagccctcttgtctcctttctcatcccagccagcccatgccccatgtcctgtgactttagggaagcttctggctactcagagctgctctctttaggatataacaacaacagagcacgagaaactggaattctggtcctattactgccccttgccagctgtgctttcttaggcaagttacttggcctctctgaacttcggctccttcatgtgtgtatcccctgcattttatgatgattgtaaaaatgcagtgagcttaagaacaagcctggtacctatgctgggccaggcactgtactaagtgcttccccttattcgtccattaatttgccacaatagtcctgagggaggtactattgttattccatttgaggaaactgaggcacagagatgtatggaattatccaaggttacacagctgataagcatcaagccaagatttgaacctaggccatctggctgccaagtctgttctcttaacacgaaggtatatttcccagggaatatttacaagatgttaattttctacccacttccctcaactccctgccacagccaactatcttgccatgtcaccaaagccaccctgctccctggagctcacgtctttttgattttcaaaaatcaaaccagaatcaaaggtccaccccactgagtccttagtactatcagtaaatctgacagccagagaggcatgacccttttccctaagtaaaatccagtataaccctggggactaatttccaaaaagattagtcagagccatatcagaaaggccaaacaggctgggcatggtggctcacacctgtaatcccagcactttgggaggccaacgcacctgaagtcaagagttcaacatggcaaacatggtcaggagttcaaagatggtcaggagttcaaatggccaacatggcaaaaccccgtctctactaaaaaatacaaaaattagccaggcctggtggtaagtgcctgtaatcccagctattcgggaggctgaggcaggaagaattgtttgaacccgggaggcagaggttgcagtgaaccaagatcgtgccgctccactcactccagcctgggcaacagagtaagactccgtctcaaaacaaaaacaaaaacaaacaaacaaacaaaaaaacagagccgggcgcagtggctcatgcctgtaatctcaacactttgggaggctgaggcaggtggatcaacaggtcaggagttcgagaccagcctgaccaacatggtaaaaccccatctctactgaaaatacaaaaattagcagggcagccagccgccccgtccgggagggaggtggggggcagcccccgcccggccagccgccccgtccgggagggaggtgggggccagcccccgcccggccagccaccccgtccgggagggaggtggggggcagcccccgcccggccagccgccccgtccgggaggtggggggcgcctctgcccggccgccccttctgggaagtgaggagcccctctacccggccgccgccccatctgggaggtgtacccagcagctcattgagaatgggccatgatgacaatggcagttttgtcgaatagaaaagggggaaatgtggggaaaagatagagaaatcagattgttgctgtgtctgtgtagaaagaagtagacataggagattccattttgttctgtactaagaaaaattcttctgccttgaaaaaaaataaataaataaaaattaaaaaattagcagggtgttgtggcatgcgcctgtaatcccagcttctcaggaggctgaggcaggagaatcgcttgaatccaggaggcggtggtcgcagtgagccgagatcacaccactacactccatgcactccatcctgggcaacagagtgagactccatctcaaaaaaaaaaaaaaaaaagaaaggcctaacaagccagattcatgccatgaacataagggaagtggcagctgagccactgactccacacaaaagtgcagctgaagggagagagaaactccatactcagtcgggatggcaggctgctgccccggatctctctgccagtcctgtccctttccgccccttgacctcaacaaggtgatatgtcctccaaagggttcatctccagcacagtgacaaaatgcccaaagatatttcttatcttttcctggcaaaatccttataagcttcagagagctccacaaccttaaaaaaaaaaggtatttcagaatcccccaagtcaggagccaaagtaggccagttgcagccctagtcctcactggagaaggcaagataaggaactccaggccatggcagagaaccatgtaggctgtgcactattcaactcaaatcatcacagttctcatggagagtgccattcacagggaccgcggtgtgtatgtacccccagaaacgtgtgacttgtcagccctaggaacagcgtgaaagccatccctacccgttctaggcatattcagcaggtctagaaaatgatctttgcggtcccacaaaacacttactgggcttctagagttaaaaggtactggtgtggccataactttggacagggcaagacacctgcagagctaagatcttgcttgactcagaagttgctgagttccatgtacagtagagagaggctacctggcttccagccacaccatagaatccacagccctgcccacaccacttgggtcatgccagctaaaaaaagatggagaacttccccagatgccccacaagtctaggaattgtttccagaccagcataagcaatggcaaggctgagggactggctatgggggatgtagcagtggacaagagcctcgctaagtgtggaaacggggaacagagggaagctggggaacttctcagaggggatgtgaggacgccctatcccgggaaggcaagaggcttcagctccagcatatgcacttcccaactatgagccaagtaggacgtcccaaccactgcaaggaggtacctgctcaagaggggactgtgtccacagtgcaacctggagttgaatgagagtctgtagtccagatttcagaatatgggagaggagcaggccttgggaccaagtggatgcctgagcggaaatgttcagtaggaagcaggctaatgaacccattaggtatcactaagcaatacattttaagtagctgaaaaggaaatacacagtaaaaataagacagcaaagggtcacctccttctcccacccagtcatgattctcagcagcaacaaccccatcagaaaggccttagcttgggccagtctgcttctcagcccacctaagaatgccagattcaccagagagggggcacagcgatggcaggtggcttggagtggggagtgaggatgactccagggcaaggaaggaagctttggaaggggagcagtgcttcttgccccaccatgccctggcaggagcagatgcaggtgggggcctgaggctgacacaagttggtagggggctctctttttaaaacaagatagtatttttaaaaaatcttacttttgcaaaccttacaaaaacataccactgtgtaaacatattgctaagacccccagagaggaccttgaaaggagctatgaaaaataaagtaaatatttttagcttcccagtaaatctactttaggcctctgggttcatggctgcccttccagaaagctctggggggcaattttgtgaaagaaagaaggccaagactttttgaagaacttctgtcatcattattattcgtaggctctgttgacctgggctaacacaagggaataaactatataatacaattttttaaagcacttttacttgaccctcacaataccctgtgaagtacaggtattttattttctcccaccttcattccacaaagattcactaatggctcaccatgcacccactactgtgctggggcttaggatggaaccatgagcaaggcgcccaccttgccctcaaggggctatagtctagcagacagcccacatccttgggtagtcccaggtgatcccccatccaagtactgaccaagtttctgggctgaagcattttctggttgtttcaccaaagaaagttccaatttcaaggcaaagaaacttaaggcccagagaggccgaacaagtggcaaaggccaaacagtcagccaggaacagaaggggaagcaaagcaactcgaatttattatgtgtcaactgtgggctatgagcttcactatcagtcatccacagacatcatctaatttaatgctcagtgaccctcagggcagctaatcttcaggtaaactctgggccagaaagaatcaacacatgcccaaagttcacacttcatgagggatgcagcatggatttcttcccaaaatgaatcttaatacaaaaccccacactcactcttataccaatgttttccaatcttcaatcatttacaaactactctcacaagttttaccatattcacagaaaatgtttcttttgaattaactttaattatatttttcctgttgaacatcctcctaagcaataatttccatgaaattgcaattggatgtgggttaaaattaaaagttctcatccacgtactgcctaaaatcatcccagataccacacaaaactcacccagagaaacacttatctctgccagtctgtatctcacagagacaaaatacagacatgtcactttccctagggtttctgaggatttatccaatttttacatctgagttgcagtcaccataggtatttaagatgaatgaatgcttctcacactgccttgcaaacattaattaatttagccaccacaccactcaacttgtgtgcctgtactctggtttaggaagaaaataataaaatgtctaaaaagttccagtgatgagaaaagtgggtgaggcaccctgtaagacttcctccttggatttcttattaggatgatttcaaggataattaaaagatttgtccacggcttaattcctgaaatgggagttcttcccagttgaaagattattaaaacagcacaatagagcactgtagaaggagaactgcctggagcagcaggggggtttagccgtgatttattcccagaatatcccttctgtggttgtgtagacttgggacagtcacttcccccttctgggtcagattcttctctagaatagaaattccatatggagaggggccatatttgttttggacacctctgtgtctcggcacttagaacagtgattcgcatataggagacgctcaatatataagggttgaatgacagaatcaactaatttatctataaatgaactaactggtctctaaggtctcttccaataagtggaaataaaatgatgctctagccaaggaaatcatgagagtatttgagtagagatccccatatctacaaatcacctgtgtatagtccagcgaatttagcagatgcaagctgaagggaagaacaagataaacttcccaactggatcacagaagcaggagcccagtggcccagcactgattacaatataggcctgagtggtagtgtctacagaatcaagaatcacttgaacccaggaggcagaggctgcagtgagccaagattgcgccactgcactccagcctggtgacagagcgaggctctgtcttaaaaaaaaaaaagaaagaaaagaaaagaaaaaggaaattagtggtgttttaaggcagtctcctccactaagatcagaaagtctgcttgacaacttacccccatcagccagtctatttcaactgctgcataaattgcaaggcagaagaacaaggccaggtgctcagaaatgcatcactgtcttagaagaatactggctctcatttattgggaatctactatgtgccagatactacattaggttttatagtttacatttcaagttagctgctattttatagttgaggaaaaaagggtctacaggggtggttagtctccactggactgatccaagcttcaagtctttgtcccacagttatcgatgactggaatgaggccaaagagagttgtttatcacatctctagatgacgagaaaggagtatcagatataatacatggcaaaatcagaatctaaaatggttttgggaggataggatagcatagggaatctaaacatgtaaaacagaaaaaagacatttttccctttagttcaaaaagccaacaatacaacaaagaaatggagaacacgtaacttgcaattctgcctatttaaaataatcacaattttgtttgagtgcacatggaatatgagtcaacaaggtgacgtgaatgccaaaatgcctaatacaatctcagactgcattaacggaaatgtagcactcagaacaagggaggcaaaaatcccttcctcctctgtgccagaatactttcataatttccagtaaacttcaagaagcacacagacatactgaaacacaaccagaggagaggcagaaatggggaggaaaaacattccataagaggaaaggaggccattttgcctaaaaaatcatggactttgggaaaacagggaaagaaaaacatgagagctgtcttcgactatttcaaggaaaacagaattagacttgttctctagaaagcataacagggtggtgaatattttctaacaattagagctgtcaacacccagaatgggctacttagtgagtggtagatccccgccctgggaaggtgggtgtgtggtaaaggaggtgaatgaggacaaagctccaaaccagatcagcttcaaggatcctcccagccctgggagagacagcacaggagggccaagctcatcatgctgtgatggggtgtcagtgcagataaacacaggtctctaagtggggatccatactgacatatgccagtctcagcttctctccgaaattgacaagagtgctattcgcaatcagcaaaaagttggccaggtgcagtggctcatgcctgtcatcccagcccttcgggaggctaaggcaggaggatcacttgagcccaggaattcgaggctgcagtgagctcagtgagctctaagggcaccactgcactctagcctgggtaacagaaagagaccctgtctctaaaaaaaaaaaaaactaaaaataaatttaaacaaataaaataagtaaataaaaacaaaatcagtaaaaagttactgatttcctgtaggaaaaggcagtgtttctgtgcatttccccctatactgaagcctgttttgtgctgcaagacaagcaaagaaagaaagaatttaagaaacagctgcaaggcagaaaaggggacatactgcgtgaacagagagatgtaaaacaagcactgacataataatacactcaaaatctaagggaccttctctcctcagagctctgcacactactgtagggtttttagatacagatttggcttcttcaccacttaactcatgtctccagcttctcaaagaaggccaggcatggtggctcatgcctgtaatcccagcactttggaaggcctaggcgggcagatcacgaggttaggagatcgagaccatcctggccaacatggtgaaatctcatctctactaaaaatacaaaaattagttgggcatggtggagcatgcctatagtcccagctactcaggaggctgaggcaggagaatcgcttgaacccaggaggcagaggctgcagtgagccaagactgcgccactgcactccagcctggtgacagagcgaggctctgtcttaaaagaaaagaaaagaaaagaaaaaggaaattagtgttgttttaaggcagtctcctccactaagatcagaaagtctgcttgacaacttacccccatcagccagtctatttcaactgctgcataaattgcaaggcagaagaacaaggccaggtgctcagaaatgcatcactgtcttagaaagaatactggctctcatttattgggaatctactatgtgccagatactacattaggttttatagtttacatttcaagttagctgctattttatagttgaggaaagtaaggctgaggggttaaatggcttggttgagatgtcaccactccaaaaaaaatcataattcatattcactaagtgcttcctatgtgccaaatactgtttttaagcaattacatgttttatctcattaacaggtaagaagaagtggctgaaagggtgctaactaacctattcacaaagtcatgcagccacagggtaatgtatgctagcactttcctctgcaccacgctgtctcttgctacagaggtaaaggaaatatccccagctgtgcctctggtcaatcagcaggggctctccagtaaataaggaaggactgaggctttgatcaggggttgttgctacctttctgtctcctgcaccagaagaaacatccatgtgcaagaccaggacctgcaggtcaaggaaacagcatctcgatggcctggctgcacagccaggagttgtctaagtggacactccaagcacagccatacctctctctgctgtgaagcagcacctcctccatgccacccctaagacagctttgcttccctttgtcatcaggtcccacattgcccattgcctcttttactgcccaaggaaagcacagttctgtagccttaaaaaaaaaaaaaaaaaaaaaaaaaaaaactcaaatctgagtctggtttaaactctagaactttatcatttcttcttttgccaaatagaaaacaaactggtaggcctttcagcaaaggccagccaactccatccctccctaaacaccaaacggaataaaaagcacttccctggagcagtggcagccattggtccatgatggggaggagtaatttatcactgacattgtttagaaccaccggcgcatgataataataaaatgcagaccagcttttatcggcttcattattgcttctacattctctacagaccatgcacatgccattactggctgcactcagccagctgctcccaccagcctctgtccccttgccaggccactgcctggaaggctgctctgatgctatggcagccaatgcctcagtcagaaaatgcccactccccagatacctcctgggtggcacacaagaaattgcctggatacttaccagatcagaggtaaagatttcactttttaaagacaacaagttcaaatgcccatcagactaattgaaatgattaggggaaaatgaattgcattctctttttagaaagaagtgcttaactttcacttatccatatcaacttacaactgtaattgctcttatatgcacagaaatactctgtctataaatccattcactgcaaccatatggccaacttcagaaaaaatgcagttggcagcaatctgcacccctagctgtccctaaggccaagtctgtagtattcttccctggggacttttcttctgtcttcccagagaagattagtacatcactgtctgtggcaaccagctcccctagtttcttcaccaatgcctcctggagaggggccccacaggccagccaccaaggagaaaaaccccttggggaagatctaatgggaacaagccccagacacctgggctactctctttccctggtgcaggtcaatttccaattataaacggatgcagagaaggtttttacttacttgagctggatttcttgatctgctgtaatgttctcagaactttgcgcatgtccttcatgctggtgtctttctggctgtataaaagaagcctccgagcatctgagaacaggcgagccacactgtaaagggtgcaagaaaaggcgaaaggctttagctaggccaactgcctctgctgctttacagaagtgactgccaagtgcatagaactcagcctggctcccaggtcctccacaggctggccctaacccactcccatggctccccacacccagctccattcatcaccatgttccctcccccacccatcatcactgccccaaatgcctttctccattggtctacacacccaaatcttaccacccttcaaggcccggctcatcatgcatgtgcacacacatgcatgcacacacatgcccccagggccaacttatccatgaaccacagtaggctcagtggcctgggcctgggatactcttaagggcatattagaatgttttaatttattttaaaagcagaattaaaagttaatacactaaaaatgtatgaataatcatgaatctggtctggattatattcatctttataccaatgcagtcatgaaatataatttttaatatttgtgtatggaaggggcccatggaggctacaaagccagtctagggtccatgaacatgacagtgtggccctgcgtgccgcagctgcagcttcctcaggattgtcctgagccacatcccatcgtccttactccgtcctaactcacatcacggtcctgtgcatttgaagaatcctcaatgtctcatttgggggacacttattatgcccatacttatgtccaggcactgaagccaggagccaggaatacaaagggaaggggcagcatcctgctttgctcagggagctcacactcaggggagaaagacctgcagacattgtagtctgatggggcagtgacagaggtgagagaggtgacctgatgcagagaagacagaactcccctagccttggctgtcagcttcttatgggcaaggacccttccagcatgcatctttgtgccagcccctaccctctagctcctagagccagcccattcagatgcacgtctgctgcatgatatcattaacaacatatagtatattccaaaatagctagcagacaggacttgaaatgttcacaacatacagaaatgataaatactcgaggtgatggataccccaaataccccaaattctccaaaattctcccttccctcattctgcagactctatcacacaagcatttacaaaaacaacttcacttaaatccagccattcaaaattctccagaggacaagaaaggaaggaaaaggattaactgacaagtttggaaagaaaacctgatctgatacttacatggatttgttaaagtttccaacaactccgggagcctccccaggagtcgggtaacggaaacaggggttgttggcattacagataatcccctgaacccaaggaagtgttcctgcagagggcatggctttatttggaaaatggcctgttgaaatcgaggagtagaaaaacacagggagaaacattaattccctgaagcgattttgaggctccatttatacaatgcttcatgccaagtctgtccgtcccattccccacatcccagagacctgtctcttctgaataaaactgactctcaggtggaaacttggcctcacatgccattcttaatctagtggacatcatctgtagaatggggttcatgataccagcgttggagaagtgatgagaggggtcctaagcagaaagtccctggcatccttagttcctctttgacagccagcctcagctctcagacatagaggggacttggggatgccctaagcctattttttcatactctaaggaggtaactacggtaagatgaagtgggctgggcacagtggctcgcgcctgtaatcccagcactttgggaggccaaggtgggcggatcacctgaggtcaggagttcaagaccaccctggccaacatggcgaaaccctgtctctactaagcatacaaaaattcgatgggcttggtggcaggcgcctgtaatcccaggtactctggaggctgaggcaggagaatcgcttgaactcaggagggggaggttgcagtgagccaagatcgcgccatttcactccagcctgggcgacaagagcgaaactccatttcaaaaaaataaaaataaataaaataagataaagtgactgacaaagaacactcgcaaagtcagctggcgtgactgggagtagaacccccatctccatggtcccaatccaagcctcttcctcacacctgcggttagattggaatttagctcatctcaaacccctctggtactctcctccatctgccaaacatttgtcagtttcacctcctctgccagctacaaagctcctcaagggcacctgaaaaacacacaggcttggggtctgatgtcatctgtgaagcttcgggggttttgttgttattattgttgttttgtcactaattaaaacaatgaggccccatgcactaggtcatcctcttgctctcctctttctttcttacaatgagcttcttaccaaaaggatgatgggacatatttgggcttggtcctaggattcggtctggcacagtttggtttgcggccgtaatacatggatgctgcttatgaggatcaagattaataggccctggacgaggggctcttaacccaaggacctgttcaggtatggacagaaaggccagagctcctgcttctatcatattctcagggctatttgtgaccccaaaagagttcacagttatcaagaaccacagctctaggtggtgaagaacaagtagcttcacaggctttggagtcaaaccaattggaattcacatccagtccctgcagcttgctaagcagtgactttagccaagtcattgaccccataccctcagttttctcatctgtaaaatggtgataaaagtacaattaacttcacagagctgtggtgagcatcgcatgagaccttgcaggcaaagcgtttttgcagagtgcctggtgtaggacaaagactcaacaaatgagcctatgaggattttccaggcactgtgggagtgaatctaccccagcacttactctgctgttgcccagcaggaacactccttccatctcacagctaccacctccctccaaagtgggaaccttgttttattcatctttttattttcatgcaaatgggctgagaagttaatccaaagtcaggacttgctgcactttgcatttcaatatagggtctttctttcttttctatccatactccaaccagagaggcaacacccaaagcaaggatgtgataagatctgatcactgtggccaccctctgcagggactctggcctattgaacatttacacagttaatctccctatcttcctgttaatagttcaaggaaaaccaaacaaggccccttgcctaagtcagctgctcttcattcagggagatttatgtaacccaaccaaatactcaaaggaccaaaagattctcccctttcaatgccaggagacactggcactgtagacagactggcataggtgaaaagcagcacagggcagtgatggtgaaggtatttcaggttatcccttagcaggggtggcaaaggcccttccttgtacgttgtgccccatcctatttgcaaacaaaagtaggatcaggactaggcagtgggtgtacaggaagacaagtaaataatataatgggctctcaggacccagggaagtttttaagaccttgataactctggtttgaactggggaagatttacagagaatttcaaaccagtcctttgttcctagggacaagacacctctccaagtttcaccttaacttttaactctgctcttccaactaggtccctggagggtgatgagaaaagaaggtaaggttgcaagaagtgcatggatatggccgggcatggtggctcatgcctgtaatcccagcactttgggaggctgaggcgggcgaatcacctgaggccaggagttcgagaccagtgtggtcaacatggcaaaaccctgtctctactaaaaatacaaaaattagccggacgtggtggcacatgcctgtagtctcagctatttgggaggctgaggcaggaggctcactggaacctgggaggcagacattgtagtgagcggagattgcactactgcactccagtctgggcaacagagcaagaccatctcaaaacaaacaaacaaagaagtgcatagatgtaaggaaaagtctcatttaccatcagtatatacaagaatttcagaacttttctgaaaatttatgatctggagtcagaggaatctaggttaaaactcaacaatctgcccaagatcacaacctcggtgaagggcagaggcaggatacaaacaaaccccaacttgtctgatgccgaagacatttgctatttccactacaccatcttgcctgcttgtaatcattccagaaaatcattcgtctagtagatgaaaaaactgagtttgcccttgaaacttatacttcagtggtgcttggcataatgcttaaataaaatctaaaatgtatttgctcatcaatcaaaaaaatctctttggggttccaaaagagaaaacagaattatctcacaggcatataaattgcatataaatttcagtttatgcttttttttttttttttttttttgagacagagtctcactctgttgcccaggctggagtgcaatggcgcaatctcggctcactgcaacctcagcctcgcaggttgaagcaattctcctgcctcagcctccccagtagctgggattacaggtgtgcgccaccacgcctggctaatttttgtatttttagtagagacgaggttccaccgtgttggccaggctggtttcaaactcctgacctcaagtgatccacccaccttgacttcccactgtgcctggcccgctcttttcttttttgatgaaatcaggaaatcacgtctcagaaaatgtttcttgaggggtgtgtgtgtgtgtgtgtgtgtgtgtgtgtgtttaatatgactatgtgtgatgtgcattagaaaatcagcaagtaaataactgttgctatatattgtgagaaagatgggaccaggccaagaaacacaattaaaaggtggccctggccccactgctttcctggaagaacagtatctcataagcttgtgggtctcgtaggggtatggactgagctgcttagtggtaggaaaaatcactagggcagtgaaactgaagtcccagctacatttcccagctacgtaaatgttgatcctttagatctggccatttctgcagtgtcaatccacccactgagcccagccctaagagaaagactgtgattgtaagatgatacactgacaataataatatgaggtaggtattactattctctgtttaaaagaaacttaaatcacttgtccaaggtcatatgcttagtgaatgctgacaccagaattcatacccagataacctgacatctggagcctgtgttgttagccactactgtattttctatgctcactgtaaaggctgttatcaaaatacatgattgacagatgatctgagttctattcaaggttgttatgagaataaaataaaataatattagtaaaactgagaagttctacacaaatgctgcttaaaattctgtgttccatgatttgcaatgtgtgattaagacatcatgcatatggaaaagactaggtgttaaggcattatcttaaatgtgcttttaatcaccactttctaaaattatcagtaaggttattctattttcatgatttaaaatgtgtaaaagagatgttgtctactgttataattacaattatcaccattcactaggactgaaaacagtctcctgagttcatgccttatcaacaaattagaagcctaggttttctgatccaaagcatgtgtgatgtttcccaaagacagcatctttggaaaagtccaatttagcccacgttaattgcctggattttccctgccattggtgagtctcaggcaacatccacagttacttacattcatgttgttcatagggtgggtagctcagccgaacagagatcaggatcaggaagataaatagaggccaggccacttccagcagcagctgacactgagtgggaaataagatagaacactgtaaatttaaaaataatatggatatccaatgccactgggatctgggaaatccacagacaacttcatttactaattaatcaacttctccagtctctcccaccactctctaagctttaacagaactgtttggagtcccaaccttttaacataccattccatatacctctgtgtcttcccttaggtaagggaagatgcttcctatcgtgctttatctggttcacttctattcattcttcaggattcatcgtggcataatttcctttactaaaatctcagcctgagctagaagccctcctcctgtgctactccagtaacccaggcacactcctcctgtagcattttcctggagctcctgaaatcatctgtttctgttgctggcttcctcagcacattgagcactctgaaagcaggcacccatctgtctgcattcccagccttagcatagtgccaggtatgtggtgactatgttgagaggagaggaccaggccaacctgctgtgctaaatacacacaacccttgctcctctaattgcacacaaagctgctccctatggggcagagaagagggctctcaaagacaatgaaaattcacacatagttccatattgacctgtgtgcactcaggactgtaaagagagagtgcaaagtccttccccatctgtccaggtctggtcatcatcttctccgatgagttaaaaagatcattgaacttctaaacaagcatgatacactggttaaaacaatgaggtttctccaaaggaaaaccctgcctcagtgagttaccaggcgataaattagcagacggacaagatggaaatcactagacacaatataattgagccagtagtgttcagacaactagttacactgcctgaagtctatcacctctcccattcctttcatttctatattccaacgttgtaatcaagataaacaccaaagagcccaaaagagtcacagggccttgtgtttcagagtaattataacttacaactgtggcttcagagtcacacagccaagataatactggtataaaatccctttttgtcttctttttttaaaaaaagcaaaagattgggctgggcacagtggctcatgcctgtaatcccagcactttgggaggccaaggccggtggatcagctgaggtcaggaattcgagaccagcctggccaacatggtgaaaccctgtctctactgaaaatacaaaaaagtagctgggcatagtggtgggtgcatggaatcccaggtacttgggaggctgaggcaagagaatcgcttgaacccaggaggcagaggttgcggtgagctgagattgtgccactgtactccagctggggcaacagagagagactccgtctcaaaaacaaacaaaaaaaaaaagcaaagatttttttttttgagacagggtcttgctccatcgtccaggcggtacgatccggagatcatagctcactggaacgtcaaactcttgggttcaagtgatcctctcccctagggctcccaaactgctgggattacaggcgtgagccactgcactgagccaaagcagaaattttttcttgatcttcaagtccttatatttttatggaaaatttgaaaataaaaaaatacagaaaagtttaaaaaggtaaatataaatcaccttaatcctacctcccagagacaatccctagtaaactgaagtaacaatggatctctgttaacatcttttgtcttttttcatgcatacataaataatattttttctctacaatattgagactatgcagcatatatacttttgtattctgttttttcatttaacatcatactgggagagcatttcccatgacataaaatataatcttaaaacatgtcctgtaatgtctacttgatattccactctatgaatagatcataattgaacctttctgctaggtgctcgtgcttcagattgttttgggtgtttttatttatttatttatttgttgttttatttctgatatttttaaaaaactgttttttatttccaaagacctttgatatggttctacattaaactcttttaaaaaatctttttggcgatggatgcagtggctcatgcctgtaatcactttgtgaggccaaggcaggcggatcacctgaggtcaggagttggagaccagcctggccaacatggtgaaaccccatctctactaaaaatacaaaattttagtgaaacgctgtgtctactaaaaatacaaaaattagatgggcatgggggtgtatgcctgtaatcccagctacttgggaggccaaggcaagagaatcacttgaacccaggaggctaaggcaggagaatcactcgaacccagaaggcctaggttgcagtgagccgagatcactgcatgatcacgccactgcatgatcagagtgagactgggcagaaggaaatacagcaagataatgacagtggatgtactaggatgataagaacgtaggtgtggctggcgcagtggctcctgcctataatcccagaactttgcgaggccaaggcaggcggatcacctgaggtcaggagtttgagaccagcctggccaacatggtgaaaccccatctctactaaaaatacaaaattagccgggcgtggtggtgcatgcctgtactcccagctacttgggaggctgaggcaggagaatcacttaaacctgggaagcggaggttgctgtgagctgagatcacgccactgcactccggcctgggcgacagagcaagactctgtctcttaaaaaaaaaaaaaaaaaaaaaaaaaaaaaagtgatgtttttaatactttcctgtcttttctaaattttccacaatgagcatgtataaattatctcatggaacaaaaaaacactgttaccataaaactatcaagaatagtttgcatagacggcacaacagaatgaaaaataaaggcaaatggatccctctctggaagaaagcatgctgacagtggagtactcaagaccaaagatggggctggtcttgctaatatttctgtaaataatcccaaagaggcaacatactcaaatttccaagcttgggaatgacattcagccttttctttttttttaatagcaaacacctttttattctgtagcttattttttaagttgagatatacatatatatcacattgcatatcttaaagatatacaatttttatttgtcaattatacctcaataaagctgggggtgggggtggggaagaaagcaattttctttctgccaaagaacaaaaccatgactctatgaaaatgaacttttctcccagctgagccaggactccctcatctcaatttccccaggtactttgtgtctgtatcagcacttggtacaccagggaccctatttatatataagcttctcccttagggtcactttcttcttactaagcctaccacatgataatggctttaaaaatgtttggtgagtaaatgagctggtttaaaagataatgaacacggaaatataaatcagttgagccctttgggaaagcaatgttaacaatacgtattcaagagtcatgtttatcccatttgcccaattactattcctggaaattcatcctaggaaactgaacttaagatatcaaaaagctatatgcataaagttattcattcattgaaacattataattgcaaaatattggaaacaacttaattgcatagcaatagggaaatgattcaattatggtacatgtactcaacaatatatcatgccatcatcagaataatgtttatgaaacacagaaatcattagccatgtaatattaagtgaaaaaagcagaatacaaaattatatgccattccaagcttgtagctgaataaaatcacttataaatattaacaaagacaggaatacaactttccttttaaatggcatgactgtaaataaatttagaaaatacttatgaggccgggcgtggtggctcacacctgtaatcccagcactttgggaggctgaggtgggttgatcatgaggtcaggagttcaagaccagcctggtcaaaagggtgaaaccccatctctactgaaaatacaaaaaaatagctgggcatggtggcgggagcctgtaatcccagctactcgggaggctgaggcaggagaactgtttgaacccaggagacagaggttggggtgagccaagatcgctccattgcactccagcctgggcaacagagtgagacttcacctcaaaaaaaaaaaaaaaaaaaaaaaaaaaaaaagaaaagaaaatactaatgaaattaggggaaaaaaatgaagctaaacaaagagtatgagtaagataaatagccatcagccttgaagctctgaaactaccatttgtactttaaggataaatagtagctactgtttatttagggcccaatatgtacaaggcacattttatattaattacttaatttaatcctcaggacaaccctgtgagataggaaacattattgtcttgattttatatgtagcaaggctaaggctggaggaagggtaaatcacagagatagtcagtagcggggttgagatgagcagccaattctacccaactcaggaggccacatgacattctatttgacaccacgggtgactcaggtaggaaatggccccactaggtggaatggtctagaaatatcaacaggatccagagaggtaaaattaattcacagcttgtagatttataatacttacagccaatattgggcagctactgtgtactcaagacgttttgtgtatctcatctccagtatttaattcataataaccctgtgaggtaggttgtatcattaccgttttagaagtgaagaaactgaggtttgaacaagttacgagccataagaaactgcaccaatgtttgaacccagatctactgacacttaagtgtgtgcttttgtacccatcatgctgccatcacaaagctatgtttaggacatataccttttaagatatgccacttaaaagaaacctagcacttgccagccctgctgagcactgatctgacccaattaatcaaggcttatgttcctggatatctctgcagcccccatatctaggatcctgtagggcagcagatgctcaaaatatgttggttgactgaaaaaaatgaatggatcttccccatggcaactgacagcaaagggcaaacaaaaaatcttacaagccatttggagcagctgaagctggtgagtgtaagcagatcaggaaaagaggttaaaaaaaattgatgatgataataataatgaaaggtcttactatgtaccagggttgtgagtgctttatacacattaactcatttaatcatcaaacaatccaattagtactcttgttatacacattttacagaagaggaagctgagattcaaagagttaatacactgcccaatggtccaagattggcaaatggcagagccaagattcaaagccactctgactgaagggctccttctcttcgccattatggaccccaacctccttatgcactttgccttcacttaccagagcatacagacacctgctctctcaaagcccttgctgagctgggagactagcatgtatgagtgaattaaagagactgtctgcaaagttcacaccacctgagccagagaactcatgagagacaaaatttaatctttgcccttttatcttggacctctaaaattcttcccatcattgaacctagaactcaccttccaaacccaggggaatgttccaggtatttcttttcataatagcctccctctagaaaccaaagttgacttctgccaggatatgccattatggctacactcattaataaaatcagatttctcctccttctctaagcttagcacttttcctaaacataaaccctcataaatagcttggaaatgaagttgatcctttaccattataaattcctacagaaaactcttctaaatcttgctttggtgcctacccacccaaccccacacctccccatggggtgggaagatgggaagaaacattgtttttaaaaggcgtttctcaccaaagtcaaagctgctccaagagtaccgaagcaccactttgcacttcccatcttgctatttcaacatggggataatatgagcaggcactgctagagcagattttcttgatagtgaccctactgacatttggggccagataggtgttgtgagagactctcctatgaattctacgaagttcagcagcatccctgacctcaacctctaaatatcagcacatacattcccaggattgtgacaaccaaaaatatctccagatgttatgtccctggtggaagggtgagggtggggtggggtagggggataaccggccccggtcgagaaccactgctctagagttattatgagaattaaatgtatttcacatagaaggcttagcacagagtctagtacttatcatcatgttattcaatatgcatcaaaccactcttgaatcatcattcatagttatgccaacatctcccacactacagatgttcactgtccacttgattattcatgcctgacttttgctgctggctgccgaagttcatagaccacaatccagtcactctgtgaacccatttccctccctagcctgaggacacagtcacggtgctcttaaattcttgagatttagccacgttaattcaaggttagggcagcgcaagggccatgtacaaagaacagagaaaactagcagaataaaattgggccttaggcaagaggcttctgaatcatggtagccaaaataatgcactccgcgctgaaaaatgaagtcgctatttcttagtattgagagattcttgagaatataatgggggataaaaaaaggaaacaagaagaataaacatcagaaaggaagagatgaaaatatcctttctgtttctggcatggtcgtaaatctaagagaactcacaaagttaactaaaaagctgcaaatgatttgcaagtatgggtaagttaatcagaaccaaggtaaattctcctaaataatagcattgctattagtctctgaaaaccagttaaattaatataatgtggggaaaagagaatactatccacagtgagaatggacacataaacaaaaaaacctaggcattaacttagccaaacatgtgcttcttacataaaagaaaaccacagaactgtagtaggataaataaaggaagatgagaattaaggagagctaaactctgcttcttcatgagttcatttaatatccaaatttcccaagctaatttatagatttaacacaactgaacttaaaatagcgatagggtacttttttgagcttgataaggtaataacattcaatggggaaaaaacagataaaaatatcaaaagatattctgagaggcaaaaaggtaagtgggggacaatgagctcccccatatatcagaatgttcatcaaattcagggtacattctgggctctatcagcaccaaaactaaaactacatatcaaatgaccaaatgaataactccaaaattgctccctacacatctttttttttttttttttttttttttttttttttttttcagacagagtttcactctgttgcccaggctggagtacagtagtatggtcatagctcactgcagccttgaccacctggactcaagcaattctcctacctcagccttccaagtagctgggactccaggcaagtaccaccatgcctgactaatttccttatttttatagagatggagtcttgctatgctgcccaggctggtgttgaactcctagtctcaagcaatccccccacctcagcctcccaaagtgctgggaatacaggcatgagccaccatatccaggttttaataaatgtcccaaaaataactagaaaaggaatcactatttaatcaagtgattatttattaaataatcactgggatgacatgatatgaatgtgaagaaaaattaattttagacccatccctaacagcatacatgccaatgagacctgggaaaactaaagtgaaatcttaaggatcacatcagaaaaatgctagagaggggaaatgatttttaaaaccaggcctgccttccctgaactacaaagtctcatgcattgatggtggctatttaaattggttggatcctctggaaagacatctgatcagacacttcaagggccatttcccttcaacctagtaatcctgttcctcagattttggcctacagaaataatacaaaaataataaaagattaaatgtatagaatctttatagtaatttatttgtaacagcacacatggaacaatctaaatgttggcaacagggtttgaacttataaaaactgtgttaatggattactgcacagctatcaggaatgtcaaaggcatcatcccacagtagatttggagccaaaagatcccagccctcctcttagcaactttttattttttgagacagagtctcgctctgtcacccaggcaggagtacagtggtgcaatcttggctcactgcaacttccacctgccaggttcaagcaaattctcctgcctcaccctcccaaatagctgggattacaggcaagtgctaccacgcctggctaatttttgtatttttagtagagatgggtgtcaccacattgaccaggctggtctcaaattcctggcctcaagtgatccgcccaccttggtctcccaaagtgctggaattataggtgtgagccaccatgcccggccattaacttattaacaatactctcttcatctgtgaaacagaaattgcaacgcatacacctcagaattgctgtgagaatcaagaaagtaatggatatcaaagtattactttcaaaactataaaacacagcctacacatcagaaatcattattctaaatcagaagatgatttagaaatatgtgaacacgcacactaaataatgttaaatgaaagaagaaaacagcataaaatggtccatgtatatgtaatgattacaattgctttcttgggcctttgtcattcaagttccctctatcccaagagtcaccagacaatgtggcctgactacctcagggaatcctcttgcacataaaataaaattaaattctcagggggcactgtgggtcacgcctgtaatcccagcactttgggaagccgaggtaggaggatcacaaggtcaggagtttcagaccagcctggccaatatggtgaaaccgcatctctataaaaatacaaaaattagctgggcatggtggtgggcgtctgtaatcccagctactaggaggctgaggcaggagaatcgcttgaaaccaggaggcaaaagttgcagtgagccgagattgctccactgcactccagcctgggcgacagaactagactccgtcttgaaaaataaataaataaataaataaataaataaataaataaataaataaatattaaattaaattctccttccccaggagaattggccctaaatgatctggtcatgtctactaccaactcatcccccgccagtcttattcactccaccagtgccactggctttcttctgttccctgacctaggggacaggcacccccagtctctctgcctggaatggatttccctatctctaagcctctgatctttgcctggctaaccattgcttgaacttcagggctctcagctttaatgtgacaacctgtcaatctaaatgaaatccctacccacacctgctagtatctaacaccagtaccatagtttgccggattttttccttcataatcctcatcacagttgatagttatatttttatttgtgtgatgatatgtttcacatctgctggcctcactgaactgtaagctctacgaaagcagtactcatgcccagctgcttcaccactatatacccagctaaccataccacaagtaatagatgcttaatagatatttatccaaatgaaacaataaatgtctatttgttttaactttcttcattccgtagaagagaaaactaaagctctggagaaaggagttttcctaggccactgaggcagatggtggccaagctgggattggaatcatgaccactgctgccggcccaggagtaaggacagggaagaaatgtgtcaggtgaaactagaagtggggaaaggatgcagagagtttccatctactctgtaaaattctctaaaagctcataaatgaggagttttaatttttggatagttcattctttttcattaaagaatgcccaaatagtggtactctggctgggtgcagtggctcatgcctgtaatcccagcagattggaaggctgaggtgggtggatcacttgaggtcaggagttcaagaccagcctggccaacatgctaaaaccatgtctctactaaaaatacaaaaattagccaggcgtggtgctgtgtgcccataatcccagctacccgggaggctgaggcatgacaattgcttgatcccgggaggcagaggttgcggcgagctgagatcataccactgcactccagcctgggcaatagagtgagactcagtttaaaaaaaaaaaaatcacaattaactattttcccagccacatgactagtcagatctatttgagaaaattaataataaaggcaaaagaaaagaggccatgtggccaccctcactttgtccagtttgttccatggggaccttggcctctggatcagcctaaaaccagatgaggatcgtgaaagctctgaagttctcttccccttcctgtccccagccctgtttgtactgaatacctgccacccacacaagttaactgttactttggacccaaactgagctttgcacccaactttcacaactcaattcaatttattctttgcctaacagaaacagcggaaaactaaccctggctgatggtcccccctcagtctgcacaatgggggtacaggagaggcaggggacccaggagttaccagcaaaccaggacacagaatgaaaaggcaagcactgcctttcaacagggttgctctggggtataccattcagctccaggctgaacatagcgtttctagtcttcctggcggcagcacacaggctttatgtatgctttctattcttcctagtgcaagggagcctcctcaagacctgcaaactaatgggccttaagacatttcccactcattcagtaaatacttactaagcatgtcccaagggccaggctctgtgctgggctctgaggccaagcgtatacactccaggatctcaggagacaggaactgtgcaatgaacatccatacgctgcaggcaacagctatcatggactgctaacttcttcccctacctaatgggcagggctggttctcactatgtgagctaacaagtggccccaaaacccttaagaggttctgacgtctaaacaatataatctagaaatctaagccaggtggattggaaagtagctaccagtcagaacttgagattcagagacatagaagctttagtatacacagagagcaaagcaaaaaagggtctgcaactgtagggccaccaggagactggttctggtgctactttcctgactgaccaactctgggcacctgtgcccccctgagccccagttctgtcagctgtacaagatgcaagccagatctttccaactctaacaatctaagcatcagcaacctgaaataaatcacttttctttctgattcagcaaaatatacttcctttagaaatcaggaagagagttaaggaaaacaggttagcaggcagtggtataacaacttaagcccctttgtgtcagggtgttgcatcccacttccttctttaaaaagaactctgccacaaggctacaaactgcctttggctaaacctgcctatctctctaatcctaacacttttaaacccatctgcaataccaagcaagaagcaacaagaccagtggagtctggcccaatttgaatgacccaaccccacatcctgttgcaggattccttccctggctaagcacggaaaaccttttccctgccctttcttctaacttcaagctgctaagcagctgcaaaaaaataaaaaataaaaatagtttggaggagggaagaaaagtcactgtgatgggacagaatgaggctcggccctagtcctggggatctcagcttctggttgcagctcagttgctggctgggtgacctcaagaaatcccttccctgctttgtacctcagctttctcatccgtaaaataagaggttcagactagactaccccagagccatagcccccctttcattgccaacatgatatgattcttcccactactcactaatggacacacaacatggataaaccatggcggagacaatttcccagcaagtgggccccctctaccaggataagaaggggcaggagccctggatcacactgtagcaaaggaataagagtaaggacggacatagaggactggaacaccaagacctggggataaccacgggaggcagggagaaaggcaaggaaggagtcagaaacttcaatattctcagatggagaataggcaaaataatgacaccactgaaaagcgattaggcacattgagttagagtgccagctccaaagtcagattatctggatttgaaccctacctgtgctccttgttagtggtgtggacctcagacaagttacttaacctctctgagtagcacgttccccagctacaacatgtggaaataacagtacatcgcggggccttaaaaggaataaatctagttaataatgcctaatcagttagtgcctcacacatggaagctcattctaagtgtttgcttttattttattaatataatattatctattatactttacaattattattaaaacagataggatccacagattccagtccctgttctctcactagagacctcagaattcaggttccccatttgtaacatgagaggctgaacacaatcagtttttctcaaaggaagatctgtatacatattgctgagggattatatttaagttctctaagaggattttaaacactttgttttcatttcaacagtcatctaaacaaagtctaataaacacatatggattttttaaatgcttactttaaagccaagttctggcacaagatttcaaagcccaagtttatatttgtgtttatgattgtgttggcaccagtataattgtagcaaactcatgaggatggaacaggtgccatcaaattaaggtcatacaagtagaaaaatgggtggagaattcaatcattagcacatgataatatagactggccaaactcaaaatgatcagcatgatagcatttactgccatgcaacttataatttggtttcagttgaacaacagctgcctcaccacatttaaggtattaatttgaatggtattgattttgcaattttggctgcacttaatttgtaaatatgtatgggtcatatagttgtataataacagcctataagaagtttatacctacttttacttcctaatatttaagtaacactataataaaaaaggaaatttagtgaacaaaaggatgctttgacacttttgttcttttacagacagtgcaagcattattctagtttgaggaaaactgaatgaaattctctccaaagtcccttatagccctttgaatctcagaaagatgatcattttgattacagacatgttaagctacattaagacagccaagtggggatactggcttagaatccaggaaaaaaaaataaaggcagaacaggaacaagagacttagaaactaactacagagaaatgcatcctagagatgggatctctaaggaagggtgttcagagatagagagacaaagagctgacgtctgagtttcagggagttcactctgctctacagccctcacatccctctgtggaagagttccattcacctgcgcattaaagatgatctccagattactcaaagcattattggcccatctgggaagtgaatggcttagaaccctctgcagaaataaaacaagtctcagttattatattcctccaggcctgaaggaaagaatccagattgacaccaagatacccagtattgatctctaagagtggggccactaactcacttcacccacagcttccagaaatacaggggcccattaggggcttttggagagccaggtggctcccagggctgcagcaaaaggaaaaagtggggtgctcaggggcgattcggagccaggtcctagggatcagaactcatgcctgggcagtagcacaaaccaaagctactatttctacctggctgcaaatctgccctctatgataagccacatgccatatccggaccacacagtcctgtgtccataagagccagattccatcaatccctgtgtgaaaaccaacacagcttccttccctccctccctcctccaatccccaactcaaaaccacaaagaaaaaatgagagaaccccccgctgctgaaaaacccaagcttactgtttgtcttcttctgaaagtgaggttcttccacagcagcaacctcagctgaggccaacaagccatgttccctcagccagcacccccagcgtgtggctcgggagccctggaaggcagcggccagagctcacagcagggacgccgtggctggtcattaactgaaagataaagcaggaggggaaacagccatcagttattgctgcaaagccatacaccaatgaggactgctaatccagccctctcagctgagacctccaacacacagctctgcatcatgactgcttctcaatggatcatgagtcaccagctcccagcctctgggttcacccacaaagagggactcgggaggtgttccgacagcaggctaggagctacgtgttatggtcctaatcattttagttctatagatgttatcatctgggaatgaagaatgcatttctgaaaatagacctctctcaggtggccaaaaacactgaggatggaaatggcatactggaatcccagagacctacctctcttttctaagaaaatgcctccccttacatacaaagtcagcagcatttgtaaattttgcctcaagcctggagtgacttatactattccctgaacttccttacatactaattttcagtgggttatacaactgagtccttcaaatgataaaaagcaccatcggccaggcgtggtggctcaagcctataatcccagcactttgggaggccgaggcaggcggatcacgaggtcaagaaatcgagaccatcctagccaatacggtgaaaccccgtctctactaaaaatacaaaaattagctgggcatggtggcaggcacctgtagtcccagctacttgggaggctgaggcaggagaatcgctgaacctggcaggcggaggtgcagtgagccaagattgtgccactacactccagcatggcgacagagcgagactctgtctcaaaaaaaaaaaaaaaaagcaccatcaataaagcagtttcctaatctggaaaaccacaacgtgccttagatgagtgtgagtaaacaccaagaaaatgctaccgacacctggctctcaggtaatgaggacaaccctagcgctgtgtctctggaaagaaaacagcatcccatggagaaacaagtctgctatggcaggctcagggcatcaactgtgaaaccgacaaacaagctcccatggtcagcacatatgcacacttctggccttgttccacctgcacctgaacacaccgcccccctactccgttgggtgtcacaggtgcctccttggaggactgtttgccatgctagggcaagaaggtcttctcgtgaacaagggatactacattctgtgtatcccagccacccatccagcagttacccttatttaatgctggaatagtcccaagtagttatattaaagttaaagctggggagggggcagaagatgaaaaatggaagggaggacacacaggtgaaaattcggccctgctggcacttggtagccatgaactctcctagctgtgcttatgaaatggctcagtgaatcactgtggcctctagaggagtaggggcaagggtagggtgggacactgggcatgaggaacaaggagcagaaggaactaagaatgcagtagcgaggtatggatacaaaaccaagcgctagactagaaatctgtgagtccaaatgagatctccatgccaaggtcagtctctagtagaacaatacccttttatctaccacccaacaaggacttggattaaaacttctagaaaagtcaagagattggaggaaattgcagtgtctgagaagaaaagacagcctaccactatgtattccaattcattcattgacagtccaataaatcaagaaattctctgaaatagtcaagccttaggacctatttcttttccttaccatttgctcagcaaacttctagaaggacacaggcctccaaagtttcttactccaaaaagaggaagagttaaaccagcactgcatcagtttgttcaaagatgacaactggcagcacagcactggcaaccagagcagcattgtgagacacatgcttgtcatcccaaattgttttctaagtggctcaggacagagcttgcattccagagacactgaaataaataattagctagatttttctcatacagaagctgctctccaggaatcagttcgttgatttagaagctacatgaatctcttgaaatccccaaggtaacaatgaggaggggacaattaaaaaaggaaaactatcagaaagagcccaggcatgaattagccccggcttcccaactatgtgcccctggccaaggctttatgctctctaagcatcaatttcctcatggtaaaataaggatgacaatacttaccttgtatggtgttcaactgtgttctactgtggattcaacgagataatataaataatttcccaacacagtacatggcttaatttaagtgccaaagcaatgtgagttcccttctccccatttatctttcttcattccaacaatatcctctagctgagaaatggttatatcctgtccaaacaggacgttccattatttctagcaaatccattgtgggtttctggaaagataggaggggcaaagcagtaaggatgaaatcttaatagcctagtgttgcagtacccagagccaaacccaaatatagaatatcacctcccctaaaccctgagtggaaaagctcaaaggaagagaagacacacctctacacaacgttcatgagaagaagggaaggatgagttttcttggacagcattttcttggaagtaaagtgtctgggtttcaagaaaaaggttctgactccaaggactctccaggaagcacatggagaaggttgctaagaagtagcatagagccacagtagaaagttctaccgtggctttgctgggcacacttaggcaagcttcctgctccaattcctcccacccaccttggcactgacctggcctcctgcacaatttgctcccccaactcagaacacaatgatcaatactgggagcaattctgtcctaagaggagagtttggcaatgcccggccccttctgctcaggtaactgaagccaaagggacatttccacatcagttttccaagttagtgaacaaacaaaccaaaatcaaaaaaaaaaaaaaaaaagatataaaagagacagtactatgtactagatttctcaatgtttcaaatgcagtacactcacttctgccctcatacacatttccagttactggctggaaaggatcccacttcacagtcatcccagtcaataggccactctgatcctgctcctagatgaccgcaactgccacctcactggtctcccaaccatttgtcacagagcacccaaagttactcagctagaccaaatatctgaacatgcctctccccgacttaaaaccttttgccagctcctcagcacctgaacatagagtccagtgctcaccaaggtctacctggcctcccttctgtgactccagcctactctcttgccactccccacctgctaagcaatgccctggagatgtgtatacaggctcagaatatgctgcacgctctcctaccactgggacttcactggtgagttctcttgtcctaagacactttttcaagcactgctagcctggctaatgcctaggtctcaaacttaggtctccacttcttcaatgtcctttcctgatatcctcccctgcaactgacacgtgggttcagagcccttcctacgtgctccctaggaagacttggctgggaaagaggatttctaccttctgagtcagagcagagaccatttctgtttccttcatccctgttttccttagtatgcaaaagggtcctggcttgtcgtaagcacttggggatgtctgcttaattaattaagagacggataggagaaatagggtgtcagaattcaagggtggcagcactcctggacctgtggtaactcatttctcaagcctgattaaatgatttgggcaaattatccccaaagagggagctctgtgttcagcagcttctaccatatgcttgaaagtcacaaaggactgctgagcttcccaggtgactcctgggacatcctgaaaaacgtaatagaatctaagtctgtttcccataactgccagctttagctaaggactgggcagcctcccaaggccagcagggccatgcagtcgacttcccgcccgtcctcaccctcaagcccgaggcgtacgctctctgggtctcatcagtcacccaagtggatcactccttgccaaaatgtgacaatctccacacctcagccttgtttcatacagtttgggcatggcagaagtgactgctggaaacctttggccaattttttaaggaaattttaactgcaaatgccactgatattttgaagttattaatatctacagaatacaacagactgctaaattaaaaccttcccaaataagcagaaacactcatcattagctgcagagaaatgcaaattaaaaccacaatgagatatcattacatacccactaaattaaatattaaaagtgctagcatgtgtatggagacactgggactcaatacactgtggaattgtaaaatggaagagccactttggaaaatagtttgacagtttctgctaaggttatacagtactattatatgacccagtcatcccatcctaggtatttgtgaatatttatagaagccttatacagaatagccaaaaactggaaacaattagttgtcgaaaagaccatcaactggtgaataaataaaactggggctgggcacagtggctcatgcctgtaatcctagcactttgggagccagaggtgggcggatcacctgaggtcaagagtttgagatcagcctggccaacatggtgaaaccccatctctactaaaaatataaaaattagttgggcgtggcggtgggtgcctgtaatcccagctactcaggaggcaggagaattgcttgaacctgggaggcggaggttgcagtgagctgagatcgcgctaccgcactccagcctgggtgacagagtgagacacctcctcataaataaatatataaataaaactgggacacttactcagccataaaaaggaataagctactgttacatgcgacaacctggatgaatcccaaaagcctaatgctaagaaaaataagccagacacaaaaaactacatactgcatgattccatttatatgacattctggaaaaggtgaaatgaaggggacagaaatcactgcagtggtgaccagtggtcatgggtggaggggacgacagactgaaaaggagcatggcagtggtagatacacatgtgtatccatttgtcaaaactcatcatacttttgtaaaggggaagtcttactgtggtaaattacacatcaataaatctgaaccaaataaactgccttctattatcataattaacatacctcacaagtcataacttggaagacctaagaactggatagtgtaaagcctgattattgtgtgatcgccttggaagaggaatagtagataaatattcattaccacttataaattccacaaacaactgcagccttaactctgcaaggtgcccatgagccacaacaaatatttatcgagtgcctatcacatgccaggtgtgttccataccttagagattcagtggtgaacaacagaagcaaagttccttcattcatggggctcctattctaccagggatgggaaacagacaaataatagtgggttgttcaaacagtgggtggtggtggtaggattgacgaagaaaaataaagcagagtaaggggacagagagtaacggggtggaagttattcctttctgatgaagcatctttaggacaatgaactgagagagtggaccatatgctacccacaaaggggtggcttaaatgacagctgggattataaaattacttttacttttccctaaaccaaaacctggaataccagacagcagacagattcagtgatgctggcaaaagaaatacacacacacacacacacacacacacacacacacacacacacacacattcacaggaagctggctgtgaagggggaaatgatgaccctagttagcacctggcacgtgttctcccacctcttcctcaccaaaacattgtgcccttttgaacttgacatgcacatttccaggagagatgagagatgagaattataaagaagaagaaaaggggagagaggatgacactaaaaagacaagataggaggatttttccccatttggcatagccaaaagaaaaacaggaactccttcccgtgactgccctctactcttctacagcactaaatctgtctatggaaacacagtgaggaaagaaagtgcatgtatctgtacagctaccagaagctgtttgcttgtgcagtaacaaatgggctggctggtctttttccttcccgcaagaacactgccaacacatgagctttagtgctgggctcctatcgaagggtgacagtcagccctcatgcctgagccagggcaggttccagaagagggaagtctccaagcagggatcatacaagtgtcaacatctcactgggacagagaaattggcccctctgggtggaagaggagaggcttccacaaagtcatgctccatttgactgtcgtattagtagataaaatctcttggaatgttgaagactcattcccactacacccctgctgcaatcttatagacagagaagctgaggcctcccccaaagcaagtgacttgcctagcattagagctggtttctcaagaaataactttttcaacaactcttatatgccccttcccacttagctatttctcctatgattttgtttgttgttctgaatgcatttctcagagttctatccaaatagttcacatacccaaaatgtacagatagcaactaattctcctctttcaaaaacagtgattatatgacagctatttcattaaaccttaaacaaacaagagagtatgtgtgtgtgtgtatgtgcgtgtattccactttgttcaacaaacttccaaaaagttaccagaagtgagatggaagttgaaatttccaacaacagctatcaatatctctcttttttattactttattttattttttagatgtaatctcactctggtgcccaggttggagtgcagtggtgtgatctcagctcactgcaacctctgcctcccaggttcaagtgattctcctgcctcagcctccggagtagctgggattacaggtgcccaccaccaagcccagctaacttttttgtatttttaatagagacagggtttcaacatgttggccaggctggtttcaaactcttgacctcaagtgatctacctgcctcagcctcccaaagtaatgggattgcaagtgtgagctaccatgcccggcctcagtatctctcttgatgaggttgcttctagatgtctttttcgtaattgaggtataatagacaaataaaaatgttatatatttacagtgttctagatgtcttatatcaaaaacagcttgccagtaaactacaaagcaggaggtggatttaactacatcagatatgaactgaaaatacattggtgccaaagctctgattgcctattcatgagatgttgacacaaaagcaagaatcacagatatgactcatgtgcctcatctccagagagatgcacagggtcctataatattaggacatgaaacttctaagcccaacagaacatgcttgctttggaaaaggtctgttctctaattgcctctctgatcatgtgtctttggatcggtagccacgttcagggacaagcctaacaaggttactgaaggccaagacacctggaaagaacaggttcactgcacccatgattaaagacagacagatcgtggctgctgtgggggtgggaggggatattgagagtcatcctgcaatttctcccaggctgacccatcagcttaattgagcctgaagctaatctgactgcctcagtttaacttttctggcctccagatgctactgggccctctatccttaagggtatccttgctaggacagccttaaattatacctcctcacactcctgaaacattccataaaccacagttccagggaaactaccttgagttagggggccttgcagaagggtcatgggctggtactcccccctgaaactgtgttcctatttttaaaggcaacattttaatagtcaaatttgagaagccaaaaggggtaagaaatcctccaaggtaaaagtcaaggatgaaatgaagttatccaatcattccagaggaattctatcattctataagaggttctgctatcacactgtccgtttaaaaatatatagatccagtgaattttattaattccaataatctgtaacttgggtgcagtttttaaagtaccaaatgcatcacacttacttgattgttagttacaataagataataggtaactgtacttccttctttcacttgaatacacatccaatttcctagacaaaattattgctaatagctaattttcaaaataagggctatgaatttgtaaaaactgaaacaagaaatctatgaatattgtacaaatctataactagcttttgagaagcataattcttcatgttgtcaacaatataattttacaggagatcctgaccgggtgtggcggctcatgcctgtaatcctaacaccttgggaggctgaggcagcaggatcgcttgagcccaggagtttgaggctgcagtgagttatgatcatgccaccatactccaacctgggctacagtgcaagaccctgtctcaaaaataaacaaacaaataaataaggagatcctaaaggtttaactccatctatatcatgtcactgatacttggacaaccaaagatcctatttatcaccctcaacattcccgttgccaccagctaaatggtctcagggcttctaaacctcacaagagccaggatttctgaaagcagatctgtcctgtaccccaagtccttgtttcatcactatagaactacgaagaaactctaacaaaatgttagagatagcctctcttcccctgctgatttccactaagcaaacaccaagcaaccttcaaaggaagacttcagcaaacaataccactatttgccttttccctggtcggggggtatgtagcacatagaaaaaaagaatctttcctctagaaaagaaatcaacctttcaacattctatgtcatagaaaaaaaatcaatttttttcagtcacaatcataacaccagaataaaagggatctgaagggaagggattagtgaattcataaacaccctgagctacagaaacacaagcaggcaagcctctatcagcaaccctttatttgcagaaaaacttggctggataatgttccctgctgttataggacggttttccaagagaattttgggataaatggtttagtgaccatatcaccaaagatcactttgtttggattacatctctgaagaatcagtgtcttcagatgttcaaccttctcccaacctgaaggatttatatttatgaaagtgctcaaagcatttggtggggcagacaaacccaaatcttagtcactgtctttctttcttttcctttgggtctattctaccatgcagaaaactccccaaatccttaactcctttgttgtcttgagttaattgtttcagcaggaagaaaggaggttttagagtcagagaaagctgggtttgaatcctgactctgctactcaccagctctggaaccctagggactctgagcccctgtatcttctccaaaaaatagaactgataatgtatgtaaaacatttatccagttcctggaacaaagtaagtgtacagtagctattaccatgattaattctggcaatttcacagtgaagtattcatcaagggtgggacacagagtgggtggtttattaaaggaatctcttttctgtattctttgtccacagaaagggcctttccagagcaaactggagcgctctccagtacccagtgcattggtagaggtgaaagcattatacggtatcctgttgccacttctgaccattgttttactataaaaccccctcttgggggtcctcaccactcacttatactattttctctacattctcacagaggttgcacctatcctccatagcacactgccacctccctacaagtttttattttattttatttatttatctatttatttatttagatggagtctggctctgtcgcccaggctggagtgcagtggcgcgatctcggctcactgcaagctccgcctcccggcttcacgccattctcctgcctcagcctcccgagtagctgggactaccgacagccgcctgccaacacgcccggctaattttttgtatttttagtagagacggggtttcgccgtgttagccaggatggtctcgatctcctgacctcgtgatccacccgcctcagcctcccaaagtgctgggattacaggcgtgagccaccgcacccggccccctacaagtttttggcacctgactcagttttcctgtccatcccatttcctccagcctctatgtccattagaaatctctattagaaatctgagccttggccagacgcagtggctcatgcctgtaatccctgcactttgggaggctgaggcaggtgatcacctgaggtcagaagttcgagaccagcctggtcaacatgataaaaccccatctccactaaaaatacaaaaaagtagctgggcatggtagtgggtgcctgtaatctcagctactcaggaggctgagccaggaaaccatcaagtgagaccatcaagtctcacttgaacccgggaggcagaggttgcagtgagccgagatcatgccattgaattccagcctggacaacaagagtgaaactccatcttaaaaaaaaaaaaaaagagagaaatctgagccttataattcctccatcttttcagctctacctacaatcttctctagtgtactaactcatcagtgatccctgataaattaagcaatgtgcaacaagctactgtgtctcaccatcttcctactctccactacactgaacccacaatgacgcagcgctccacaatcacatgtagaatggaagtaaaacctcagcgataagaaaagatagttaaagcagattcactacagtaacaaaccagtcaagaaatgtcactgaaagtaaaggtttgtgtgacaaaatttccagctgtgttctaagaaacataagttcaagcaggagtgcatttaatctgatttttcctcaaagcctctctaatttgtagggaagcacattcattttcattaacttcatgtgagctagagagaatctgtgattgaggctctagaacccctggtaaacatgccatcaagcaagggcaccttccccggaggttcaacctagagtataagattgtcagcactggtaaagagccttgaactctaaacccatagataggctcaagtcaggaactcagggagcctataaacacctggatacaattttgccaccttaacacttttattccctttacttgcgccaaactgagttatccaatctccaggctcttgtccagttctagttcatacagtatcggcagccttctccagaacgtcctttcaccagccagctcttgagacagtcatatgtcatgtgtgcaagacacttctatttctgcagcccggcgagggccagctaactcggttagtgacaatttaatcaaagttccagggcaagcacagagacacagagtctaagtcttgccctccaaaacttacaagcaaactccttctttagaataaccaaaacaaaccctctcgctggctgcctcactaaattaagagaagaaaggggaataagatcacaagtttaaatccacttacttgtgattctgaaaaacaaaaacttaagggtgtttttctttaaatattgactacatgaactctattatatgaggtctgagaggatcctacaaaaggatctgtattattccaatattatcaagattctgagtgttccttatagaaaaaactactgttattaagattttcacaaatcaaacattctgtgtgccaaagaacaaagtgggaaaaatggaacaaaagtgggaataattcccaaaaatggaattattgggtttcatttttggtagcctccttctgtcaactgtagttttgaaaaattcacacaatccaatcccccaagcaacaacgcgctaagtgtttacatcaggtgagagctggtgttggtcacatatgctatgaactagaattggacaatgtcccaaaacggagtgccatctggggtcagagtgccatgcccttctctgcagactccagggacatatccactctgcttaatggaagccactggaaccaagtgtcagacagccctctatttgctccacagagaagaaagccatgctctgatcatgtgaaatgtgactggaattgtaaactgaaaaatggcactaattccactaaatttgcaaatcctgcaacaagactgacaacttaataaacaatacttgaccaaaggctttctttctcgtgaactcaaggttttcactataattaacacaatcattaaagtaaaaaaaaaataaaaataaaaaccctgccttgattcacagttaattttaagcagccaacatcaacatcgggtttcaggcttttgcataaagaaacagcctttaggaaaccctcaacattcaggattttgttctgattcaaacttacaaagaacaatttttagttgagagaaacaaaaaattccagttgaaagacgccttaagattcaaattggaccaacagacaggagaaataaatgaggccagtccaatatttaacatttcagtgtccattttaagctgaaaggaacagacatctacagacacaatttcttctttctctcctataaagggcactgtaatagttatcctaaattctggtatagtatgaagaagcctggattaaagaggcaagagactaagattttaatttgcagttaatggcagctggagaataaatttagcacgccattctaccactgtgggtaatggaacagaaaacaagtccttttttttgtttcttgacacagagtttcgctctgtcacccaggctggagggcagtggcacgatctgggctcactgcaacttcagcctcctgggttcaagcaattctcctgcctccacctcccaaagtgctgtgattacaggtgtgagccaccgtgcccagccagaaaatatgtctttttgatgaagaagctgaagtggatgaccttctgagtctaagaaaactgtttgggacttgggtattcagtagccatggaatatacatcccaaagagcagaagaaaccgtaacactagaccccaacatcaaaaatatgttgctattttctcccacattgctggtaggggtgcaaactgggacactttggcaacttacattaaaatgctatgagagaacaggggaagcattccttaaaagttctaggaaaggtgttatggaggaggtagcatgagaaattcagccaagtgggaaaagcacaaacctgggagtcagagagacaagagtttgaatccctggctctgccattagccaaatatggaaccatgaacaagttatttaacttctcctcggctcaggtgcatcatctgaaatatggggctaatataataataggcaagctcagtatttccccaaatgtgggagagttacacaggatgaatttaagtgatattcagaggattttaggagatgaacaagcacagtattaaacattgaaccacatcatgagaaaatatggttcttttcagcacttcttcagcctatatataacattcttagtacattaaggagtaagcggccgggtgcggcggctcacacctgtgattctagcactttgggaggccgaggtgggtggatcacctgaggtcaggagttggagaccagcctggccaacatgacgaaccccatctctgctaaaaatacaaaaattagccgggtgtggtggcatgcacctgtaatcccagctactagggaggctgaggcaggagaatcgcttgaacccaggaggaagaggttgcagtgagccgaggtggtgccactgcactccagcctgggcaacagagcaagactcgtctcaaaaaaaaaaaggagtaagcttttgtttagtcttctttttgacacctctttaatgcttgctaattcccttttcaacaaagtaagagaagtctcattgtcagctggggcctttgggaaccaatagtttatcttatacatagactgtgagaaaaataatttgtcttcatcctaattatttttaaaattacctttcatttatgataactcatattggttttccaattacaggtcaaatataaagttattttaaaatatattgatgattacaaaaatttgagtcaacttgagtgggctgaaatgctacctatctcagagttccagtgaaaattaaatgagatcatatataagaagaactagcccatgctgtgttccatcacccacggtctggttgatgggtaaaatttcagtaggtgaggaatatgagcagaagatcaagtgtgaaccaaggcaaatacatgagatggacatgagattccagaacaatgaggagccaaacaatgccaggaaggggttcttaaagtagaagatgaaaacctgtagagagagactcatttaacaggtaccaaaccatactatatgttaatcagtctggtgagaaaaccagctatagttccttcgagcatgtgtcttataatccaggacaaaactatcaaagtgggtcacagtcttatttcaaagagccttgaatgccaagcagaaagagatcattaatggtggcagattcttaaaagtcttttgacctctgtccagcacctagtactttccacagtacatggtgtttaacaaacatttgctgaacaaataaatttgtttaatagcactataggtgtattagtgcatttaattttcaaatataaatatgtattgttgttgttaatatcatatcttcttcttccttctctctcacagtaccagacaacagcctaaccccaactaaggtaaactctgccaccaaacatgcctgggaatggagaagggtctgcaggtcagtgtaagctcatcagtctgggccttcactttctccctgcctttccaaggaaagctgctgcttgcatcagtgttgcctttatgtcaaagtgtatcacctaaataccagatccaacagatttcaagccaccaccctccaaagacttgcttcttcaagaaaacaagcgtggtttgactcttgtgaaaaacaattactcccaacctggcatcctacaagaattttgcaaagcaagggtgaacagggatatgacaaccaaacatcttcctagcagctccttccccctccctgctcctggccagaaacctcttcttccttttactccttcttctttccacttctaatttgttatgatctctcaaacaacaaatttggtacagtgctttagaaagctttgtgtcttaccgacctacccccagtgagggtcttctgagatacttcaaactatcctcatgaggtatagtccaattctcctcctaggatgggtactagcatgctattcttgaaggatgaatgagcctgaagagttggttatggtttcctttcatcacctattggcttaacaggagtccattataagaagtaaaacttaggccgggcactgtggctcacatctgtaatcccagcactctgggaagccaaggtgggcagatcacaaggtcaggagttaaagaccagcctagccaccatagtaaaaccccgtctctattaaaaaaatacaaaaattagccggacatggtggcatacgcctgtagtcccagctactcaggaggttgaggcaggagaactgcttgaatctgggaggcggaagttgcagtgagccgagattgcgccactgcactccagcctgggcaacataacgagactccatctcaaaaaaaaaagcaaaacctacacccaaaatgatgtccgagatggagagtccaattttattttagagagattttccaaatggtgagtcagaagcaagaacagtatctcactaaatcatgtttactcaactgaaacttattgaattaaaccaactcctccttcctttgcatttcagatgagaaccccttctggttctatgattcaaatcttcattcactcaaagcaggtaaataggaaatttcaacagcttcctctcctccctctcattcctttcttctgtcatcgatctgatcaggaatgctctgaggcattccctggttattttttctttacctctcaaaatccacatggtatgttacactaatgcccagcatgttcctcagatctctagatggctctaattaaaggaccaccccttcttctgaatacagacctggggttagaggacataagagcttgaagggctctttaaaagtcaagtagtatcattttacagaccaacaacctaaaaaacagaaaagtaaaatgacttgtccaaggtcacatggcttaatggatttgtgggcattcatgaacaccctgtaattacacataaaatttggattatatgagcccatgtgtattttttctgaagagaaaatccgtatctttcttcaaagaagtcaacaatctcttccccaaaatatagtaaccactgacaattatatgcatatttgaaaaaaagtttaactaaaatttaatgttccaagtctgaatagtaatatgaattggtgatctagaataagagtggaacctaatttaataactgtcattgttatcatctttttttcttttcatgtctgggatatcaatgcaagtaacatgggataaagacaatttgatgtggaagtaaactataaagcaagatttttgttttgttttgttttgtttttttgagatggagtctcgctctgtgcagtggcaccatctcggctcactgcaatctctgcctcctgggttcaagcgattcttctgcctaagcctcctgagtagctgggattacaggcttgcaccaccacgcccagctaatttttgtatttttagtagagacggggtttcaccatgctggtcaggctggtctcgaactcctgacctcatgatccgcccaccttggcctcccaaagtgctggaattataggcagaagccatcgcgcccggcctaaagcaagcttttaaaatcactgaaaacactcgtatgaataaatttcactataggccaagcattatattatacggttcacattatacacaaacacaaatacctattttacagatgatgaaactgaggcaaagagtgatcagcaacttgcctaatgtcagatatccattagtaataaccagaattccaatctacattaatttgactctgatatccatgttctttttcaccaatatttgcatctatactccaagatgtcctaatactaatattctatttacttatttagaagaactaaatcaactctctaaggtagcttcaaggaagtctttcataaatggttcaactactaaaaagttcttcctgggaaatatcataaactaaataccagctatcacaaaatatctggactttaagactaaccagataaaatgttttgacttccaaatgcttcttggaagttggatttggcagagaaaacaccggggaattttaaacaaacaccccccaagaaaagactttatagaagaatagatccaatgcatatgaagttactgttttttaaaaaagtgtttaaatctctaaattacttagtgagtcatgtcactcttattaacaaaaataaattaatatacaactcaaagtacttgaatatggaatgccacagactagagcattttcttaaatcacagctgcctcagaaacggaaatgaaactgagcgaaactgaaatgtttgttctacaaaaagtaacctggcctaaataacttaagtatgcactaaaatttctcagtctaacataaacctagccttaactacagttgtttctcatataactctatttctaatgcttttctgtgattaccctgttatcttaagtagtcttttagaagacaggaagcaaacatgagcttcccattctccttgttggacttattcaagtcagcatttattaaattttttccatattaagtgggatgaattaaggccaggggagaatgaatcaaagaccttcctctagagaagcatacactcaagaggaagacaaataaatgttaactgtaattaaaaaacagaattaaatacatgatacaaagagtgctgtaatccaagtctaatggaagtaaagagaaggggatcttactttcaacttagtgatgggaaggagtggatccagaagagcttcatgaggagggaagcatttaaatcgggtcttaaaggaggtttgcaaaagctaaagggttttgtaccaactttgttttcaacatgggaaagacaggatttcaaactttattttgttttaggaaccaaatccagtgctcctccattgttggaataaatgctctttgcctgaatgctatttgtggtcttcgtagaatggagagtaactgaaggccccaccggaaatcaattttatgtaagcttttcattctctggcctcaagtatttctaaaatgtacctttctatgcaggctacttattcaggcaactattttcaggtgaagatactcaaatgaaaatagagaatcccttttggccttttgctaatatttcatttgtcaaaactttgatagtctgacaaagtctttaccatgagattggtaaactcacggaagccaaactgtctgggatgcgacttcagctccactacttacgaactccataataatgtacctagcctgcctatacctcagtttcccatctataaagacaataaaagcacctatttcactcatgagaatgaactgagttattacacggaaaacttaaaaacatatccaacataccataaatcaacagtaaatgtaactatttttaccaagaggtgtcttcaaagagtttatttctaattcattacaccaattaataagaaaggcactttctcatcctatttcacttttacaaggcagacattttttttcaagacggagtctcactctgtcgcccaggttggagtaaagtggcacgatctcgactcagtgcaacctccgcctcccaggttcaagcaattcttctacttcagcctcccaatcccagtagctgggattacaagcacccaccaccacgcccagctaatttttgtattgttagtagagacggggtttcaccatatttgccaggctggtcttgaactcctgacctcaagtgatcctcctgctttggcctcccaaagtgctgggaatacaacaatgagccagtgcacccagccaacaaggcagactttgaaactgtgtttatcttccaaaaatacgtatatcttaagaaaaaactaaatttgatttctaaacagtaacagcagtaacagagaaatagcttatttcaaaaggtccacaacttcatcaaggacaggacaagcaagaatcatattgtattataacaaatttttacaattcaccaaagttaggttttacaactaaactaacagttcacttctctttttcctttgtttcttaggcccttacagcctaatactctatcattccattttctatagatcacataggaaaacattttgagatcacacagctattcgcaaacatctgactgaagcaatagtatagttttcattatgaaccaagtaaaaaattgagttgagtaaattttattctattctttccaggatgttgcaatccctacgcaaccaaggtttcaagttaaagagaatttggctgacccactcacagcaacaaggaaaatatgatacaggctgtagattctgataaggattatagcagatgaatgtagagaatgtggtgatcatccttgaaaagctccctggttgcagcagctgaaatgttagtgctggagttaaagaactctggctgggttcaagtcttagctctgcctcttgcaaggtatatagccagagaaaaattagcttctcatttacttaatcttgtaaactagggacaataaatggttttgttgtgaaaattcaattagcatttgatgacctgcacagtggcttatgcctgtaatcccagcactttgggaggctgatgtgggaggatcacttgagcccaggagttcaagaccagtctgagcaagatagtgagaccttgtctttacaaaaaattgtaaaaatttagccaggagcagtggtgcgtgcctgtggccccagctccttaagaggctgatgtatgaggatcacgtgagcgcaggaggctgaggttgcagtgagccttgtctgtgcagctgcactccaccctgtgcaacagagcaagaccctatctcaaaataaatacaatgaataaacacgtgaaaaacatttcaaacagtacttgccacacagtgctatataagtgtctattcaacactgcaataactttggccattcatggttgtatccacatgcagatacgaagatggttgcattttttggagtaggccttctctcagcataaacaaaacaagtgttcagaatgatcttttaacatttgatgctagagtaaatgaccataacaactactataatggtattatttatttaatatctggatacttaaaaaaatgtatttgaggccaggtgtggtggctcatgcctgtaatcccagcactttgggaggctgaggctggcagatcacttgaggtcaggagcttgagaccagcctggccaacatggtgaaaccctgtccctactaaaaacacaaaaactagccgggtgtggtggcacgcacctgtaatcccagctactcaggaggttgaggcaggagaatcacctgaacctgagaggcggaagttgcagtgagccaagatcattctactgcgctccagcctaggcaaaagagcaagactccatctcagaaaaaaaaaaaaaagaaaaagtatttggttttaaaagtattttagaaatgcaaaaaccacatgcattttgatattttctagacatctagatatcttcataattagaagagtctatctaaggtaatgttcacttattctagcagctaaaaatgaaaacagtgaagaccttaatttgtagccactacatatatagcttaagtatcccggcttacgggagagaagatccctttaaaaaaaaaatttaaatggaaaaatatcccaaccaactcctctccaaaaaggtaagtactacagaagataataaaaagctaagtcactgaacttcttcagtttcattcatttttttatgtttacaatgggacttccttgagcagaaggaaccaatccttgaaaacaatcaattcctgatcactcttttccaatcctgcactaatgcactgtctcacacaaaccgaaaatatgttctaagtcaaaatgtgtccaggggtcgggcgcggtgcctcacgcctgtaatcccagcactttgggaggccgaggcgggtggatcaagaggtcaggaaatcgagaccatcctggccaacatggtgaaactctgtctctactgaaaatgcaaaaactagccaggcatggtggcgtgcgcctatagtcccagctactcaggaggctgaggcaggagaatctcttgaacccaggaggtggaggttgcagtgagccatatcgtgccactgcactccagcctgggaaacagagcgagactgcatctcaaaaaaaaaaaaaatgtgcccagggtccattataggcctgcactcgtagaaatacgagggttgagatttcaaatgctcatctgcaggggagacaacatatcacacgtgtccaggttacagtcagatatgtcattctggaacactatgcgggtgctcaaatacagactcctaaattgctctgacaacagtagcaattctagtcccttaaatggcttgtagtcatcgtgaaggctgaagacccacttccccggtccttctgattgtaaaccaatgttttcctaaaattccctagcattaattattttaatggtttgtggaattatttaatggtttgtggaagcacttgggaaacaggctgacaatggaaactttgtatttgaaaaatattgtaatatctgtagaggttctactcaggaatactttccatgcttccatactttctctgatttaggagaaagtttctcaagagaatgatactctcaacagaaacggaaagtttctcaacagaaagcctccattatttttgtggtaggtatgagaagaataggttgaaataaaaggggagatgaaaacttaaggactttaagttttgtttgaaaagaagatcataatttaagtctgggttctaaactacggccgttaaaaaaaaaagaaaaaaaaatcaagaaaattccactctttaacttgggggaaatttttgtgaggttctcttcgtgggaagcagggattcggccatggagggcaagtgacttgctgatttcagtacccagaaggtttttttaaatatgaaatttgtccactatgagatgaatgtgtatatactacccattctcttcttgaagtgtcaatgaaaagtcggattttaaaagctaatggtatcagtgctgcaaaggcaggccaattactgccagtgccagacaacttttttctttgtttatttttaatcttatttctttgcttctttttgataaaagatatacctaaagaggcacctacacataaccctggcaccgtccgccgccccaagaaccttcctgctttaccaatggcctgggagttggcaaacacgctaacaaaaaaaaaaaccaaaaaaacaaaaaaaaaaaaacaaaacgggctttcgcctcaacctcatagttcctccccgtctgcaaccaccggtcttcaccggattcacagtcggaaccgcgagcaaagacacctagtagagccggccgattcctaggtcctccggccaggaggcgctgcgggccagtctccgggggccaccgcagcccgcgcgcccagcacccccaccctcacggcagagcccagcccagccccgcggcggagctccgagttctgcgccgcccgccggggttactcccggtcattccacggcaccacctcggcccagcttccccatctgcgcccaggcagaagctgccccgagagaccagcagcaacggtctggaagatggggctgcagggaacgtgggagagggaggattgggcaccccacctccgggtctccgcaggctctcctaagtcttgtttttaaaagaaacaaaactcggccgcgcgcggtggctcacgcctataatcccagcacttggggaggccgaggccggtggatcacctgaggtcgagggttcgagaccagcctggccaacaagttgaaaccccgtctctactaaaaatacaaaaattagctggatgtggtgacgcgcctgtaatcccagctactcaggaggctgaggcaggagaatcgcttgaacccgggaggcggaggttgcagtgagcggagatcgttccattgcactccagcctgggcgacagaccgagacttaaaggaaagaaaaaaaagaaaaagaaaaggaaacaaaactcgtccgcgctctgcgccagggacaccagctcagctgagcgcacggagactgtaggcaggacctccctacccctcaggtcaaacaaagacccaaggcctctagtgagcaatagcaccacggaccgtttgggacacctccaactcgagttcccggattcacagtccgggactgtgccgctccagtcccggggagcatatagccaattcccaggtcagaacagaccagcttcttaagaaccgagtgaagactcagtgctggcatttgtctccgtaggtactggccgacctgcaaccagaagggtttctagccagctcagggccctccgaacaaagcagcgctcggtgccggacctgcagctctccccacccggcagcagcgccctcagcacgcccgggaacccccgacccctctgagcccggggtactgcgcccgggtctccacgcccagagatgctccccggtctccaccgtcgggcaagccccaagcgcagcagcgcagagtcctggggtcaccagagctcgtactaggacatcgtctccccatttaacaccgcctccggtcccatctgagttgcaagtggtggggatgtggggctccggatcaaagtccccgaaaccgagcacttcccgaagcctccttggcctcgaaacaaaacaataacgcccaagtaagtcactggagagcctcttacctgttttccacttttgtgtttgcgtctctttctcctaccccttgacaagccttccggagaaggggagaaaacagaaccggggaaaaaacaaggagcaaagcgccctgagaaccggctctgttggtgcgcggagctccccgccctgccctgccgcagcccgggagagaagggtcggctcggctctgcgggtcccggccccactcactctcgctcgcaattacggggtttttgccgggactagttccttttatagattcggctgcaccgagcgcagaggttactatcggtcaaagcctgtgctctccctcctccccgccccgttcccggcctctgtttatgtagttcagtcactcagcagaaagcacgtggagccggggcccgccccttaaacgggcgacgttcagccgcccacgacacatctagggagttggggggaggtgggtggggtgggggtggagggtacagcaggtgtcttagggtccgcggtctgcgtccccttcccccgcccgggcccgccggcctaagacgcgcgggaagcgctgggctcggggctgcgccgcagactctctagtccacgttcccggcagccaagggcaccagtggaatttgcttcctctaaatcctgctttccgcaatttttttttcctttgttagtttcctcagccggagggagggattgggggagagagagctctaggctgaatctccctcaggacgccaatcattttgtcttgtcttttgtttcctttcaaaggcctaggctggggtgaggggaaggcggacagtcctctgggtaatgggctgcttttgttttccccccacaaacctggactttgatttttgataggcgacctactgccttggagattcccagcctgagctccccaggtccctcagaggacccgagaggaacatcttactgcttctcttcataaattgagaggaaggaggccacaaaaacaaaaaaagaaacaaacaaacaaaaacacagaacaatatggaccagcccccttttaatttcattatattgatcagcctccctgtgataaaaacacaggacttgtatttagtttgtatacatttgtgaagtgcagccagagaattgcagtcgtgtaaaattatgtagccactccagacctccaacttatctgtttgcctttggctgtaggggagcaaaactacccaaaacactggaggggcaaaaaaaaaggcaagagtaggaatgcaggcctacacaccatatgtctaaatatttaagtcatccatcaagccaacaaactaaatgtcaccttattctggccaaaactcaggtcaaactgtgaagagtctaaatatgaatctgccctgaagggcagattcatagaagactcaggacagacccgtagaagaggcccaagcaggccctggaagtgcacgtggaggccacaaggtctcctaccttgacaaagatacctttgtagccaccttgaagggcagattcacatttagactcttcacagtttgacctgagttttggccagaatgaggtggcatgagagagctgccccaagcctacttctcttcccacctccagctccatcatattccagaactcccaccacctgcatacagacattcagctgcacaagccccctccatgctacagtcaacaggatctccaggccacggctcaagcccaggtactcacatcagtggttctatcaacactcaggacagacccatagaagaggcccaagcaggccctggaagtgcatgtggaggccaccaggcaaggaattctggagtcccaggtactcataactctgggtggcatggcccctttgcaccatggactgtttgcccttagaaagggatggatctgagctgggcgcagtggctcatgcctgtaatcccagcactttgggaggccaaggtgggcagctcacctcaggtcaggagttcgaaaccaacctggccaacatgatgaaacccagtctttactaaaaatacaaaaattagccagatgtggtggcgagcgcctgttatctcaggaggctgaggcaggagaatcgcttgaacccgggaggcagaggttacagtgagtcgagatcatgccactgcactccagcctgagtgacagagcaagactccgtgtcaagaaaaataaaaagaaagggatggatctcagaaaggccagagatgagctttctaaagcccaaggcccaggagagcggacccccttgcctcagtcaaagaataaccttggtcaataaattgggttttggggtcaaacttgacaaccacatgatgagcaatttacgtaaagtctttctgcctctgtttcatcttgtttttttcttttttcatctttttttccttccttccttccttccttcctccccccctccctcctcccctcccctcccctcatctcctctcctctcctctttctttctttctctttcatttcttttttttgagacagggtcttgctctgtctacccaggctggagtgcagtgatccaatcatggctcagtgtagacttgactccctgggctcaagcgatcctcccaccttagcctcccaagtagctgggaccacaggtgcatgccaccacacccatctaattttcgtattttttttgtagagacagggttttgccatgttatccaggctggtctcaaactctggagctcaagcgatcctctggcctcagcctcccaaagtgctgggattacaggcattagccattgtgcccggcctgtttcttcatctttaaaatggagagaagatgtatattctgtcttcctcaaaggggttttctgaaagtgaactttgttgaaacctttgagctccttggcagaatgatgttataaaagcagagagtgttattaaaaggtgttatctttcctagcatgattttagagagtaattagatctccctgaccctccatctcctctctccttcttctcctacctatttgaagtcgaccaccaaaatcattattttttttttaattgagatggagtttcaccttttgttgcccaggctggagtgcaatggtgcgatctgggctcattgcaacctccacctcccgagtagctgagattacaggcacctgccaccatgcccggctaattttttatattttttagtagagacggggtttcactatgttggccaggttggtctcaaactcctgacctcaggcgatccacctcagcctctcaaagtgctggaattataggtgtgagccactgtgcccagcccaaaatcattctttttggaattttgaagcatataattccaaaaggtatgaaggtaatcacttagattgctctaataagggaatgggaacagttaagtcctatacaaataagacaaagataagatactacaaaaaggggatgagcccaagaaaaaaatcaaagtcccagagagagaacagccattgattctaaatacacaagtctatggccccaacccaaacttgtttcactaagaacaacctgtggtttcgagaatctggtcatcccccacagtgaatacatgaacacattgtaatgtttgaaatgtttatttttcttgttgatttcttactgttagaagagctaagtgatttggcccaaagtggctaagtgattcggccagtttgtacacagggatataagtttgctgacaccaagctcatactttacaaatgtaatatcttcataaaacaaaaatactgggccgggcgcggtggctcacgcctgtaatcccagcattttgggaggccgaggcgggcggatcatgagatcaggagatcgagaccatcctggctaacagggtgaaaccccgtctctactaaaaatacaaaaaattagctgggcatggtggcaggcgcctgtagtcccagctgctcgggaggctgaggcagaagaatggtgtgaacctgagaggcagaacttgcagtgagcccagatcacaccactgcactccagcagagcaagactcaaaaatatatatatactgaatctcaaaagctagagcctaagagatgccccttaaaaaagaagcttacaagtgtgaattttcttccctccagcccttaggttggtttgtcttttagtatatttcaataagcttccccctccccatcccatccctgccccccacaccaacaccaaaaccccaagtccctcctctaggtgactccttccaaatacataggaaggccctcctttgttgctgtttttctggagaggctgattctgtaaatgtagcctgggtggcttgaggttctattctgagatgaccctggcatcttctaattacagaatcaaccttcaggcagctgtggccttgcagactctgctggaggtcatggaactacagaaaagctcaatcttatcattctattgaggcttttaaattggagattacctaaatggcattgtttggaggttgctttgatatatgttaactcatctgcataaatgtacatgtacacattgtttaaaataccaatgatactggttgctagaaactctgaaaaaatagagtaatgcaggaagtcaatgaagaataaaaaataatatattttaaaatgatgttttaagatgaatttgttatgattaagaagacctggtggggcacggtggctcatgcctataatcccagcactttgggaggccaaggcgggcagatcacttgaggttaggagtttgagaccagcttggccaacatagtgaaaacctgtctctactaaaaatacaaaaattagctgggcgtggtggtttgcacctatagtcacagctactcgggagtctgaggcaggagaatcacttgaatcagggaggtggaggttgtgatgagccgagattgtgacactgcattccagcctgggcaacccagcaagactcagtctcaaaaaaaaaaaaaaaaaaaaaaaaaaagacaaatgcctaatagctgaaatcttagagattttctggagagtgagaaatgccttaaaataaaataaataaataaataaaaaataagagggataaaaggacctgcagttcaaattgagtcagcttaattccaatacacagttagacacagaaacaaatcgagcaatcaatggtcaaataaaaatgtaccaggaaccatcattatttgtgcagtagaccgtgtattgcagaggctctcaatcaattcaatttaattggaccaatgtgatcctcttctgtattaatgtggctcctgttgacatgcaagcaagattcaaaattattattgcttctggacttgagtaagatgtttgttctgtttgtcattgggatcaagaggttagccttggctgggcactgtggctctggcctgtaatcccagcactttgggaggttgaggcgggtgatcacttgaggtcaggaatttgagaccagcctgaccaacatggtgaaactcatctctactaaaaattcaaaaaaaatttagccatgcatggtggtgcatgcctgtagttccagctacttgggaggctgaggcaagagaattgcttgaactgggaggcagaggttgcggtaagccaagatcatgccactgcactccagcctgggtgacagagcgagactccgtctcaaaaaaaaaaaaaaaaaaaagttagcctgctggattacagacaagtactgcatattccactggatttctagttgattagtgagtgataattctttttaaaaaccacccttccaaccctctttccttcaagctatccccttaagagccaaactgctggaaagatttcatctctaccccctcccttttattaacacctcacccactgcagtcaaattttcactctcacagctctgaatctattctgcccaaattcattaacgacttccttagagagagagaggccagggacgggttgggggggcaaatgtgatctctttttttctttttctttataaaatatttttaacatagaaaaataaagaaaaatatcttaagctcagaaaaaccgcttaattggtggtgctgttgacctcttttaaatccttaggctattcagtctctggtatttgacactactgaccacactttccttcctgaaactgattcctctcttttatttcatgaatctggttctcttctgattcttctgcctctttaaccactctttttctgactattgtttctttatagatctcctaatactggttttctcttttcatttctacttgctctcctcatcaatattattcacgcccttggcttcatttaagccctgtacctccagctcttgtctccttgccaggctcacccaccgtgcgccctatgctgcctggtagaatatccagcagcatggtgtgttggagccagcacacaagctcacaagagttgtttttgcatatctctttttgtttgtttgtttgtttgcatatctctaccagctagcttgaaatcggccaacggcatgaatattacaccattggaaatccaatataaatcagtgtcgatgaaaagagtaaaactctgtaaaatatttagagatttatggtgagccaaatatgagtgatcttggccctcaggagacagccctcaggagatcctaagaacatgcacccaaggtggttggggtgcagcttggtttttagggagatatgagacttcaatcaaataagtttaagaaatacattggttcagttcaaaaaggcagggcaacttgaagtgggggcttctaggttatagatagatttaaaatttttctggttgacaattggttgagtttatctaaagacctgggatcaatagaaaggaaatgtctggcttaagataaaggattgtggagaccaaagttctcagtgtgcagaggaagccttcaggtagcaggcttcagagagaatagattgtaaatgcttcttaacagacttaaggtctgtgttgatgttaatgccagagaggcataatgaggcctgtccgacccccacttcccgtcatgacctgaaccagtctttcatgttaaattttaagagtgcccttgcagaggaggaagttcattcagatggtgaaggggggcctcagaattttatttttggtttacatcagggttttgtttggtttggtttttgtatggaaagccacttgttaacatttattaggacaaaattttgcaggtcattctacaagtaaatccaaaacaaacaaatttcttgtctttccttcaaatctccttctaccatctgcctttttaaaaattttcatttaatgatatcatcatccagacattcactatgggaaatcatagtcatccttgcttaactttttcatctgtctctatctttctcttctcatttgaaaaagcaccaaggtcaggtcaagtatacctcccaaatattttatttttttaattcatcatttatttttcattcccagtgtctaagtccaagccaaacatctgggcttctgtattgcagaacctccaaactgctgttcctgtctctagtttcttccccttcctatttgtcttccctattgcagtaaagtgattttttgcttggggaaaaaaacaaacaagcaaaccaacacaaaaacaatctaatcatatattttctccctccaaaaaaaaaaatttctttttttttgagatggagtctcactctgtctcccagactggagtgcagtggcacaatctcaactcattgcaacatctgcctcccgggttccagcaagtctgctgcctcagctgcccgagtagctggagttataggcacatgcaaccacatccaactaactttttgttttttcagtagagacggggtttcaccattttggccaggctggtctcgaactcctgacctcaaatgatccacctgcctctgcctgccacagtgctgggattacaggcgtgagccaccgcgcccagcccatccctcaaaatttactatggttctcctttgctcacaaaggaaaaataccctcaaagttctgtaagaagacctacaaagcctctgaaaacaagatattggaaggcctttgaagcctgatcatatgacctgcttcctcctccatcctcttccatccatccacaccccaccccttactcacccccattctaccaactcacgactctcatcatactttcccattgcttggaaatgcttcctctcatctccactcctgtcgtcctgttatgcttttattctagaagcagtaggaaagaggggcagaaaaaagaaattcacttccctcattaaatggaaagttgtgagatagagggtatatgaagaaagagagagagatttttaagtatccaaattgataggcaaatattacccccaactcagatccattatcaagtgtaacaatagattcacagaagcagtcagtacccttaaatttgccaagaaaataattggactcaggggattaaaagaaatcaagcgcttattataatagaagtagtgcatctgcgtttctttccttattcagagtacttttttgacacttaagaatccatattcctggctgtgatttctgggatgagggactgttttatttcttagccaggagcttttcttttctctgacatattaataagagagtaagtcattagaaaaaaaaaaaatcctaggaaatgttccagatactgttttctattagacttctagagagacaatcctctttctctttcagcattttgggaacgatttcttcaggagtgcatggtttttcctttgttgccctcaatagtctgtgttgttttgacccatccttgcccagtattccttatgacttctggaattgtctggacagaagaaatacttttgccttgtcaaaggttaaatgtggagatgtgctatgaccccactgtgggagcaggccttttattttccttctgtatctccattcttctggtgactgacgtccagtgaaattagagcaatttcttagctggctacttgtcctggtgtgtaaattagtgaggaatgagctccattcatagagtcctgggcttgccacagagcggaccccaaagctggtttccccttgagtggctcaattacctaacagagttcaacaggaagcccccacatctgcctactcaccactgggattggaagccctggacacactgcctgaatgagaacagaaagctaagttgggggtgcagtcttaaggtatctaaggaaaatagaataggaggttggggaaaagagggaaaataatgtaatcatactcataaaaactgagggtgttagtagggtgcaaagaggcccaacattctgatagtttagcaaaatgtatcaagaggctttggtccaggaccagtggctcatgcctgtaatcccagcactttgggaggccgaggcatgcagatcacctgaggtcaggagtttgagaccagcctgaccaacatggagaaaccctgtctctactaaaactacaaaattagccaggcatggtagtgcatgcctgtaatcccagctactcaggaggctgaggcaggagaattgcttgaacctgggaggaggaggttgtggtgaaccgagatcacaccattgcactccagcctgggcaacgagagcgaaactccgcctcaaaaaaaaaaagcctttggcccactaattttacttggaggaatttatactaaggaaatatccgatagtatggtaaaaaaaacttatgttcaagaatgttgtcactattttattgatgagtgaacattttaaaaatgcttaatcatctgataacaattctaaaatacacattgataaattcacatgatagaatgttatatagccatgaaaggtgaaaataatgttttcaaagagttgtgatataggaaactgctcatggtaaatgcgaattgaaaaaaaaagcaaagctatatttatgtgtatggttaacattcaataaaaaataactgttactatattgataacctttttcattgaatatatgtgcctagaaaagactgcaaaaaaaaaaaaaaaagaaaaagaaaaaagaaaaaaaaaatcccagataggtgctaacagcaatcacctgtggatggtaagattataggtaattttttcatatatgtctgtattttacaaaatttataaaataaacacatgctatatatatgtatacacacacacacacacacacacacacacacacgtaaatatttatatatatatatatatatatactttattttttgagacagggtctcactctgttgcccaggttggaatgcagtggccccatctcggctcac

SEQ ID NO: 261 - DNA, 88596 bp, Homo sapiens
tcaagttggtgtttgcattttgaaaagaaagaaacatctaatactattggggaaagggtcaactcaaagatgtacttaaaacgaccagtggtcccttatcacatcatgtaaatcgtaagaaggtaagggcatgcccttgaaatggcagtattattataagccacttgagctctactgcatccagagggatgaaaaaattgaatatgctgcacctttcaccatgaccctgccaaatggaggaagcattgggaatatttggtcacccaagtaagagctatgttgaaaattataagttattttctatttataagtaatagttaaaagacatcagtagcttggaaaacaaaacggctttgagaaatgcaatattccttaagcaatggagacagccagtgctcccagaaaatccaaacgcctatgaatttcaactctaaagagatgtattgaatggtcatagagctactgctgtcaacacaaattgttttatttatcctgatcagtctattagcttatcaaacaaatctgaacataccattaagttgaatgtgcagttgcaggttcaaaagttgttcactgttgtctgtttaatctgagtccagtctttgaacttaagaaaaaacaaactagaaacacatgatgaaattttctaatgccttatttattttatcctagtctgttctttaaatgaagaatacacattttttttcattggatcaaagtataagattttaaaggtttgaaaagcagtcctccaagtttcatgctgagttcaaaataaaaatgttttcatgttcaggccattatatgttgcctgattcatcttgaaatcccttcctttgaataagaccaagcaaaatctgttcagtctttgtataaaccaaagccgtttcttggtcaataattcttttttaccattaagattgccaatacaatacattctgagtacataacaatttatatatctatacatatttgtttgttttgtttgtttgtttttttgaggcgtagtctcgtgctgtcacccaggctggagtgcagtggcgcgatctccgctcactgcaactccgcctcccaggttcatgccattctcccacctcagcctcctgagtagctgggactacagacgcctgacaccacacccggctaattttgtttttgtatttttagtagagacagggtttcaccgtgttagccaggatggtcttgatctcctgacctcgtgatccgcccacctcggcctcccaacacaatttatatttttgaaggtccttttatgtgtattgtgccatatgcttctcacatcagccccaataaatgctttaggcgttttatattatctaccactattacatgctctccatctccagactacccatttctgccattgccctcataggggcccattctgataattctggatatgtagaaaaataaatcctgtttatgtgtttaaataaatagatgtatactatagacctttctttttcttacaatgcttttattaaggtgtatttcttctgcagtgtgcagctctagtaagttaccctgttgattgtgtagcacttcctagcatgcagccacatttgacatagtatctattactatagcgaatggttggccctaattctatttcagaatctttgggctggtcacggtggctcaagcctgtaatcctagcactttgggaggctgaggtgggtggatcatttgaggccaggaattaatgaccagcctggccaacatggcgaaaacccatctctactaaaaatacaaaaaagtagccaggcgtggtggtgcatgcctgtagttccagctgctcgggaggctgaggcaggaggattgcttgaacccaggaggcagaggttggagtgagccaagattgcaccactgcactacactccagcctgggtgtcagagtgagactctgtctcaaaaaaaaaaaaaaagaatctttgtaaattctcttactgacttttcataagtttctcggtgggtatataacagaagttggagtgctgaatcccaggcatatactcacccagaaccatcaggttgccctccagaatgactgcaccagcctacgattccactacatacatgagaaaactggatttagccatactttcaccagcactggcaccacctagcttcttcatctgtgctagatggaatgttttaaaagtgagacctcattttgcatatcttagattcctaataaagttgaatatccatcccctcaactagtcattagtcattagggtttctctttgtaaattacctatcaaacctttaaaatcttgcaattcgatctaatgggaaacaagtatgtttctgtttattgcctatttctctgctggtcaaggtctttttatcgtttgttacaagtttcttgtattgtttaaatattaatcccttatcagtttggaccctgttaatatctcttatccacctgataacttgccaatgtttccctcatttttacatagaaaaattcatcaatgtttttgccgcattgttttgggggtcttcaagagaccatgaggtcacacaatttttatttattaaacttatggttttatctttcacatttaatgttttaaatttgtataaaaggtctgtaggtatttttgtccacataatgagccagttttatcaacactctattaaaaaagtcgttttaccttagtagctcatgatgtcaatatatttcagattcatgcatatatgtgcctgtttttgaacactttatcccgttctgctgatctaggattgttcctgtacaatgacttctatgactatatctttgtagtatgtcttcagatgtggtgaggtgatgcctctctgggtttattttttgttttgcaaaatcggactaagctatttttgtgaatcatttttttccatataaatgttaaaataagtttgatgggttccttagaggaaaaagagggaaaagtctcattgaaatttaatttgaattgcgttgaatatattggtttgaggagaattgacatctttacaatatcagaaacatgataatgcaccctttattcagatcttccatcatgtcctttaaaaggtccgtcaagacctttaaaattccttaaagatcttatgcattgtttaatatgaatggtcttattgctactatagctttactgttttatggttttattgctatgatgaacagaatcttctctttcattattgtttctagttggttattgctattataaaggaaattaatttactaatttttaaataaattaatcttatattcagcacacttgttgaagttttttactagctctggttctgtgtttctttaggttttcttttctttttctttctttttttgtagagacagggtctcactctgttgcccaagctggagtgcagtggtgatcacagctcactgcagcctcaaactccgggtctcaagtgatcctcctgcctcagcatctcacagtgctggattagcaggcgtgagccaccgcacctggccttctttaggttttctatgtagaagaccatctcatctgtaaataaggacagtaccatgctagagagaggcagccaaagtagacatgtttatttctcgtcttaatgagaatgtgttttagtttgtgtttctctgaaagaagagataagacaagcactttgggttcaagtatttcatagtttatttgggaggtgatattcaaaaactggagtagggaacaaagtaacacaaaaaaggaggaaatgccaggacgccggtgtgtttcctaagcagcagggcctcagctcctcctctgggaacatgacagaatgcccccgtctgaagaactaaggctgggtcatttgcccactggccccaatccctactggttgaggggtgctcctgggatgttaccaggctacacctgcacacaaggtgagcttctttcagctttggagaaagcccaggagcagaaagtgaagagatgtgtggtgcaggggtgggatgctaagatctgagctcacatgaactgtccaccagagctgcaaccaaaatcagataggagacagcaatgaaagtgtctacttcagtccaccccttgcaccattcagatccactcatgcacaccctggactttttgagggagaggccagctgtaatctctaggtaacacaatataggaatggaactacctagtccccattgttgccactggtcacacagctgtagtaataacttcaccctctaatgtccttccaggagctccctcgctgtcggctggtacttcaactgtactaagctgcttgcctggtgcgctgatctgaaccttcaatctcgagggctcagagcccttggttaccttgcccttacagagccgtggagcatggaaacactgagttatctctgtgaaatctctgcccaattatgtagcagtaaccccagcctctcaggatgacaaacacatctcctttctctgcctgctcttccacaggtgtggaaatcccagagaccacgtggcaggcagtatcagactcagtggaaccctcactgtacttccaggttggacacgtcctcctactttttaagtccagggcatctaaacgggcagagtctaaagctgcagaaacaggagtgtaaattctaaagaggggttaatgggaatgatattgagagaagcgaatattgcttgattgatggacctgtgtattctaactgttggaagcaggcaggaactactcgtttaatgtagggatctgcaaactttacacacaggaccgataataactattttaggctttgtaggtcataatggtctttggtgcaaccactttgccatcatagggcaaaaacagccacaaacactacaaaggtgaatgagcatggccgtgttccaataaagctgcattttcaaaagcagacagtgggctagatttggctggcaagccagtttgttgaactctggctcaatccatacaacacatgctggaggatggtgcctcagtttccactgagggcatcacccatgaactgccactagcatgatgcttatgaccagtcatgtcctgtggaatataacagtaatagctaaaaatgtattgagcaggtcctatgaccaggtacttctaggcactttacatgtagcatcttatgtaatttccataccccgatcgtggtagatactattagaatccctattttgtgggtaagaacattatagattaccctctctagtccatcagggttacagacctggtaagtaaaggatgacaagaggaggagaactggggaatcttgcctgggcttgacttaggacttttcaactttgcaatggtatgaaagccacacgcattcagtagtaccatactttgagtaccataccaccattctctttttcacattcagtattcaatgaattagagattagctgtagagataaaaaggccccatttttgcctcacagctcttacaactccttagcttccactgacacccactgcacccattctggcttatgcatagggcattttccaaagtaacccacctcaggattggtcaagatgcccctgataatactgcagtattttccaaatcttatcaaggaaataatctgtgtgacctctggccggttgcagtctaaatacaggtttccccatttggaaaatgaaaaagatgaaacagcttgaggttttccaaacagcacaccgccaagcctctcatcattgagctgatgcttcagaatttggtgcctgacaaagggagccaagtgagagcccgcatcctcactttgatcaaagcagcaccacttccaagtgtcatttagcagaggcccatatacaaatggtctccgaattgcgagggcttgacttagggctttttaactttgcaatggtacaaaagccatgcacattcagtagaactagactttgagtatcataccaacattctgtttttcactttcagtattcaatagattacagagatattcaacactttaatataaaatcggctttgtgttaggggattttgaactgcagggtatgtcagtgtcctgagcgcatttttaggctaggctaagctatcatattctgtaggttcgatgcattaagtgtatttttgacttacaatatgggtttaccggaaggtaacgccatcgtaagtcgaggaccatctgtacgctgttctatggggctcaggggtggaaggatgactctgcagctaaaaaatgatctgaagatcaggtgatgttaatgggctcacttagttctacttgtgcttctgatatttaggtggatacaaaatacaacgcatggctttgaacgcaacagttacccagtgattgaatgaagatcaaattataacaatggaagttagtgagccttaacttcttattgcaatcctaagtaggtgctatatttcccaaagaattacctagaatttccagcttacctctgacacaagggagaaaaaaggtaatactttccttcctattataggcattctagatgaccactgattcttatcaggcaagctctggaaattccaccctatgtaatcacaaagaaatgtgccagcctgggcaaccaagtgagaccttgtctctacaaaaaaattagccaggtgtggtggcgtgcacctatagtcccagctactcgggaggctgaggtgggaggatcactggagcctgggagatcgaagctgcagtgagctgcgactgagccactgcactaaagaacagagtgagacgctgaaaaaaagaaaggaaggaaggaagggagggaaagaaagaaatttgaaggtttatagtttagaaaacaagagttactttgatttagagtatcattttgttcatattgctaagtggagggaaaaaagtagtctacaagtcaacatgcaagtcaaccatttatttaaagtatgtatacaaacaggctgcaagccacatggtagctatgtctggtggggttcaaggccaggatctttagtccacagaagataaacacaagcccacaagggtgggacactgctatctcctgcattgtcttggtgaaggtgagctggagcaactattcaggttagcttgacacacaaatccctatggatgtcatagacattgttgcgttggtcttaaatcccaattctgtgtttaccaaggaaccctctgatctcagtttcacacctgagacaataatgtaacaagataatgtccacattaacactttactattttaatgagcaatttggtgctctgggttacagatccttggtgggatcactggtgtgaattgattactcagagaatagccacgcttttggatgcactaaaaagaaaaattccaggccaagtgtggtcttaacacctgtaatcccagcactttgggaggctgaggtgggtggatcacctgaggccaggagtttgagaccagcctggccaacatggtgtaacctcgtctttactaaaaatacaaaaattagctaggcgtggtggcacacacctgtagtcccagctactcaggaggctgaggcaggggaatcacctgaacctgggaggctgaggttgcggtaagccaagatcgcaccactgcactccagcctgagacagagtgagactccgtctcaaaaacaaacaattcctgaacatgaaaaaaaaaaaaaaaaaaaaaaagacagtctcccccacaagccctgaggccagaaggttccatctcaactgatatcagcctctcttacccctcttaccacactaactgccaccacacaggactgagtgtactcagaacaaccttgaaactaatgccagatgcagaaacccacttttcgccttttgtcaaagcagggcagagaggtaggggagagaatgaagtatcaggaagcactgtgtttgttctattaaggagaaacaggatttcaatataatatcttgaaaattaaaattacaacaaatttcttagaactttggtttatcagcatattagcatattgacacagtctcacatgaagcaggaacaactgtctacaggaggtatctctgcaaatgatggcctctgggccagatctggtgttccttggctgtgatgtacagcccccctgctaagtagagtttttacattgctgagaaatggtttttaactttttttataaagttgttttttaaaagaggcaaatagcaaaaaaaagaccctgagagagaaagtatcaggcccttctcagaaagtttgtcaacccctggtttacaggaataatgaactctcctccgtcctgcctccaccaaccaaaacaaagtcttaaaaaaaaaaatacacaagaccaaccagaagcacaggtggaaagatgactttttgaacaaaagactaccctcccctccttgatcttagcaactttagtctgaatttgcatgacagaaaattcaaatttttgtaataaatcaaaataaataaattatagggttgcactgagaaatttagtggacattgaaaaagtcaaattggctggctgctcttcttgaaggtagttgaaaaaaaaacaatttaatgtaaatatccatgcatgcacagaactttaaaggtagaagaaactctcattttacagatgcataaaggaatttggggaatgtaaggttctatgaaaacaaagaacatgaaatgaaaaaaaaagtattaagaattacttagtccttttgatatccatgtgaggtagggagagcaatattcccagcataagcacaaaaatcatcaagccaggacactaaaaataattaaagagatggatataattacataactttgaaaacatgtatttcttgattgcatatttgctttatgtctatattgatagacatagaagatgtatttactcaaaccttattttttaaatatctttcagaatgcaccataagaaacttgtttggattatatttttgtgcatgcacaaaaaaagggctgcaatatgaagtatttttttttttactatgaataccagacaaaagtttttaaaacactgtaatgacctgcaggtgttgtcaagccaatgacctgttataatcctactgctacatccaaaagaaaagttctttagacacagtacagtgaggtatcataaaacagtatatattgccactaaagaatgcaaagcaatatagatagtatacatttatagtataaacagtataaatagcaacttatattcatttaactgagatttcttttatgttaaaccacattaattcgtctccattatagattagttctgacatccaggaaaataaaatcaaaagaatatatatatataaaaaacataaaatgagcacataaaatttaccatcttaaccattttaaaattaaggaacttttttaaagtgtggtttattttcttataaagtagaaatttacttaaggatatacatacccatatataagatataaattatatatacattatatatataattatatagatagaaattatatataggatataatatatagagaggatataaaaatacagagaatatatataatatatagggtacatataatatatatggatatctatatccttaagtacatttctactttataagaaaataaaccatactttaaaaaaagttcctggccaggcgcgctggctcaggcctgtaatcccagcactttgggaggccgaagcgggtggatcacgaggtcaggagatggagaccatcctgactaacacagtgaaaccctgtctctactaaaaatacaaaaaaaaaaaaattagccgggcgtggtagcgggagcctgtagtcccagccattacaggctgaggcaggagaatggcatgaacccgggaggcggagcttgcagtgagccgagatcgcgccactgcaccacagcctgggcgacaaagcgagactctatctcaaaaaaaaaaaaaaaaaaaaagtccttaattttaaaatggttaagatggtaaattttatgttatctggttcctaccacaacaaaagcatataaaggtaattttaatataaaaaaagaatacataaaataggatataattaaattctcatttatttaaaaagttaataattgtggctgttttgtttcttttgaagtatattttgtgtaaaaagtatagatagatatttctctctgtgtaataagggaagggtatatatagagaactgtaagggacaggtatgtgaaaagcaggaattataccaagaacaggaaaaactgattaatcttcctgatcacataaccaagaaaaaagataatgtgttccaagatgacgcattaatcaaatgtcatccaaaaagaaaaaagttcaaagataaaaatataatgccatgttcccaaattgatgttgtgacagaatgtcagggcacccactgacaaactaaatgaattccaagatgaccagtgtcagggcgtctatacaccatgatgccccagctcagttaactcctgtaagtgctgaaaagtatttacttttaaaaaagagggctagatgaaatgtggtctcctgaattgaatcctagaacaatgaaagaatattagtggaaaagtggtgaaatctgaatattgtgtgcagtttaattaacagtgattgtaccaatgttaacttgttagctttgacaaatgcatcttgctatataaaatgttaacattaagggaagctgagcaaagagtagacaggaactttcctcactatctttgcaacttttctgtcaatctaaaattatttccaaattaaaagtttattaaaaagtggggagataattaagtatcaacctatgcacacagaaacacaacacttggctgtagcaatgttctcataacagcaacagagggaaatacatcaagtgtcatttcaaaaataacccaggggtaaggaaggaagtagtgactgggagaatggctgagtaggcttttgtgtgctacaatcttctatttcttgacctgaattgatggttgcacatgtgtgttcattttaattcactgaactatattttttggtacattacccttcaactaaaaaaataaaattaaaacatttccctattactgatgaaggttagaatgaagagaacataaggtatataagtaggaaagaaaacctatgtagggacagatgttaatagttattaaatcctaagtaaaattttcagaacttggaaattaccaaatccaggagtggtcagattcctttatgaaggtagatctggagctacttaggccagatttttgtattttagcaaagttcctcagatgattctgacgcacacctggattataaaccactaaaccactgaactaccccaagaaggttacgtgacctcccagagctagaatgttccagaaatggtgcaagaattctattactggactcctggccctctactctacccacagttccaaaccctcagccaagattcctgagatattataccactagacaggaatatcagtaagttctattaactttaatgtgcttatcaaaaagattttttttctatcacggtggctttttttaccctataagacagaatcttttttccaacatattttcaattttacatttccagtatagcattaatacatttgtcatttattaaataatggcaaaccatagcatcataaagtattaagactgaagggctactaacctacctattcattttaaagatgaggaaacaaatgccagagacagtaataacttgtcaggagtttccagaattcaattctccttttttagattaataaattagaccagatttcttccccatggttactgtctgaggagattaactaatatgcgatacatgatgtcttgggttctttcatgtttaattcagtttgttgtgatttctaaaaatgtatctctttaaaacaattgctgctgtgcaacagtgtgatggcaagggaacagaaaacaacaaaaaaacttgattgaatacttcaatcaaagtgcttcttttttatgtgaggataaatcatactgaattaaggggaaatttaagaatattttttaagaaataacaatttcaggtaggcaattgtgaggaaaataacaatcatacaagccaaggccacgtgattcttccacaagccccagggtgagagatcgatgccctgctttaccaaatattcttcgccagtacatctgaaattaaacagaaaaagaatataacttcattcctagcatccgtcaaatgttactcagtatatccactgttccttaaaggagcctaaaattgaaccaagcctttaataattaccccttcagatatcatagctaacagtcattgtgtgtttacaattttgctagacactaacaaacaacatggacctaacttagttaattcctaaaacaatccaatgtgatagacattgtacacacttaaaagatgaggggactaacgtttaaggaacttgaccaggtttacagagtcatactttgaatcaccaagtttttagcctactcaaatttattggtttccaaatctgtaatgctgctctctccaaagggcagaaatatttatcaagtaatagttcccttatccctgataaagaaaatatctgcttaaacagatgacacctgtgacccttactaagatgatcaaagctcttacagtactctttacgcttacaaatagccataaaaaacaacacaggttaagaattccaaaaccaggaaaagaggtgtgcatgggtttcctgccaaagtcatgttctgtcagctcttgcaccaagactgtgaggagcatcacagatactcaggtacaagacattcccagcagactcagctatcaggtttaagccttaagtggcagctagagtagagtaggatgaactccttgccacaggttaggaaatcatcttgtactaaaaagaccttggacagccacagttactgcctgataccatttttgtgcaactcttgggaattcagcaattccaaaaacatacatagcctctcttttactataagaatagcttcctcctggccggctgcagtggctcatgcctgtaatcccagcactttgggaggccaaggcaggtggatcacgaggtcaggagacgagaccatcctggctaacatggtgaaactccatctctactaaaaatacaaaaaattagccaggtgtggtggtgggcacctgtaatcccagctactcaggaggctgaggcaggagaatggcgtcaacccgggaggtggagcttgcagtgagcggacatcgtgccactgcactccagcctcggtgacagagcgagactccatttcaaaaaaaaaaaaaaaaaaaaaggaatatcttcctcctttgtctactgaggatgaagcctcatcttccgttaccatgaagcccatggtggttcctccttatctggtcccatttttcccatccacttcatcctgaccaccctgatcaagccaaaagagagggacagaataaagaaaacctctctgtacagaggatttcctgtggacaattcaaaagagtaatttgtcctgttattcagaattatttatattctacttgaacattcaggagattgaggataatatcaacattctcttttctctcattaatttatgtatcaaaatcaaaccattagcaatcatagaaaaggcacgtgttactaaattcttaaaacaatattatccagtgttattagaatctgttttaacattatgtgaaaacggggtttttttctcaacttattcaagtgtttcttgtttttttagaggataaatcgattgatagggagtattccaagttaatttaaaaacaacaacacatgactatgcggcctttgatttcatgatgtcttccaaatgcatgaggcagtggaagtgccaggatcttggcagggaaatgtttactttctttgtgctattgctgcctatttcattcttactactgtccgtgggttgggctcagaagtatccgtgagttcagggacccatagatttcatataatccatacagttcaggaaccataagcccttgataaaatatcaaagcacctcacttcaatctcaaatgctctgaaaaccaagaattcaaacccacaatcaaaatatcaaaaggatcttttaaaaggcccaaaacaataagaaacaaacgtaagaaacattgctgcatgttaaagacaatttttactgcagcagaatactgaggggttgtgccacatgttcacatgcattcgcgcacaactcactttatggatgagaaaacgtaggctcggaaaaattcagtgcccctggaaggactcatacagatctaagcccagtagcctttatacatcacaccatggtagtaacaaaacccattttgacactgaacaaaaacttacgttgcatagttacaaggattgtttcctgttgcattgagtcctgggcagaagttttgtcccaaaaattcattatgctgcaaagcctataacacaagtgggagcagggcaaggtaaacagttttaaatttcaagaagtttccaaagagttatcacaatcatgccctctgagtttaatctttattgttatttctaaaaacatattcacagtctttgtctcaccaaaccaactaatgttattttccctggcaatcaagaaacctagggttgggattttggcttccaatacaaaagaagtaaagtattttgccaaagcgggagacctctggctatactacaccatagctccttcctccttctctccccaattttgtaactccataaacattctaattaaaatgatacagtggtgctcaatgagtattgttaatttacagtgacaatctttcgttcttgtttgttttcattagaaccagttgtaattcttggatgttagaagcttggttatactatattaagacacagatagtttactttggagttaatgagcttgcaaaagccaatatgactatgcttattatatggtctttgctcttctaattttcctttcattataaacatatgtattctagtgtcccatcctctcatttacttccttattgaactgaaatgcaacaatgtgtttttcatcaattagccaatctttctcctttactaggaggtatctcccctagccctttaaaggatgactgaggaaaatagcaaatgactccccagccttgtgttaaccaaggctaacaggaaattctcattccttgctcctaaaagggagtttctggatgggagactttcacagctcatggtcagggaaatgagatgaggacacttgatttccattgttcctagcttgggaatgcagtcacagtgacagacaaggaagacataccgtaaatccatatcgtggaatgctgaagtactgaagccatgacagccaagatgcaatggttgtgagattgaccaacagacctgaaaaaatctacaaaaagcaaatactaaaagtcaggcctgcttgagtaatttcatgcagaattctagagaataccctcttcaagtccctaccactttgtaagtatttcttttaaaaccaactctttcttgaagttctctccacttactcaagacactcactaaactcttctcctctgcatgtgcacatctctatatagctgaagtcatttacggttttaaaggaagaacaaaatatctaatacatattagatattccatttaatcgtaagatcctcaattgtcaagactatgtactcaactttatttgtaactgcaaataatggaaggtcaagaagcactgactattctaatgacacaaccactatgtgtgctcaccaatacacctggcattggaagaatctataccagataaatcctgagcgtcacatgcccactgcacctcacataagatttgttatttacaaaggtttgcagtctatatccatatgactttagcaaggatatgaggttctgaatgcaggcttaacataacccaaagtctagaactgatacagagtataatgtagtgagaggtagagcataagcaggatcagtgctatcatttaaagctgccaaaaagcaatagcgcaatggagatgccaggaagacctgctgaagattgacaagagaactaattgccaccacaagcatactggtatatgcataacaatgatgatgttgctggtatgacaatatatattcagacttgacctgaccaagtgcttagcatataacacagcatctctgagtaaaatacagttttatgactagtttttaatgttctgtgtagaaatctttaaataataataaatcaaacaaaacatttgtatttgctggatgacagtatgggaaatataaacaagcctatcacttcctcattaatgtttgcattggtagttttcaaatccagaaatggaagaattaaactatggcaagagtttgtgctaattatttttatttaaaggcatctactcctactctagcagacaggacatgttcctgtcaagtatgatgttgaaggggaaaaaaatgtaactggtttcattcacctgttgattcctctatgtgcaaaatttaggggcatgtaagattaggattaagtaaccattaaaaaaaaaaagataagcagaaacatattgaatgtcaggaacgaaacccagaaaggaggtacttagtagtgtgtgaactctgcaattttccaatatttttaaaacactctttttcaaaatacgagagggaaccaaaatagactactcaaaccatactctgttctgcttcttatgaggcttaatatgtgtcttggaaaacagtattataaatccaaccaaactatctctgctggtgggtaaacaagctagcagttcaatgctgtatgtgggaactttaaaacataaattaaaaatgttaaaaaaaaaataaactagcagttctctaatgccagcatgaaagtcgggcaaataatctgtaattctcaagagaatctgccgatcaaatgtcttctgatttttgaaattccaatttattaaggtttcataataggtcacaaagaaacgccttttaaaagctcattagtaacaatattaactaaaattattggaacttcattagaacagtagcaaaaaaggttggataagggcaaagaggaaagttagtatattctctaacataatctattccagtagatggccttaagtaaagcagagccccatttacagaatcctcaaaacaggttttacatgacaagtgaatgtgcaggaagaaatgaaggaaaaaaacaattccttatcagagcaaacacagttcagactcaccatcataaacacaaaacagatggtcatgagaagtgttgctacagaaaccacactctgacctgctgctatggccagtgccatggaactggctgaataagccaccatcataagggtaaacatcataacgaagaaggcatctgcctttggcttcaatccttagtcagaaagagaagaagtagttaacccaactgcctaggtcaccgtatgtttgggattgcttattgtgcaaatttaacactaatattttgagaaactaatattagaatgaaaaaaagtcatccactctccaaccaccctcggtctccaatgttgtgtctgtccatgtaactgcataaagttctcttataacacttatgtgccattatgtataattacagacaatttctgagttcctgagatgaagagctacaggcagtacaactaaccaaaattcaactgccttctcttttcacaggaaactcatcaatagcacattcatttgcccatacatcctcacattactcattgtgtgctgtaactttgtgagtgaagggactgggacgatcgggatgccatgacctcacagtggttgtagtatctgggggagggggagggggcctccataacccaagcctccccagacagatcaccacatcactctggattgaaatgagactaaattacgtttcataaactgctttctaaactgtagtgagctaatactacaggtaatacaatctgaagatttgaaacagccacaagaacaacaatcaggagtctggagatctagatcctaaccctgattgtttaggacacacctattatttgtcaaatggaaggtttaaactcaatcggtagttcttatcttgtagtgtcaaaatagatatttccgggggttttgtgtgtgtgcatgtgtttatcagtgaaatatatggaaatcagatgcaaggagcctggagtgaagcctgagcataatgcacaaatgagtctccacatctaccaaacaagtattttttttttaattaacaagccccaaaaggcaccgtctttctctcattaaagaagcagggatgggtaatatatattaaataaatacatatatatatatttaatcattttatgtatctctaagagattaaatatatttaatcattctatatatctctaagtgtgtgtgtgtatatatatatacatatatagagagagacagggagagatagatagatagatagatagatagatagatagatagatagacagatagaaaacatagataggctataaatatcccagcttctccagcatagtctcaaagttttataaattctttccatgtttgtgtataacacaagcatctctcagtaaagtgtagttttataagtggttttaaaagttcaggctgggcacatccgctcattcctataatcccagcactttgggaggctgaggtaggaggactacttgaggccaggagtataagaccagcatgggcaacacagtgagacccaatctttaccaaaaactccatctttctgtgtgccggtagtcctagctacccagaggctgaggtaggaggatcactggagcccaggaggttgaggctgcagtgagatatgatcaccactgcactccagcctgggtgacagagcaagaccctgtctcaaaaaagcgaaacaaagcaaacaaacaaaaaagttcagttgggaaacagtcttgacaaaaatagctgacagtgaacaactgtttcagagagtgcaaaatggacaggtgtttccttatctcatggtttggtttatagttttgagaaccaaaaatatgcttgcaaggtgcaactgacttcacccataggcaagactaaagacatgtccttttttgttttgttacatacttacctaacatgaagtacactatacaggtaaatataatacttggtaacatcctcatgggtaataaatcagataacagttttccaaggaaataagatgacactctgtagtatccgctgatgtattcatgtctatagaacaaaaatacgtatcatacatccaagattagtttaagaagccacagggcaggctagacttgtctgttacagacctctgctgacagcaggggttgaacaagccagcttcccacatcctcagggctagacccactatgcatgcccatgaataccttgggtgccagcctccctgagaaagcatcccatgaagctctgcgcacagcccctcttctcatgacactgttccctcctattgctgctctttctagctcctgaacactcagtccagggaaacagattccacacatcctccctctcttcaaagaatgcttcttttccttctttgacgggggctttccttgaagaacagcacttcagtagccgattttggcaggaatagaagcttttctttttccctatttctgatgaggaaggtggcctgttattctccaagccccctagtgcagcttcagatgactaagctcttcttacttcttctactcccaagttaaaaaaagaaaaagacttcttctttcaatgatcatgtcttccagccatacatccctgtcaactaccaaattgtaatctttcctcttcctgacatctttctcccacaattccaaactcttccacttccttcattatttccctttctaataattcctatatgtgacatgtacatttgggaaaatgtgatccatccttgaaaaatacccagcctgggaaacatagtgagaccttctctctacaaaaaaattaaaaaaaaaaaaaaaaacagccaggcgccccggtgcagtggctcacgcctgtaatcccagtgctttgggcggccaaagggggtggatcacctgaggtcaggagtttgagaccagcctggccaacatggcgaaaccccatctctactaaaaataccaaaaaaattagctgggtgtggtggcgggcacctgtaatcccagctacttgggaggctgagggaggagaatcgcttgaacccgggaggtagagattgcagtgagccaagattgcaccattgcactccagcctgggagacagagcgagcgagactctatgtcaaaaaaaaaaaaaaaagctaggcatgccagttactcaggaggccgagatgggaggactgcgtaagccccgcaggtcaaggcagcaatgagccatgatcatgtctctggactccagcctgggcgacaaagcaagaccctgtctccaaaaaataaataaataaataaataggaaaatacaataaattaaaccaggctgctctttactgtaagaatgccttccggctcgtgccacttccctggtccaccgagggctaagcatggtcacgttctttgtcgacttaatctccccacttccaagttgctgcttaatctctaccaagcccctcaaacttttcttgtgaaggtcatcagtatttactaaaaacaaaatatacttttcagtccctttattgcttgctctctccaacatttggattttctgactgtactcaaatctagaaaaactcttttctctggatatcaggtcccaaaggctcaggattttcttccctacctctggctgctttttctcaatgaatattggtaacccctatacatattttcaaaacatcatgttgtatatgatcaatatatacaatttttattcatcaatttaaaaataaattttaaaaagtactggtaatcctccggatcccatccttggccccaaccccagatgtaatcagtctaaccaatagcccctgctgctggacagccccgttcccagaacaaagacctactcacatgaagagcttcttctctaccacaaagagttccacggctgaaacactgctgaaacactggttggtcgtcaggaagaagagaaccccagctctgccatgaaaaggggaaccaaatcaccgcagtcaactcagcattcttagacagattttctacccacaaaactctttccacaaatgacagtgtataaagttaagcaggaaaaaaagggaaactgttctggttggaacagggaagcgtgaaccccatcaagcctctccccatctcttatgtctccacagtggtactcattttgaaactcacagtcttggattgttgtggaatgaattgcgtctccccccaccaaaattcatatgttgaagccccaacccccaatgtgatggtatttgaagatgggccctttggaaggtaattaggttcagatgaggttacaggatagggaggtggggagagtgtaatgggaagagcgtcctaataggaagagacaccagagctcttgctctgccacacaaggaacagcaaggaggcaagtctgcaagccaggtagagggccctcaccagaacccagcaatgctggcatcctgatctcagactttcagactagaactgagagaaaatacatttctgttgtttaagccacttgctctatggtattttggtatggcagccaggccaatacataattttaactaacaaaaatgccaagtaccattcctaatgtacaaacagaaaagtggtaagctaaataaagtctgtaaagattaagaaattcaattagccactttgattttaaagttgaacaaagaatgtaagtcatgtggaagcaaaatgaaagacagtgaagggaaccttcaatcaaccccttattatatgcataatctacatgcaccacactaccatcagcagggccgtgacattatccttgaccacgctaagacagccagccctctatgaggtttccagagtgctcagaggaaaccaagtgacacttactgataaagaaaaatctaatttgtgtatcgtaatgaaaaggaacactattagtgcttgtttctcagtgaagtaactagatttaaaaaggaaaatgttggccgggtgcagtggctcatgcctgtaatctcggcactatgggaggccgggtcgggaggatcatgaggtcaggagttcaagaccagcctaaccaacatggtgaaaccctgtctctactaaaaatacaaaaattagctgggcgtggtggcaggtgcctgtagtcccagctactcaggaggctgaggcaggagaatcgcttgaacctgggacgtggaggttgcagtgagctgagatcgcgccactgcactccagcctgggtgacagagcgagacactgtctcaaaaaaaaaaaaattaaaaaataaataaataaaaaggaaaatgctaagttaatctacactttgatacaaatatgcattttatgaaagcatgccaacatccctgaaacaccataacaaaacaatataattgacagtaagggtgtgagttgaaactgaaaaagaggtaagtgacacatcatttaaatggcgtaaaaacaagagaacattttaaaaaatgcaaacccaagtgaacaacacaattacattaaaagaaaaaaaagagtccatagatacctaaagaacaaagatctaagggaacaggctagggtcttttttgttttattttatttttagagacagagctgccctcggtcacccaggctagagtatagtggcatgatcataaactcactgcaactgagttgaactcctggcctcaagcaatcctcccagcttggcctcccaaagtgctgcagttacaaatgtaagccacggtgcccagccagagcagttttaaaagtatgtacatataattaaaatgagtgaaaaatagccaggcctggtagacatgcagttatctcactttctgtacacaaataaacctaatatcaagtaaaaagctaatttcagaacatggaacatagcaaagattcaattcaatttgttgtcttaaatctatcagtacagtaatgtccataatgattctgaaaaagtagacaatggaaacgttccttctaaatactaagatgatttattttaaacacagttttttcttattaaggaagttaattcattctaattctttcaaggtggtaatccacatctgttatatctacttattggtctgaatattttttattttgattttttaaattataaattggcatattatggttgtatatatttgtggggtaccaagttatataattcatgaatcataagtgtgaaataattaaatcaagctaattaacacatccatcgtctcaaacatttattttttgtggtaaaagtatcttaaattttagcaattctgaaatttacattattatttactgtgttcaccacattgtgcaatgtatctccaaagaaaaatccttattcctcctgtgtaactgaggttttgtaccctttgaccatcatctctccattccccacacacctctagcctctggcaaccaccattctactgtctctttcagttccattgtttcagattccacattaagtgagattatgtgacatttctgtgcttagctttctgcgtttggcttatttcacttggcataatattctccaattacatccatgttgttgcaaatgacaaaatttcttttgtttttccactgtgtatatataccacattttctttatcaaatcagacccttcgggtgattccgtatcttggctattgtgaacaatgctgcaataaatatgagggtgcagaaatttcttcaataaactgatttcacatctttggggtaaatatctagaagtgagatgactggatctgaatactgtttttaaagtataccttttcccttaatacacactaatttgtttagctatcaccacaactctgtaaagcagttattccagaggtagctattaattcaaagatgcttatactctacatatgattaaaacccagtttctcagttacacgggttagagaaagagcagagagtgctttcctctctcagagaattcatccccaaagaagagaactaaaccactggcctcgagcagttttaaattatgaagtactaatattcacccctgaacaaaactttgagaacctgtttccagagatgatgctgaaacattttttcctcatcaataaatcactaatcatcccaggagggattaaatcatatacacaggccactttaacatagtccaaatgcttatttaaaaaatgatactggggtcaacgagaagcagtgggaggaagaacatcaggaaaaatagctaatgcatactgggcttaacaccaaagtgatggattgataggtgtagcaaaccaccatggcacacgtttaactatgtagcaaacctgcacatcctgcacatgtaccctagagctttgggggaaaaaaaaaagatagcaagcttaagtcacaaatacaaattatgagcccaggagttcaaagctgcagtgagctatgactgcactactgcacaccagcctgggcaatattgtgagattctgtttcaaaaacaaacaaattaaaataagattaatgccctatttctccagaaaacatctgaagaaacacctaaagttcttctttatttctctggatttttctaccaagagctttaatggccagatttccagtcctcttcaaagttccagttgaggaccaggttactccatgtcctctccaaatgcttcctgctgcacaatataaaaggcccactgcctttagatcctgtgatatattctgtgctgggttaagacatggcatctacacagcacacaaaccatcaattactagcaagtctggaaataatccagatacctcagccctcagggaaagtaaaaacaacaatgacatcactctggtaaactgctgtttaataacactctcatcgtagagtaacactatctgattccatacaaaagaatttattttacttgagtgaggaaccaacttttatgcttattctttaaaaaataatcagcctttccagacatcaaaataggctgcacataagcgtcttcaactttcctcaatagtaaaatggggatactaccatctaccccctctaaatcactgggtggtaacctgagactatggacagcaagcactacggagcacagtatctgccacaagtgttctccatacatgaaataaccagaactctgagggctgtgaaattcctgagtgcttatgttcagaacacaatacagtcgataaaaagtcccctcataaaatgaggtttttaagggtccactgtgactgaaactaggtaaggatcacaacactaacaaaagtgctaaccatataacaggaaaagctgagtcccacccccatcacacccctaagtcaaacatatatatttaaaaagtgacagaaattagctcacaggcaacaaaagaagaaattgatcaattggactacatcaaagttaaaaatgtttatgcatcaaaggacactatcaatactgaaaagacaacccacagagtggggaaaaatatttgcaaattatgtatctgataagggattaatatctcctcaaaaatataaagcactcctacaactcaacaacaaaaaaacaaacaattcaattttaaaatgggcaaaggacttgaatagacatttctccaaagatccaatggatctctactatttaaaagggagaaaaagaaaagtgttggtaaggatatggagaaactggaacccttgtgcactgctggtaagaatgtaaaatggtacggccactgtggaagacggtatagtagttcctcaaaaaaattaacagaattactatatgacccagaaattctaattctgggtatatatccgaagaattgaaagcaggaactaaaatagggttttttttgtttgtttttttaagagacagggtcgaactctgtcacccaggctggactgcagtagtgcaatcatagctcactgcaacctagaactcctgggctcaagcaatcctcccacctcagcctcccgagtagctgggactacagacacatgccaccacacctggctgaaagagatatttgtacacctagggagcactgtttacaacagccaaaaggtgaaagcaacccaagtttccatctatagatgaatggaaaaacgaaatgtggtatgtacatacaatggaatattattcaaccttacaacggaaagaaatctgacacatgctacatgaatgagccataaagacaacatgctaaaggaaatgagtcagttaccaaagaatatctactgtatgattccacttatatgagggtcttagagtagtcaagttcagagacagaaagtagaatgattgctgccaggggttaggagaggcagatatgagatgggaagttattgcttaatgggtacagatattccacttgagaagacaaaaagaattctagagttggatggtggtgatagttgcataacaatgtaaatgtacttaatgccactgaactgtacatttaaaaataattgggccaggtggagtggctcacgcctgtaatcccagcactttgggaggccaaggtgggtggacccacctgaggtcaggagttcgaagccagtctagccaacatggtgcgaccccgtctctactaaaaatacaaaaattagctgggcgtggtggtggatgtctgtagtcgaggctacttgggaagctgaggcaggagaattgcttgaacccgggaggcggagattgcagtgagctgagatcgcgtcactgcactccagcctgggcaacagagcatgactctgtctcaaaaataaactgactcatcctaccctcaataaaagaatgacatttacactatacttgtcttaaattcaaattcttaatggatttcaataagcttgaagaaagtaacagcattttctgaaaatcaagatccaaatttacttacctgttctggattccagtagaatcattttttagcccaaagtaaatggcacctataaccagtcccagtacgactgtgacaatgatcttttcaaaaagaaaaatgcaaaaaaaggggaagagtttcaattagagataaaaacttatacacaccatttattagtataatatatggttacataatcagatctctccattaagataaacactcaatggcttggccaacgtccctgggagaaaataaaacagcatacattatttagactgcttcctaagttaaaaattaagttatctgtgctttggggagagtggtaggacacaaagcacactgctggaaaagctggacttcctcccattgcaccacccagcagtcagttcagggtctgcttcaggttactgagcttgtgaataccacacaggatagcagagcaatgcaagtatgtagcaaagcaaagtccaagtgcctaagagttttgaccctgaactgaactctcaacctttgtgccaatgaacatgagtcattttatatttcaagaggttaaagtgaaaacaggatatctttattcttaacattaaaaataaataaaaattttaaagcacacattaaaaaaattctaacaatggaattttgcacagtgaggaaataggggtgagatggagcctgcctatccaacctctagggagtccatgcctgcactggaaaagtgcattgtcactgtcaccaaagcatttggccggctttctctgtgcacacactgcatgcttccactacccatctcctgtcactgcttcctcatcgcttcagccagtgaggcctatagccaatgctgcagacctaagctgccaattctttgctgttctcacctatcttcaccactcaattgatttctatagctcctaaggagactggacaaacaccaatcttgtttctaggataaagggtctcttaaggacacttcaataagcaaagggttaatttaagggttacgttatgatataatttatctgagaaaatcctatttatatttactcgtgagttaaatattaaaaaacaagaaatgggctgggcgtggtggctcatgcctgtaatatcagcaatttgggaggccgagggggcagattgcctgaactcaggagtttgagaccagcctgggcaacatggtgagactccgtctctactaaaaaaaaacacacacaaaaaaattagccaggcatggtggtgtacgcctgtagtcccagctactcgggaggctgaggcacaagaatcacttgaaccctagaggtggaggttgcagcgagccaagatcataccactgcactccagcctgggcgacagagcgatactgtctcaaaaaataaattgataaataaataagaataaaaaaataagaaatggtaatctaaagaagacaaaatatcctaccatatcttggaatcttcaaagttaaaaaaacaaaatctcaatactgcaacagtctaatggtatcaagatttaaagtaactgatcaaggacacttttggcatgaagcaaaccgaactgcaaaaacagtaccatcatctgtgataactagtttgtgaagaacctagtctggaaagaacattattccaatgtttctacttatgagctgtcttttaaaattcacttagaaattttggggggaaatccattatgctggcatattttcattaccctcagaatatacttcaacagaccaagcttccaaaataaatgcagatgactgtatcaacaggcatgcatgaatgtgcatacaagagtctacgttttcacacagtaaaacttttaagaatattcaattcaggatttttttttttttttttgagacagtctcgcactgttgccctggctggagtgcaatggcgcgatctcggctcactgtaacctccagctcccaggttcaagcaactctcctgcctcagcctcccaagcaactgggattacatgcgcccaccaccaagcccagctaattttttgtacttttagtagacacagggtttcactatgttggccaggctggtctcgaactcctgacctcatgatctgcccgccttggcctcccaaagcactgggattacatgcatgagccaccatgcccggcccagacttttcaaactaaacattccaaatgctttgtcaagttttcattcaaacttgttatcttatactaacactgagtattatgattaagatgtttcctaaaagtttcaaagttctaaaaatgttttcaaagtcagctttcaaacatattgacaaaataatcaatcccgtaaccttggcatgcttttataaggtgtgtctgtgttattctttctggcattaaagaaaggaaaacaaacaggcaaactaaacagtgcacaatggagtgcacagaccccatctgcttccaagttgagctgttcagaaaacccttggcaccttaaatgaacatgcaatcttctcatacagataatccattcattctaagattttccaaatacaacctttggaagatgcattatcagaggccaagtttgaatcatgtaaagaaataactagttcaagccaaagtgcagctgtaaagcaacagattcaagatttatcagtagagagtcataaaacattttaacaactcaattttcaagaactcagaattaaaacaacatacaaaatcataaaccctgaatcaggaatcattaagctatagcccacaggtcaaatagggccagccacctatctttgttcacctatgagctaagaatggttttttactttattttttattattttttagagacaaagtctcactctgtcactcaggctggagtgcagtggtgtaatcatagttcactgcagcctcaaacttctggtctcaagcaatcctcccacctcagccttttgagtagttaggactacagacatgcaccaccacacttagctcattttatttatcattgaataaaaagtcaagaataataatatttctcacaatataaaatttatataaaattcaaatttcagtgccaatgtataatgtttcattggaataaaatgaaagttacctttttttttaagatagggtcttggccaggcacagtggctcacatctgtaatcccagcactgtgggggactgaagcgggtggacccacctgaggtcaggagttcgaagccagcctggccaacatggtgcgaccctgtctatactaaaaatacaaaaattagctgggcatggtggcgggcacccgtagtcccagctactcgggaggctgaggcaggagaattgcttgaacccgggaggcggaggttacagtgagccgacacagcaccactgcactccagcctgggcgacagagcatgactctgtctcagaaaaaaaaagggggtcttgctttattgcccaagctgttctcacactcttggcctcaagcatccttctgccttggtctcccaaagtgctggggttataggcaggaaccactgcatctagccagcctttcgtttattattggaatactgccatgttcatttattcatgttatgagcttggctgctttcacactaaaacggtagagctgactacctgagacaaacaccacctgatctgcaaagcctaaaatatttactacctgatcctttacaaaaaaaaaaaatatatattgcctactcctgccctaagctaatattccagtttttcacaaatcgaaacaaaacttgtcctgctaagcagatgctcagggagatacaaggtcctattcttaatctaagagactgccactgctctgaacatggctggaattccttttgtgaaagtgagttcactgatgaggcagggaagctaaacctagaggcactaggccaggtgttagcattggaaggaagcccagtatcaaaacatgcagaatctcagtgtgtgaaaaacagctctgtgttctaattatgccctctccagtattgccacataggcgatttggacaagacatttataaaccattttttgaagcaagataattcaagttattttccaagtaagaaaaatctaatgcatacatcacactaaaaaagcaattcattacattatttcactgttgacaataagtaacccaggttgatcctaccagactgatttccaaatgatatcaaatctatgctcaaagaataaaattttgcctttaattgatagtatataaaagtgccagtgttctgacagaaacaccaaattatacgtaccaaaaacatttggagaaattagcaatatggttcaactagggatacaagctcttagataaatttatatatatacttaactagcagtatggctatacatacatatatgtggctatacatatatacatatatatacataattagcagtatggcttaactagggatacaagctcttagatatattttatatatacttaagtatagaaattatgatgcacaagtttaaacgtcagtaatattttactagagccaacaatgtgccatcttttagtactcaacagaaactcaatattgttaataaaaataacagccccaaaataaccagctaaattgacttctttgaagaatggaccaatgaactgggagtactaatgttttgggtgacagaggggttaagaataacagaaaaggccaggcatggtggctcacacctgtgatcccagcactttgggaggccaaggcaggaggatcgcttgagcccaggagatccagaccaggacaacatagtgagaccctgtttctacaaaaaattaaaaaatcagccaggtgttgtggtgcacggctgtagtcacagctactcgggaggctgaagtgtgaggatcgcttgagccaagagtttggggttgcagtgagctatgattgcaccactgcactccagtatgagtgacagagtgagacccagtctctaaaaaaaaaaaaatgtgtaaagaaaagaataacaaaaaccacaaggagtaataatcaccaactatcacagagccaaccaaggaacaaagaaacattatctcattttgattaacagaaagttaatctaacaatgaatagccttgttctgtgaactcaaatttgcttactacatttgtttcacctgtaaactgtctaaggaaggtaaatgacaaggaacagcactttgcacacaggctcttcccttggagtggccagcacatactccctttcaggtgtattcagtgacagtaggtgaaggtttccctgatcacctgattccaactgcaaatcaaccttcttctccctacttctctctcttcctcccctttctccaccccttctctgcttaaactttccccatagtttcttctaccatctaacatgctatctatttaatttctttattatttatcataactgtcttcctcaaaaaattagctccatgagcagagttttatttttgcccattttgttcactactgaattcacatccctaaagcacagcacaggccctataagaacaagttgaatgaatcagtgaacaaaagtgaacagctaccagaaaaccccaaaactggctgacacttctttcacaatttcccaaaaaaaaaatttttctactcagattattcattacagcttgtctaaatcaacaaaaattctgagttaggtagtctaagaaaccactaaaaaaaagaacctggccagatgtggtggctcacacctgtaatcctagcactctgggagactgaggcaggagaatcgcttgaacccacgagttcaagaccagcctgggcaacacagcgaaaccccatctctacacaaaacacaaaaattagctggacgtggtgggacacgcctgtagtctcagctattcaagaggctgaggtgtgaggatcacttgagcccagggaggtcagggctgcagtgagctgagttcatgccaccacactccagcctgggcaacagagtgagactctgtctcaaaaaaagggaagctttccaaaagtaaaacttaattgtcctttatttgttctgctgactggttctatatcccaggtggagtgaagataacaaataattggaagggtgggtagaagataaacatatcctgaagcagatgataacagaaccacattgttcccatttgagtatttcaaaagaatctgctggttacctgagctatagaggcctggggattacccagcaagtttttgaatgaacgcttggaaacccatctgagttgatgacagaaggaggtggtgtagctgatctccttgaagactgtgatcttcttcttcttctcacccccggaaagttgatgtaattcagcttttgtctctttgtagaaggaggagttgacataaatctccgctaatttttctatgagtggcttatcctgcttggaaggctctatgatctctgtggctttgcaatcagtggataaaaaggaaacacaaacaagataacaacaaatttagcccattttttctgtgaaccctttcttggatgcttccctaacaccttcattctaaagctttagaaagaaaaaataggccaggcacggcggctcatgactgtaatctcagcactttgggaggctgaggcgggtggattacgaggtcaggagttcgagaccagcctgaccaacatggtgaaaccctgtctctactgaaaatacaaaaaaaattagcctggcgtggtggtgcgtgcctgtaatcccagccactcaggaggctgaggcaagagaatcgcttgaaccagggaggtggaggttgcagtgagctgagatcacaccactgcactccagcctgtgcaagagagcaagactccatctcaaaaaagaaaaaatagaaataaaaaattattagctctgtcattagaaaagtataacaggccaggcacagtggctcactcctgtaatcccagtattttgcagggcagaggcaggaggatcatgcgaggccaggaattcaagaccagcctgagcaacgaaacgagaccctgtctctataaaaataaataaagtaagtaataaattaaaatgtatatttaaaaagagaaaaagaaagaaaaagaaaactacagagaaatagcctgtctattgccatagtcttatgaatatagcaaacaaactgacgttttctatttgaccttaattcttttaaaatagacttcttaccatatagttctaattcttaatataaaattctggtcgtggccaggggcggtggctcacacctgtaatcccaacactttgggaggccaaggcgggaggatcacttgaggtcaggagtttgaaaccagcctggccaacatggtgaaactccatctctactaaatatacgaaaattagccgggcctggtggcacaggcttgtaattctagttgctcagtaagctgaggcaggagagtggcttgaacctgggaggcggaggggtcagtgagccgaaatagcaccattgcactccagcctgggtgacaagagctagattccttctcaaaaaaaaaaaaaaaaatctggttgttgcttcctactatatgcaaatgcatatattgccaagtttcttattttaaaaacactatataaacactgagcattttttaaaatgttaactcctcttggaactgacaacaccatataaattctcatttataaattaatcaaaaacaccaacagcactcacagacaacaaaatatttgtgttgactggtatcagaagactgcatcaacagaaattcacaaagccacattttaattagccaccacattgctaaacttcagccaattcaattaggcaaaaatctgggactgtaacagattcatatacctttaaagtcttcttctctgtttaatgccacagcagtggaatctccattaatgatgtccaagaagaagtctgcagggttattataggcctcacagtgataacctatgaaagaaggcagctcaaaaacacaaacttgatggtcttggaaaacaaagagaactcactttcagagggtgagggaggtaaggctagagaagacagaatctaatgacttttccttaactttctttctctcttcttcccacgtaattttaccctttctttttatatattcagtctctctctctctctctctctctctatatatatatatatatatatatatataatttatttatttattttgagacagggtctccctctgtcacccaggctggaatgtggtggggcaatcttggttcactgaaacctctgcctcccgagttcaagtgattctcctgcctcagcctcccaagtagctgggattagaagcacgcatgaccacgtccagctaatttttgtattttcagtagagacacagctttgccatgtcggccaggctggtctcgaactcctggcctcaagtgatccacccgcctcggcctcccaaagtgctgggattacaggcatgagctactgttcccagcctatcacacaatatttcggcaattctttgtctctgggccaaaaaaaaaaaaaaaaagaaagaaaagaaaacactccaagccaaccttggatttgcagggcattttgcattagtgcttggtccttacctatcataattcatgagacctgaaatagctatcagtatgctctggtgcttaacagtacttcctcaaaaatctaaatatagacccaagaaaaaaatccaaaagcccaggtgtgttctgctctctgagttcaccgacagaatgccagaatgatagaacccacattagcaatgactacttccccacatactaaattcagaggtccagcgctgggtgcaatggctcacatctgtaatactagcacttcgggaggccgagaccagcaaaccacttgagcccaggacttccagaccaacctagccaacatggcaaaaccccatctctactaaaaacacaaaaattagccaggtgcattggcttatgactataatcccagctactaaggaggctgaggcacaagaattgcttgaacctgggaggtggaggttgcagtgagctctgaaagcaccactgcactctagcctgggcgacagagtgagactctgtctcaaaggtaaattaattaattaattaattcagaaatccaaatcaactgctgtgctgctgtaattccaaatagagaacaaatcccctgagcagtattctcgatagaacatggccagcacagcacacctgaaccattcagctttggatgatgagatcatctgaactcagcgtggcctgaagtctgactcttagttcatcccctttattaaaacctaattaagaaacatggccaatgaatatctaaaattatatttaggatcatagggaatcatttgtaatcatatccaaatatatctaaaatgatgcagaccgcacaagccattaaaaaaaatcacacatttcttttttttttttttttttttttttttttttttttttttgagacggagtctcgctctgtcacccaggctggagtgcagtggcgcgatctcggctcactgcaagctccgcctcccgggttcacgccattcacctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaaaaatcacacatttctatctaaaattttaaaaatcacacatttcaatttgaaataaaaagaaccatgctgtccaagattgttagaaattttggcccatctaagtcaggtttaggactaaccactctattgaccgatacccactcaagggctaaagctgcaatctatagttaccagaaaattaagtagtgtctgccggtcacagtggctcacacctgtaatcccaacactttgggaggccacagcagattgctttagctcaggagtttgagaccatcctgggcaacatggcaagaccccgactctacaaaaaatacaaaaattagatagccatggtggcatgtgtctatagtcccagctgcttgggtgaggtgggaggatggcttgagcgcggggggttgaggctgcagtgagtcaagattgtgccactgcactccagcctgggtgacacagtgagatcctatctcaaaagaaaaaaaaaaaaccttaaataaaatttgctgggtgcagtggctcacacctataatcccagcacgttgggaggccgaggtggcagatcacaaggtcaggagatcaagaccatcctcctggctaacagggtgaaaccctgtctctactaaaaaaatacaaaaaaattagccgggcatggttgtgggcgcctgcagtcccagctactcaggaggctgaggcaggagaatggtgtgaacccgagaggcagagcttgcagtgagccaagatcacgtcactgcactccagcctgggcaatagagcaagactccatctcaaaaataaaaataaacaaaattaagtagcatttccatgagtgctcatcaaggcagaccaacatgtgcaaggggaaaaaattttaaggcctcatctgttatatggtcaagaagacaatcatattaggccttcccaaaaatgttcaagtgacagaataaatggctataaggccaacatattaattactgagcttttaagaaatggtcactgtaactaggaagcagaatataggcccagtagaaatacacacatgcatgcacattgaaataagacaagaaagatacctaaataacaagctggtgctacaaaaatgaagaaaaatactagcaccaaatggaacaaacacattttgaagtgatagattctcatggtatgtctacccaaagaccaaacagcactcctgcagaccccctttgctctccttcaggattctattaatgaagcattttacagcataaaaaagtcaaccataccagctgattcaaagtatcccaaggcctcctgagcaggcccgtggaacataagtcttcctgaggccaataaggtgaggctatcaaacaacttgaagatggaatatcgaggctgatgaatggagaagatgattgttcgtccctgcttagacatcctaagttaaaagtgagacaatactaagtcattaaatatctgaaacttgtatttctcagtaaaatactctattcttgcctttagattgtttgctctagttcagcctgactttgtcttactaacttttcatctcatattatttagctatagttagcaaacctaaattcaatgcttttattaaaacagaataggaattttcagtgtgttgtattgacaatctagaatcaactagaatagttattaaaaatgcagattctaggacagtcttcccagacattgaattagaatctctggcagtaggtctagggaatccatattttaagaagcaacccaggtaatctgcaagtatttacaagtttgagaactaactatggactgcatattaaaacaatggtcatatatctcattctgacttatcatttaggtcttctggctctttaaaaattggttttcactcttctgccctaataatgcaattaacataactgagtacttactatgtctttgctaaataatttagagataacttcatttcaattttcacaatattgtcatgaggcagttccaatattattattattaccctcattttataaatatgtcttaaaggatcaagcaactggccaagggatcacagttagtaagaggcaaggctgggatttaatctctggtctaagtccatgaccaaaatagtgctaaagtaccttttcacaggagttatgacttacaggttgataaggtttggctgtgtgcccacccaaatctcaccttcaattgtaacaatccccacatatcaaggatggggccaggtggagataattgaatcatgggggaagttcccccatactgttctcgtggtactgaaaaactctcacgagatctgatggttttataaatgggagttcccctgcacaagctctcttgcctgctgccatgtacaacatgccttttcttctttgccttccacgaaaattgtgagatctccccagccatgtgcaactgtaagtccatgaaacttctttcccttataaattacccagcctcaggtatgtctttattagcagtgtgagaacaaactaatacagtaaattggtactggtagagcaggatgctgctgtaagatacccaaaaatctggaagccactttggaactgggtaacaggcagaggctggaacagtttggagggctaagaagaagacaggaagatgtgggaaagtttggaacctcctagagacttgttgattggctttggctgaaatgctgacagtgatatggacaatgaagtccaggttgaggtggtctcagatggagatgaggaacttgttgggaactggaataaaagtgactcttgctatgttttagcaaagagactggtggcattttgcccctgccctagagatctgtggaactatgaacttgagagagatgatttagagcatctggtagaagaaatttctaagcaacaaagcattcaagaggtgactcgggtgctgttaaaagcattcagttttattcattcacaaagatatggtttgaaattggaacttatgtttaaaagggaagcggagcatacaagctcagaaaatttgcagcctgatgatgcgataaaaaagaaaaacccattttctgaagagaaattcaagcctgctacagaaatttgcataagtaatagggaaccaaatgttaatcaccaagacaatggggaaaatgtctccagggaatgtcagacgtctttacagcagctcctcccatcacaggcccagaggcctaggaggaaaaaatggtttcctaggccaggcccagggccttgctgctttgtacagtctcgagacttggtaccctatgtttcagccatggttaaaggggaccaacagagagttggcagcttccatgtggtgttaggcctgcccttcacctagatttcagaggatgtatggaaatacctggatgtccaggcaaaagtcaactttaggggtggagccctcatggagaacctctgctagggcactgcagatgggaaatgttgggtgggagcccctacacagggcccccactgaggcactgcttagtgcagtagtgagaagagggccatcatccttaagaccccagaatggtagatccaccaacagcttgaattgtgcatctggaaaagccacagacactcaataccagcctgtgaaatcagccacaaaaggggctgtgccctgcaaatccacaaggccagagcctcccaaggccctgggagcccacctcttgcatcagtgtgacttggacgtgagatatggaatcaaagaagataatttcagagctttaagatttgactgcccctttggatttcggacttgcgtgggacctgtagccccttcgttttggccaatttctcccatttggaacaggtgtatttacccaatgcctgtactcctattgtatctaggaagttactaacttgcttttgattttacaggcccataggtggatggaacttgccctgtctcagatgagactttagaatgtgaacttttgagttaatgatgaaatgagttaagactctgggagactgttgggaaggcatgattggttttaaaatgtgaggacatgagatttgggagggaggggccaggggcagaatgatatgtgtccccacccaaatctcaccttgaattgtaataacatttgtaataattataataacaatacacaggtggaagaagggccaaaatcactgttcaaaactgttactattcaaaatattttatgtgaagagtcacttcaattttaacattttctaagaacttactgtatgctagcagtgtacacaaaaacattctgcctcaaagaggatcaggccagtaggtcaacaatttcagtacaatatgaaatagaagatgctaaggattcctcataagcaaaatgggagactcacaacccagtctgaagatgatataagtagagtaaaaaaggcccaacaggaggaagctaagaagaaaaagaaaaagtactgaaggtggaagaataagatgaaaaaggtgtgaaataaaaaggtctactcagaaaactacaaaatgttcagtgttatagagcagagagagggagaaaaaatgtgtatgtgtgtgtctgttggtgttgagtaaagaagctaaagagacagcagcaaaacaggcccaacccccctacaccctcatcacagacatccttccctacattcttacctgctttgtttttcttgataatgcttttcatttgttaactgactttcactccaacagaagaggaagaaattactttgatcatttctgaaccccctgccccaagaatatctgggacatagtagtgataagatattaactaaagaataatgtttccagagcatttaccttttcaggagcaaaaggacagcatttgctgtgcttgagtctaagccagttgtaggctcatccaagaacaagatggaaggatcagtgataagctccattcctatactagtcctttttctttctcctccagacacaccacggataaactgagttccaacctaaatcacaaatattataattgtcaatgataacaaccagtcattatcatttggtgagctcctaacgtgtgccagtcctgtaagagacactttatctcattaagttcatttattctgaacagcaaataagtggatacctggtagaaaaagtaggtatctcttttatcagatgagtaaacttaggttcaggtcacagctggtcagtaactaagcctgatacaaagcacctccttgggtgaggctatgcctcacccaggaagcacaaggggtgggggaagtccctcccctagccaagagaagccgtgagggactgtgccacgagggatggtgtattccggcccacatactgtacttttcccatggtattcacaacccgcagaccaggagattcccgcaggtgcctacatcaccagggccctgggtttcaaacacaaaactgggtggccatttgggcagacactgagacagctgcaggagtttttttttcataccccagtggtgcctggaatgccagcgcgacaaaactgttcactcccctggaaaaggggctgaagccagggaaccaagtggtctagcctagctcagcggatcccagccccacagagcccagcaagctaagatccactggcttgaaattcttactgccagcacagcagtctaaagtcaacctgggaagcttgagcttggtggggggaggggcatccaccattactgaggcttgagtaggccctcacagtgtaaacaaagcctctgggaaattcgaactgggtagagccgaccacagcttggcaaagccactgtagccagactgcctctctagattcctcctctctatgcagggcatctctgaaagaaaggcagcagccccagtcaggggtatatagataaaactcccacctccctgggacagagcagctgaggtaaggggaggctgtgggcacagcttcagcagacttaaacgttcctgcctgctggctttgaagacagcagtgaatctcccagcacagcgctagagctctgctaagggacagattgcctcctcaaatgggtccttgacccctgtgcctcctgattgggagacacctcccagcaggggtcgacagacacttcatacaggagagctccagctggcatctggcgggtgcccctctgggaacaaagcttccagagaaaaaaaacaggcagcaatctttggggtatctttgctgttctatagcctctgctggtgatacccaggcaaacagggtctggagtggacctgcagcaaactccagcagacctgcagcagagaggcctgactgttagaaggaaaactaacaaacagaaaggaatagcatcaacatcaacaaaaaggaaatccacaccaaaaccccatccaaaggtcaccagcatcaaagaccaaaggtagataaatctatgaagatgaggaaaaacctgtgcaaaaaggcagaatgcctcttctcctccaaaggatcacagctcctcgccagcaagggaacaaaactggatggagaatgagtttgatgaatagacagaagtaggcttcagaaggtgggtaataacaaactcctccaagctaaaggtgcatattctaacccaatgcaaggaagctaagaacactgaaaaaaggatagaggaattgctaattagaataaccagtttatagaagaacataaatgacctgatgaagctgaaaaacacagcacaagaacttcgtgaagcaaacacaagtatcaatagctgaatcaatcaagcggaagaaaggatataagagattaatgaaataaacttaatgaaataaagcgtgaagacaagattagagaaaaaagaatgaaaaggaacaaacaaagccttcaagaaatatgggactatgtgaaaggacaaaacctacgttttattggtgtacctgaaagtgacagggagaatggaaccaagttggaaaacattcttcaggatattatccagaagaacttccccaacctagcaagacaggccaacattctaattcaggaaataaagagaacagcacaaagatactcctcaagagcaaccccaagacacataatcatcagattcatgaaggttgaaatgaaggaaaaaatgttaagggcagccagagagaaaggttgtgttaccaacaaagggaagcctatcagactaacagcagatctctctgcagaaaccctataagtcagaagagagtggggaccaatattcaaaattcttaaagaaaagaatttttcacccagaatttcatatccagccaaactaagcttcataagtgaaggagaaataaattcctttacagacaagcaagtgctgagggattttgtcaccaccaggcctgcctttcaagagttcctcaaggaagcactaaatatagaacagaaaaactggtaccagtgactgcaaaaacataccaaattgtaaagaccatcaacactatgaagaaactgcatcaattaatgggcaaaataaccagctaacatcataatgacaggatcaaattcacacataacaatattaacctgaaatgtaaatgggctaaatgccccagttaaaagacacagactagcaaattggataaagagtcaagacccatcggtgtgctgtattcaggagacccatctcacatgaaagatacacataggctcaaaataaagagatggaggaagatctgtcaagcaaatggaaagcaaaaaaagcaggggttgcaatcccagtctctgataaaacagacttaaaaccaacaaagatcaaaaaagagaaagaagagtattacataatggtaaagagatcaattcaacaagaagagctaactatctaaaatctatatgcacccaatacaggagcatgcagactcataaagcaagtccttagagacctacaaggagacttcagactcccacacaataatagtgggaaacttttaacaccccactgtcaatattagacagatcatcgacatcaacaaggatattcaggacttgaactcagctctggaccaagtgaacctaacagacacctacagaactctctaccccaaagcaatagaatatacattcttctcagcaccacacagcacttattctaaaatttatcacataattggaagtaaaacactcctcatcacatgcaaaagaacggaaatcataaccaacagtctgtcagaccacattgcaatcaaattagaactcaggattaagaaactcactcaaggccaggcgtggtggctcatgcctgtaatcccagcacttcggaaggctgaggcaggtggatcttgaagtcaggagatcaagaccatcctggctaacacggtgaaaccccgtctctactaaaaatacaaaaaattagctgggcgtggtggcgggcacctgtagtcccagctactcaggagactgaggcaggagaatggtgtgaacctgggaggctgaacttgcagtgagccaagatcgcgccactgcattcaagcctgggcaacagagcgagactctgtctcaaaaaaaaaaaactcactcaaaactgcacaactatgactgggcgtggtggctcatgcctgtaatcccagcactttgggaggccgaggcaggcggatcatgaggtcaggagatcaagaccatcctggctaacgtggtgaaatgccatctctaataaaaatacaaaaaattagccgggctaagtggtggaagcctgtagtcccagctacttgggaggctgaggcagaagaatggcgtgaacccaggaggtggagcttgcagtgagctgagactgcaccactgcactccagcctgggcaacagagcaagactctgtctcaaaaaaaaaaaaaaaaaaaaaaaaaaaaactgtagaactacacggaaactgaacaacctgctcctgaatgactattggataaataatgaaatgaaggcagaaataaataaattctttgaaaccaatgagaacaaagacacaacgtactagaatctctgggacataactaaagcagtgtttagagggaaatttatagcactaaatgcccacaggagaaagtgggaaagatgtaaaatcgacaccctaacatcacaattaaaagaactagagaagcaatagcaaacaagttcaaaaagctagcagaagacaagaaataactaatatcagagcagaactgaaggagatagagacaggaaaaaacccttcaaacaaatcaacgaatccagggctggttttttgaaaagtttaatagaatacatagacctcaagctagactaataaagaagagagaagaatcaaatagacacaataaataatgataaaggggatataatcactgatcccacagaaatacaaactaccatcaaagaatactataaacacctctacgcaaataaactagaaaatctagaagaaatggattttcctgtacacacacaccctcccaagactaatccaggaagaagtcgaatcactgagtggaccaatagcaagttctgaaattgaggcaataattaatagcctaccaaccaaaaaaggtccaggaccagacagattcacagccgaattctaccagaggtacaaagaggagctggtaccattccttctgaaactattccaaacaatagaaaaagaggaacttctccctaactcattttatgaggccagcatcattctaataccaaaacctggcagagacacaacaaaaaaagaaaatttcaggccaatatccctgatcaacatcaatgtgaatatcctcaataaactactggcaaactgaatccagcagcatatcaaaaaccttatccaccatgatcaagtcagcttcatccctgggatgcaaggctgcttcaacatatagaaatcaataaatgtaatccatcacataaatagaacaaatgacgaaaaccacatgattaactcaatagatgcagtaaggccttcgataaaattcaacaccccttcatgctaaaaactctcaataaactaggtattgatggaatgtatctcaaaataataagagctatttatgacaaacccacagccaatatcatactgaatgggcaaaagctggaagcattccctttgaaaaccggcacaagacaaggacgcactctctcaccactcctattcaacataatattggaagttctggccagggcaatcaggcaagagaaagaaataaagtgtattcaaataggaagagaggaagtcaaattgtctctgtttgcagatgacatgattgtatatttagataagccccttgtctcagcccaaaatctctgaaggctgataagcaacttcagcaaagtctcaggatacaaaatcaatgtgcaaaaatcacaagcattcctatacaccaataatagacaaacagagagccaaatcatgaacttccattcacaattggtacaaagagaataaaatacctaggaatacaacttacaaaagatgtgaaaaacctcctcaaggagaactacaaaccacaaaggaaataagagagtacacaaacaaatggaaaaacatttcatgctcatggataggaagaatcaatatcatgagaatggccatactgcccaaagtaatatagagattcaatgctatctccatcaagctaccattgactttcttcacagaattagaaaaaaaactactttaaatttcatatggaacccaaaaaaaagcctgtatagccaagacaatcctatgcaaaaagaacaaagctggaggcatcacgtgacctgactttaaactatactacaaggctacagtagccaaaacagcatggtactggtaccaaaacagatatatagaccaatggaacagaacagaggcctcagaaataatgccacacatctacaaccatctgatctttgacatacctgacaaaaacaagcaacggggaaaggattctgtatttaataaatggtgctgggaaaactggctagccatatgcagaaaactgaaactggaccacttccttacacctctactcaagatggattaaagacttaaatgtaagacctaaaactgtaaaaaccccagaagaaaacctaggcaatacccttcaggacataggcatgggcaaagacttcatgactaaaacactgaaggcaattgcaacaaaagccaaaattgacaaatgggatctaattacactaaagagcttctgcacagcaaaaaaaaagaaagaaaaaaaaaaactatcttcagagtgaacaggcaacctacagaatgggagaaaaattttgcaatctatctgacaaagggctaatatccagaaactacaaagaccttaaacaaatttatgagaaaaacacaaccccatcaaaaattgggcaaaggatatgaacagacacttctcaaaagaagacatttatgtagccagcaaacatatgaaaaaaacttcatcatcactggtcattagagaaatgcaaatcaaaaccacaataagataccatctcatgccagttagaatagcgatgattaaaaagtcaggaaacaacagatgctggagaggatgtggagaaataagaatgcttttacactgttgatgggagtgtaaattagttcaaccattgtgcaagacagtgtggtgattcctcaaggatctagaaccagaaataccatttgacccagcaatcccattactgggtatatacgcaaaggattataaatcattctactataaagacacatgcacacatgtatttattgcagcactattcacaatagcaaagacttggaaccaacccaaatgcccataatgatagactgaataaagaaaatgtggcatatatacaccatggaatactatgcagccataaaaaagaatgagttcatgtcctttgcagggacatggatgaagctggaaaccatcattctcagcaaactaacacaggaacagaaaacgaaacactgcatgttctcactcataagtgggagttgaacaatgagaacacatggacacagggagtggaacatcacacactggggcctgtcagggtgtcaggggctagggatgggatagcattaggagaaataccgaatgtagatgatgggttgaagggtgcagcaaaccaccatagcacatgtatactatgtaacaaacctgcacgttctgcacatgtatcccagaactttagtgaaagataaaattttttaaaaaaagcacctgcttttaacagtttgttcttcaccaagtcaaatatgtagtttgaagttcagaacactaaaagataggtgacatggtgaaatcacagtctaaaaagggagataaagtcaggagaagaaaatgtgaatgcaactataattattagtcttctaacactctctcccctcccagcctccaggtggacttacaataagagcatgggctctgcagctaggagagttcactttctctcatatgatattaacaccttttcaattaccatgaggctccccaaattgaccccatatatacctaaggttaataactgggaaatctatgtaaatgatattaattgtctcattattatattaattatactatagccatatcattactatagtaatcagacaattcactctacatttctgttatgtttaaaatttcacaaaaagtaacatattttaaatgtattgcttcaattatttagataaataaactaggaagtcaatagctgtgccttcacagtctattttccctagatatcctaacaagcaacatagggcaatggctgcctgaaggtaaagaatagagtggaacaaaacaccttactggtaagataaaatcaaacagaaccaaagcaaagaaaacccaatcactcataaagcggaaataagtagtgaatggtggcatctcagagttactcttccaaacaaaatacagtaaaacaccctgaacagaaaggactgtcagaaagcataatatgaagtatacaccattagaacatctcattcttcattgcttctaagtaagggatatcacaggggattacactatagccattacaatgcaaaaagctcattttcacccaaagcttcaaatatcttctcagcaaatcttccaaacatattaatcaattgtaaagttcattcattcatgtcatttttttcttcacgatcctctccaacccacaagaggaggagttactttgtctctcttgcccacaattgtatctctagaacctaaaagacagcttagcatacaaaagtctgtaaacatttggcagaagaaaaagaggcagagaagggagggaatgagagacaaaactattaaaagaaaggctattaaaaaaaacagacactacataaatgagaaataaatcctaatttgaccaaatataattttggaagccaaattataggaaactgaaacatatagagcaggggtccccaacttctggggaaccaggatgcacagcaggcaagtgagcaaagcttcatcggtatttacagccgctccccaatgcttgcattaccacctgagctccacctgtcaggtcagtggcggcattagattctcataggagcatgaaccctattgtgaactgcatgtacgaggatctaaattgtgtgttccttatgagaatctaatgcctgatgatgtgtcaccgtttcccatcacccccaaatgggaccatctagttgcaggaaaacaagcttagggctcccactgattctatattatgatgagttgtataattatttcattatatattacaatgaaataataatagaaataaagtgtacaataaatgtaatgcacttgaattatcccaaaaccatcccccctaccctggtccatagaaaaactgtcttccataaaactggtccctggtggcaaaagttggggactgctgatacagagcaagaatccttggactctcatcacttatcaatcccagaaatatacctcaatagcaatggaacaaagtcccttggaggaagagtgactaaaaggaggaagagaaaaagaggaagaagaaaagttagtgcagacacggaatgagacgtgacttaaaccatgaggtgggggaggagcataaggaaaggccaggtgatgaacactttcacgtacaacaccacattgcctcacttcaggtgcagaattcaaccaatgtgaagattttttttccaggttaatttccacgttcatattatgtaacaagccacttttctcattgttatggaaagcaaccatttttgaccatacacattacaggaaacttctgaatcagagtcattttatccacacagggaaagtcctacttatgctgatcatgatgctttcagtttttccacattaccttggagtctgccactttatccagacctaactcttgaatgaccctgttaatccgttcgtttttttcatgattcgtcatagttgttgcaagccgaagagctgctgagaactgtaagttttctctcaccgtcagagtgcccatcacaacatcatccttaaggcaaatagcattttaatgagacataatgataatgagtcttttctaagaccatgactgtttagtatacataacataatccacaaagataacataactaaggtaaagttctagctaatgatgaacctgcagttctgcaaatgacagttaactccatagatgtctgcaaagcctgctataatcatttttcaccccctatctgtacacccaaatagaatgcaagtaattatgttaactaccagcagacatttccaaactgcttcatacaaggatttgccaaaatatctttctaagctaggggaaaagaaaggtgaaggaaaggcaaaaaaggataacagtagtatgtatcattttagaaatgatacaaaaactagaattggtatcactgtccttacaagggccatattccagattctccctgccttttcacataagtgtctatgagaaattaagaaaagctgctgtaaagaacgtcagttctaggaccatgtcacataatcaactggaagcacattgaactatcagccaaagcacttacccatatagaaacagaggaaacagaaaatgcaaacccactaatacttacttgtaccacgtaacctgaattacatttgaaattggcaggtcgcggtgctccatttatcagaacatctccagataatccacttggatctttccttgcagctaagacatctaataacctataagaggacatatatgttgtgggtctaataacctataagagaatatatatgttgtggggtttttttccctccaacacatgctatatatctcatggctactttgaatccaaattctactttagttagaaaattaactggtcaagaaattctatggtttaactaaaattatgcttttaaaaattctcacctttctcttttcattgtacattacaataaagccccaaaacataaagcaagacaccattggctgatcaagtacagatctcccaaatggcccttccagctgtctgaccttggaggtactaacacaggcaatgtgctcttttatctaagactcatgcctttacttacatcttctgcttcctttccctacttttaatattctcccattctttttcctccctattagctgataacatggtcaactgctacatgtcaatcaccttatcaaatcctattagtaaagctaacctaataagactacctggtctttgggaaaaaaccacgcaactacagttatccacagcacctagaaccagacctgacatgcgttgcaaatgctcaataaatacctgctcgcacacaaaaaaaagtggcttttaaaagcacattaaaagtgcacagaaaacgcttacttatactctcttatactcacgaagatttgcctccacctgtgggtcccaggatggcgttgagaccaggtttcatgatcccactgtaaacacaaaaacagactgatttactattccattttaagtcaggttctattaatttagggtaggcactgaatatactcaatgaaggttgatgaaattacaaatagaacacaagcacaaaccaactcttaaagaaaacaaacaaacaaaacaggtcatgcatggtggctcaggcctgtaatcccagcactctgggagaccaaagcaggattgcctgaggccaggagtttgagaccagcctgggcaacatagggagacactgtctctacttaaagaaaaaaaaaaaagattgttgatttgatgtgtaatatataatggatgttaatcactggtcaagtcctacaagaaaaatggcatagattcctctaaattcctttcacttattctctaacccatttatattttctggaaaatgacattcaacatttaacgttccttgaaataactaacagattcttgtgaaacatctccgttacacttactgctcttaacacagtgtgaaacgaaatacatggcgtgttctgagtactgtttgatgatcagtactgtatcttcaagtggtcacatttgctacctagtcaaattctacacaattaataagtcgctaatttgtggaataccggtagaagtattctcactgctaaaatctaatcagcccaagaaacatctaagtagaaatcgaggctgggataaagcacttcaggataaaaagaaaacatgaccgaaagaaaaaaaaagccttaatccatttagaaaagtaaaagatatatcctcaagatatatcattttcttccttgttaagagtcagataaatacactggaaaattccaagtttagaaggagaagacatcactttggtagggtcatcctttaagaatatgaagacgtggtacatacataagcacgtttcaaacaaagtggatgtctgagggtagtgaatattcagatagagaaggaaggtggaaaaaattatggcagtgttgactgtgctgagacccaagaagacagcaaatagtttgattttctcctaaagatagcaagtagaatgataagtgaaggaactggagaaaggagaatttggccgggtgtggtggctcatgcctgtaatcccagcacttcgggaagccgaggcgggtggatcacttgaggtcaggagttctagaccagcctggccaacatggcaaaaccccgtctctactaaaaatacaaaaattagccagacacggtggtgggtgcctgcaatcccagctactcgggaggctgaggcaggagaatcacttgaacccaggaggtggaggttgcagtgagccgagatcacgtcattgtactccagcctgggcaacagagcaagactccgtctcagaaaaaaaaaaagaagaagaagaaaggagacttcagggtggggcctggcttgttcctttcaaaacacaggtatctatgcccattctctccttagaattgataagtaagttacaatatattccacagagaaagtaatatctattccaaatggaaggtcaaagccaaagactatttcattctcaaataatgattagcacagaggccaatcctatgatcctatacaattatgagtgataagcaactgcaccacagtgcttaaacccaagactccctgagcatttactgcctgttgtacttgaactatcacaattgtacaatggctggtgggtacaagagtgaaatgtagctttcactttgctcattaactggggtatctctcagtgaaacgctgcacaaagacaatgggagttaggtaaaccaggagcaagatctaacagaaaaatctcttactctttcagtggactcttccctctaaatgtgtaaaacaacatactaatgattgggcaaattttcaaggtgcatttatctatagctcttgatgcatcttctttataaacaggtccctaataactgcctctaaaatcaccataagcttgttattcactaaggctccactgtcagaaaagctttccaggtttctaaaatacctactcaaataaagaccaagcaatcctaaatgattaacccaaacctcaacatgaatgttctaagacaaagagcttggcttactactttgggatgaaaccctggcattacagaaaacaacaacaatgtccagtcataaatgccaagagtttccatttggagcagtggctaattccaactccatccactcaacacaatgatcaagtatttactgtgtacatacaagatattcttctagggcatgggagagttgagaacaaaacaaacaaacaaacgaaaaacaaagtctgagcccttgtggagtttacattctagtccagggatcagcagttttcttagacaaagggttgttggaacagggccgtgctcattcccttacatattacctagggctgctttcatgctacaccacagctgagtagctgcaacacagacgcatggcccacaaagctgaaaatgtttattaatactatctgccctttatggaaacagcctgctgacctctgttctagtctatggtctacaattcactggcctgcccaccccaccctccacccttctatcatccctgaaactgcattccccacccttatttattgctttacagcatttgcatgcaggtcagtgtccctcactataaaagtctgtcaacaagaacagcatgccacattgctaccacctctcacaccctcctgcccatgacatacagcacagttgttgtaaaccactgaacatgaacctggaacacagggaataaaatttaccccaaaatttcctgtcacctctattacattttagtggataatgattaatcccttggtcttgttttgtttatggacaagagaggtcaatgctcacctccctcccaccctcccatccctacacacacaaaatcttcactttctcaatcaccacgcccgggccctccaatttagggttggggctcccattgggtcttctaatcaatccttttatcagcgtgaaagtgtgttctgaatcccccactaggctttaaggcttccctgaactgaggatttacctgtgtcactagcatcttgcacaatgtcctgcactagcaggcattcaaaatttgttgaataaataaatttctgcatttttataaatgggattacttctaaaaagacaaggaaaaatgttttcaccttttaaaaaacgttgagaagagatagctggagggtggggagattgtttatattatggaataggaaaattaggaagtatatccttaacgtacatccttaatgtacttgctgattttcttattccataatataaacaatctcccaccctctctagccaattagagctagatttgtcactttttgaaattttactaacatggaaatatagacagaatcttgagggttcagatgagaattggagaaattaatgagaagccataggttttaatccatatacaaagacagctatagaaacataaagatggaaactcccagggtgctgcgggaatggtcaccactgctcccccagctcttctcccgcccgctttggccagatctgtatgcacctgcacgtgggaggtagttttttaaaaagttatgcatgtatgtgtatgcgtatgtgtgtagacgtatacacatacatatcttctctaggtctcactccactgagaaagcctagaaacaatgacatcccaatagcaatgagcattttaaacacctagattttggttttgtaaatatctcctccataaaaatcaacagctgattctaggtctgaggcagggtaagtacacagtgagtctggaactgctcgctgtgccaagcaaatattcaaagaatgaggcaaggtgggagaaacacttgagcccaggagtttgagatgtgcctgggaaacatagtgaaaccctatctctacaaaaaacttaaaagttagctggaagtggtggcatgtgccggtggtcccagctactcaggaggctgaggtgataggatcacttgagcccaagagattgaggctgcagtgagctatgatcatgccactgcactccagcctgggcaacaacgtaagaccttgtctctaataaaatttgtttaattacaaaaagaggctgggcacggtggcttatgcctgtaatccctacattttgggaggccaaggcaggtggatcacctgaggtcaggagtttgagaccagcctggccaatatgatgaaaccccgtctttactaagatacaaaaaattagctgggcatggtggtgggcacctgtagtcccagctaggaggctgaggcaggagaatctcttgaacccaggagccggaagttgcagtgagccaagatcatgccactgcactccagcctgggcaacaagagcaaacctccatctcaataaaataaaataaaataaaataaaataaaataaaataaaataaaataagaatgaggagatatatccaaagaatgagagacggagagagggaagaacccaccttgaaagatctcccaccaaatcaggaacaataagagtatgaaggtaaaacataataatgcgttaattgaataaaatacaaatccctgactctatactggtgatagatgaaggtttttccttttagtaaaacaaactaagagataatgataatagaaaatcactgtttggcgactatgatagtggtggctgactcaggcaggagtcatccagtggggactgaagttggtgaagtttaatgtagaatggagttctggaataatgtcagtttatctctcctcataacactaatcaattaccaaggggaaagggtgacattatagccaagtttggcagacatcaacatgaccaagtgatcaattttaacatcaccaggggtgggatgagataagaaaataccacgttgaatgagactgaagagacaggatatggtggcagtcaaatatgtgaggggcatggttgacccaaggccctgaggacctaccacgaccttcattacaaggctacatttccccttggctcctcctggacaatgtctgagtggttatataggagagggtcgttttttcaagaacacacacaaaggagttaaggagaaggaagcaccatgtggacagcctgcactcacacggttcagaaaaaacagtaatgaccatgggaacatgaagagacaaagtgatgagaacaaatgcagtgaaatgttggctgagaacctgaatgaaaagggttatgttcctgaaacgtttaaatttaacatcaggccaggtgcagtggctcatgcttataaccccagtgctttgggaggccaaggtgggaggatcacttaagcccaggagttcaaggccagcctgggcaacgtaggaagaccccatctccacacacagaaaatttttaattagccaggcattgtggcatctagctactccagaggctgaggcgggagaatcacttgagcccaggagttggagcttagagtgagctatgattgcagcaccacactccagcttaggtgatgcagcaggactccatctctaaaaaataaataaataaatttgaaatcatttcaaagtaagttattaattaaaaatgttccaagagtataatgaatttctcttaaaataacaggacatccacatatctatgggaatgaatttttttttccataagatcttcagcgttggtgagggaaagctcaaatgctgggtatggagacaaacaagcataagagaaagatttgtcctaagtcagaagaatcacaactttttaaattctcatggtcagactgtttttatcttcttccccctgcagaggaaatcaggttatagtgacttagttctagaagtgaaattacaaaatgtccagaggaaaaaccaaaatcaaaattctcatcagcttttttggaatgtagatgactatctgaatggtgatgctgctatcaaacacaaatcaaaagtaagataaatgacagcagcccttcctctacctccagaaactgtatttagagttggagccagcagataggagaaagactggaaatactacagccaaaaaggcctttctcatggatacttaaacaggaaatgccagcagcaaaaacaccaacccctgatgacctttccactaaaatgtgaaagaattgcaagatctgactgcatttttatgagcctagtaaggaacacagttctattcatgcagtaaagatgaactcatctattgctgaaatgcatgccatttgaccataaaaaaaaatgcgtggcctggcacagtggctcacaccccagtgctttgggaggctgaggcgggtggatcatgaggtcaggagttcaagaccagcctggccaacatggtgaaaccccatcttgactaaaaatacaaaaattagccaggcatggtggcacacacctgtaatcccagctactcgggaggctgaggcaggagaatcacttgaacccgggaggtggaggttgcagtgagccgagattgtgctgctgcactccagcctgggtgatagagcgagactccctctcaaaaaaaaaaaaaaaagtgtgaagccttgagcagacgagacttctagtgcatcaagttactcatctactaactttaaaagataaaataagcaaaataaatgcaccctcacaaagtacgctttttctttttcttttaagataggctctcactttgccacctatttgtacagtgggacaatcatcgcccactgcagacttgatatcccagattcaagccatactcctgcctcagcctcccaagtagctgggatcacaggtacacaccaccacgcccagctaattttttgtattttcagtagagacagggtttcactatgtcggccaggatgttctcgatctcttgacttcatgatctgcctgcctcggcctcccaaagtgctgggattacaggcatgagccaccatatccagccacatgtggtgcattttttaaaaaagtctggcagttactttgagagtcaaacatatacctaaaatgtggcccagttatttcactcctagtttagctaaaacaaatgaaagcatgtgtctgtatatctgtgcaaagacttgtacaaaaatgttcatagccagtttcttggaaatagccaaaacctgtgaggttcactgtaggtaaattaaaaagctgtctttttacaagttcatgtacatacttgatattcgataatatttctttctcaactggttttcgacaaggtagaaagccactcttcagttttactcgatagcagatgttatgaaaacttaacacagctccttcagtaaatgccttcaggtcattggaagctgtcgcggggaagccattggtgtttccttgtgacactgggataaaaacttcgacattactggaagacatctggagagtttttatctttctgcagacagaaaagcaatagtaagttgatagtccagataaatgagattgcaaacactaggtgacaatacatttaaaacaagtccatttttaaatgtgcggcaatgagcagcttcatttccaatgaatggcccataccattgtgataagaacatcctaaaaacctaaatgggaagacaggcacaacttggaatgcataaactccaattagatgtcaaatacatccctaataagtaaatgggtcctaataagtaaataggaagagtatgaaaattacaaaaaactgataaagcaggaaaaggatggatgagggttagacttgtctggcttgaaaagcatattatgatataagtcaagtgcagggacagactacatgctcatcatcagaatctctgtattttttttcaagaccagcctggccaacatggtgaaaccctgtctctactaataatacaaaagttagccaggtgtggtggcgtgtgcctgtaatcccagctacttgggaggctgaggcaggagaatggcttgaaccagggaggcagaggttgcggtgagcagagatcgtgccactgtactccagcctgagcgatagagcgagactccatctcaaaaacaaagggaaaaaaaagaaactctattttttttaattgcggagtttatagcatcattattatcaaaaggggcttagccaagcagtcaggaacaggagacatttctctgaatttatagctccagactttatgtcggaagttgttatgcaccttcaatcagcaaagaaggtaaactccaaaattgtttgcaattacataataatttccttaattaataagtatatttaaattctagggagatttaaagttaggtacgaaaatcattaagtaaatcaaaccaaaagttgagcaaaaatttaaaacaaaaaagaatattaaatgtatcaataaaatgtgaactatttcattaaacaaattacaaaaggcctcaaaaaagatttatttgagtaagaccttaagatgagcttaacaacttgtgaaacaggtttgaaatgttaacttcaataaatgtagttttaatttttaaaagtcaaagtaatccatgacgaactttctctctgcctatgattgagttgctgttcccaaacagtcctcctaagcacaacgacaaaagtagaccaaaaaaagtaagaagaaactgttgaagagttctgtctgataaaagcaaccaaagcggccaggacatgaggaaccaaaatcacggaatggcgggactgaagcactgaaacaaactctgcattccgcgtgccctttcctcttaaggtgggtatttgcacacaaaaattgtacacacctggggcacagctcagacaaaccaagcaggaagaagctgctagaagaaatgagtcggcttactgaagcctctactatttctgagcagatatttcagcagtctgtcagcactagggagacaaaattttgttggtgttgagtgcctaacagaggaggagccctggaaagagatcccaaaagcattatgctctgggaatgtggacaaaccaaaaaaccagtctactcaatcatggcgatctgctcagactgctagaagaaggttaaatccactctctatgaagatatcatccaaattttcaataaaaaattgccaggcatcaggaatctctctgaatctgctgtgattctgaaggctgcctgattcacgaatcataagtttaaaaataatgaaaaaaatttttaaaattgccaggcatgccaaaaaacagaacctgatgttccggaaatgagaaaatggaaacagacccacaagtaatctagactggagttaacagacattgacattaaaacaaaagattgatgtgtttaagaaaattaaaagacagactctcaccaaggaacaaagatctacaaaaacaaacaaaaattaagaattcaatcgatgagtttaacagcagctttcctagtttagacacaaattaggaaagagaatttagtgaactggaagactagtacacagaaaacatccaggatgaaaattatgaatgatgaaaattattaccatgaaagggggaaaaaatctcctaattaaaaagaatgagaactacataaaagagcataacaaacatatgggataagatgaaaaaggtctgtcatacgcataacaggcaacctgagagagaagggaaaatgcagcaaaatgggtacttagacagaatcagtatttgaagaaatactggccagtattttccaaaactgacaaaggtatcaagccacagattgaagaaactctaggaacaccaaagaggatgaatacaaaaaaagacaaatctaggcatatcataataaaactgccaaaaaccaaagttatctcctaataactgtttctgtaatccagaaacataatcatatttacaagtctattcatttggagtctggaaaagtagaaaccatttaaagactgacacccagcaaattcaaggtacatggctgggttttaatctgtgaacacaatgaatggtaataattagccaaaattctgttctcttgaagcagtgaaagagaaggcacaagtacagtcagcagccctgtccttgagttctgcatctgaagattcaaccagtcgcaaatcgaaaatattaaaaaataggacaggcgtggtggttcacacctgtagtcccagcactttgggaggtcaaggcaggcagatcacttgaacgcaggaattcgaggccagcctgcacaacatggtgaaaccccatctctatcaaaaatacaaaaaagtagccgagtatgctggtgcacacccatggtttcggctactcgggaggctgaggcaggaggatcacttgagcccaggaggcagagattgcagtgagccgagatcatgccactgcactctagcctgggtaacagagtaataccccatctcaaaaaaattaatatttaaaaataaatataaatggatggctgtgcctgtacacaacatatacagaattttttcatcattatttcctatacaatatagtatcacaactattaccataacatttacattgtattaggtattacaagtaatctagagatgatttaaagtatatggaacaatgcgtgtacattatatgcaaatactatgccatgttatatcaggaacttgagcatatgtggatttgggtgtctgaggggagtcttggaaccaattccccagggatctctagagataactgtaatgtatggacttcacacctttacttcaaaaaggttttaaaccatctccccatgtattcagaaaccaaaatacaccaattccaacactagcaatcacttcttctactgccatccccatttgatgttccttcagccactgaggaaaagacttcttaagagtatcaaataacttattgcttgaatttaaatagctcactgactcaagacggaaattttaaagacacttttgtgaggtttccacaaataaaaggcaacaactagagctaaagtacccaagaaagagtgatcacccatgcccatacaagacagagggtaacacttataaatacaatcacaatcttagaagtgcctgcagagaaagagtttgcctttcctgtgataggattaaatgtgtaattcacattactcaggagctgtttcattcctggctaggattctaacaatcttcctcgggagatacagggccttagtcattcatgagtcacaaaccaagtgattagacaggtataaccaaggcacaccatcaagctgaagcacgttacatcaaaaagaaaggaaaaaaaacaaactttaattctaacaccaatatggagcaatacacttactctaagaaaaaaaacatagtaaggattaaataaataaaatataccaactcagcaccagactcatctcaaagtgcccgatctctaatgaatatagtattctgggtttagggaactctctaaaagtaacaactacctttaagcaaacaccagtctttccccatggtcagaagctttctggacatgtgtgctgatctcattggattagcatcatctttttatatcaaggaaaatacccatcacacaacgagatgtccctacaacaaaaatcaacctcccacctgttgccgtttccttatttgcagattacctgctaaggctaatccatttctttttctctttctgtgtcctagaccccctgcaaagccttaagtgaaaggaagccttcaaatggctttacactttacctgatcccagccgattcatgttatttggcctgattatgtatcttagccaactcaaaaagccctttcaaataagacagaagggatttgcatatggagattctttccccagctctgctgcctctttcgtgctggtctacctatgtcattcatacctcgcctttcttgttgcttcctaactagcaaggccacatttttactttttttttttttttttttttttgagatggagtttcactcttgttgcccaggctggagtgcaatggcatgatctaggctcactgcaacctccgcctcccgggttcaagtgattctcctgcctcagtctccctagtagctgggattacaggccgatgccacaacgcccaactaatttttgtatttttagtagagacgaagtttcaccatggtggtcaaggctggtttcaaactcctgacctcaggtgatccgcccacgtcggcctccaaaagtgctgggattataggtgtgagccactgcgcccagcacatttttacttttttgagaagtttaaccatttgtcttcaatatatgctggtactctattataaaaatgataatctgcattacagataccgtatttctcaatttttttactctttatcaaactcttaattgtatagaacactctttacaattggaaagctcaaattgcgcaactcaaaacaacattttcatacaatgaaaactgagaagaggaaaaaaaaaaaagtgcacaggtagagcctaaagtcttcagcctgccacctgcccagctggaactactgcatttgttggtagaagccaagatagcctcaagttgagaattccagactctactcttccttttttttttcctaggatgacgctagtatatggagttgcactctacctcatagccatagggcatgctgcataaattacatacctctttaaagtgtttactgaggttaatctcaaaagataacaatcctgagcaatcaaatcactgtcaggcgattgctacaaacttagcagtggaaaggaaaaggaacacaaaatctgaagtttaacttacataaattgtcccttgtctttaaaaggtatcatggtattttattgcctttaaaaggttgatccatgggctttcatgttatatccgatttgacagatttgtcctgagaggtccagtgttgattatattcaggcccaaagcctgcttgtatggtggtttcagagttaaactggctaggtgctctaggaccccacatcatggcagcacagtgatctggagaacgcggcctaattcccgacagacaggaagagaccccatcaccaaagggctgtatggtcagtgagaagccactgaggccttttaatcaggaaaggctcacaaccctaatgatgtttataaaggaacactctgggccaggccaggtgcggtggctcttgcctgtaatctcagcactttggaaggctgaggtgagcagattacttgaggtcaggagttcaagaccaccctggccaacatggtgaaaccccgtctctactaaaaatacaaaaattagccgggcgtggtggtgtgcatttttgatcccagctactcgggacggcaggagaatcgcttgaattcagaaggcagagattgcagtgtgctaagattgtgctgctgcactccagcttgggcaacagagcaagaccctgtctcaataaataaataaaggaacactctgctgtgtggagaacaacaggaggagggagaggcaagtgtggaagcaaggactagcggggaggtaactgcaaaaatccaggggagccatgcttggataacagaggcaatgacagtggggacatcaaaggttaaggctttgagagggatgaacttttgttaaatcagaaccaaccaagactcatggatgacaaacctgcccaccctccttgggtcttcagtttgcaacaacgtatcgctgttaggttttcttaaatgttactttagagaagaaaaaatccttttccatctcccctgtgggttccctagctgggttcctagaaattaaactggcaatagacaggttaatatgaccaaaaaaaaaaagtttccttacataagtaaggtgggagtttcataaacaaatcagagtctaggacaaatccatatgactgaggcttttttttttcttttttcaagacagagtctcactctgttgccgaggacgtagtgcagtggtgtggatcttggctcactgcaagctctgcctcccaggttcaagcaattctcctgcatcagcctcccaagtagctgggactacaggcgcccaccaccacacttggcgatttttgtatttttagtagagatggggtttcaccatgttggccaggctggtcttgaactcccaacctcaggtgatccacctgcctcagcctcccaaagtgctgggattacaggcatgagtcaccgtgcttggctaaaacctgttaatttttatagcaaatttagccaggcgtggtggtccacacctgtgatcccacctactggggaggctgaggtgggaggatcccttgagggtccatgagacggaggctgcagtgaatcgtgattgtgccactggaatccagcctaagcaacagcgtaaccctgtcaaaaagaaagaaaagcaaagaaaaaggagaaagaaggaaggaaggaaggaaggaaggaagaaggaaggaagggagggaggaagggagggagggagggaacaggagaaagaaaggaaggaaaaagaaagaaagaagaaagagaaagaaaaggaaagaaagaaagaaagaaagaaagaaagaaaagaaaggtaaaggaaaggaaaggaaaagaaaagaaaagaaaaaagaagagagaaaaggaaggaaagaaagtaaaaaagaaaactaaaagaatccattgaactcttccaggcaccctcacaggcttccctatgaaagtcccaaagagcctggcactattgtgcctgaaattccagctgtgaggctgaggcaggaggatctcttgagcacaggagatcagcttgggcaacatgacaagaccctgtctcaaaaaaacgtacctaaactctctagcaatatataccagtatttagataacagctttaacaattcagcattaaaacgttctgcaagcttgggtcacagagcatgaactttcttcttcttcatgctctttgcccttgtgtctatcctacactaagtacacagaaaaatgatatttatgaaagtatttcctttagaattccttgcaaatctgcaatttctaaaagtcatatttggatttgaaaactgaatttctctacagaggctggctatcataaaagcagggaactatttttgtttcctgcagagttcttcagactctgttctcaattattcctattaagtgaaagattaaatcaatgtgtcacactctgttgcaaggtagcttaataaagatgttagcactagcaagataaagtcactaaccatgttaaggagtagattttgacaactcttctacagaatttagattctggtaagattactgaactgcctataaaatttagagagcaaaaacacacatacagaatagactgagcatgaaatttgtgaaaggtaagcacaaatccgaagcaaacctatctaagaacgcagtatgattaacacagctgtagttcacaaaaactacaattatcctgtttcaatgcaggacatacttccagccaggaatgtccttccccacctgaatttctacaacctcacattcctttgataactgagagattaagacagttccatccctgagggagcacaagacctgcgaggtgggagggtttagaagcaagttcctagagaagacagaccaagtacagctgaatcttgaacagcacaggtttgaagtacatggtccacttatacgcagatggaagaatgccaaacccatgtatacagagggctgactctgcctatacactggttccacagggctgcttgtgggacttgagtatgcagggatttgggtatatgcacccaaagggaccactgtaccccaagggacccctgtagatggaaaagaagaaaggagaagagaaaaagctgttctagtaaaggaatgcaaaatccttaatcgaaagagatatgttgggtcatgtataccattcatgaggctggagtttagttttcagaggggggcagtaacaaaatgaggctaaaaaggtaagcaaagaccatcaaaagggtgcagcgtgcctgatcaggagctaagacttgaccctggaattctggagggtccctgactgcaaggtcccagctctaccctctcctcactcctatatatcctgatcctacaagattttcagtaaagccagcaaggtatctataggaaattaataacttacagaaattaatacttattactaaggaaaaactgttttggaagggatcctatgccaactgtacacacggttctgcctaatctttggtttttttaatcatgtttattggaaacccgtcaacaggaaacagtattgtaaacagtaaaattcatcctttttaagagcacagttttctgacattgtaaagtgtacacagtcctgtaaccactacaatcaagacagatcattcatgttaacccaaagaaatcccctctccttaccagagcccctgacaaccactaatcagttttctgtccccttaatttttcagcttaatctaaatcctctctttgaatagaaacaaatgaacataagaccctacaaggctactgttttttcatttacattcccacaaaaatctgcaggaattctgctcgtctgtacaaaaaataaaattgaaaaattagccgggtgtggtggcacatgcctgtagacctagctacttgtgaggctgaggaagggggatcccttgagcccagggagttccaggctgcagtgagtcaagatcacgccactatactcccgtctgggtgagagcaagatcctttctctaaaatataaaaataaataaataaataaaagaattctgtccaaattggttttaatctgtgattagaaagccaaaacttcagtctagaaaatcgtcaaatcataaatgaaattagaccaagtgcaatttacatgcgtgttacatcccaaattttcttaatctaatctgcaatttggccagcagtttcccagagggaacggagatgttcaaatcctaaggctgcccataaaatgctatccaatccatcacagaatgtgtggggtttcagctccttctccccttaaacttcctagccacagaaccctggagaaactgcttagcctctccaagcctgtttctcacctataaaattaattcggccgggcatggtggttcatgcctgtaatgccagcactttgggaggccgaggcaggcggatcacatgaggtcgggagttcgagaccagcctgaccaacatggagaaaccctgtctctactaaaaatacaaaattagttgggcatggtagcgcatgcctgtaaccccagccactcgggaggctgaggcaggagaactgcttgaacctgggaggcagaggttgcggtgagctgagctcgcaccattgcactccattctgggcaacaagagcgaaactctgtctcaaaaaataataataataattcgatatttactagacttctattatctggcaggcactggacttacaggagtgaacaaaacaaaacaacagataaacatcccggccctcagtgaggttacatatgaaaaatatcagtcaacagtgctacggagaaaaaaaattaaagcaaaagaggaagggtgggccagaaatggtggctcacgcctgtaatcccagcactttgggaggccgaggtgggtggattgcttgaggcccggaatttggagaccagcctggacaatatggtgaaatccttatctctattaaacatacaaaaattatccgggtgtggtggcgcatacctgtaattcctgctacttgggagactgaggcacaagaattgcttgaacccgggaggcagagattgcagtgagccaaggtcacaccaatgcactccaacctgggcaacagaggtggtcacggaaggcctttccagtgaggccctcaagcagagctctgagggtggccttctggaggagcagtatatgtccaagtgctggtcgaaggaacagcaaagaggccagtgaggctgaagcagagtgagggaggataagagagcaggaactcgggttgtatctaccactgaccacaggaaggactttggctttgatctgaatggcactggaaggcacaggaaagttctgagtgaagaaatgatatctatatttaaagcaggagtgtccaatcttttggcttccctgggccacactggaagaagaattgtcttgggccacatataaaacacactaacattaacaacagctgatgagctaaattaaaaacaaaaatcacataatgttttaagaaagtttactaatttgtgttgggcttcattcaaagccatcttgggccacatgcacgttggacaagcttggtttaaaggatcactctgactttggtcatgggtagggacaatgcagggagaccacataagagtccaccataataatatcaagagccaagatgaggacactgtcctgcacccctccctccatagcctatgagagctccctgaaacctattatctgtgcatgttctgcaaaatcgcctgccccaaacaattccatttcctgacctcctcttacactgcccaaactgggaaaacaaggtcaaaaataaatgacagtggttcagcttcaggcccacaggaagtgaataactcatttacatttaagaggggactgactgagaagcccctatgaatttaaataaaaggagtagtgactggggctagaagacatagggaggacagcggcagaagctctgggaaagtcatcaccctttctcttctccctttgcaaggttgactccaccaaattggcactgtgggaagattagcagcagtgaggtgggtcattagaacattttgggatcctaagtccccagggggaaacaaaatcaagttgagtgtgagttagatttacccaaaaccacacagcattgtgcctacaacccagtccttgttctccgtgagtctagtacatgtcaactacatgaagatcaatatccctgctcccttccagtttataattcaatcatcggaattgcagtaaaaattatgaacagaggctgggtgcagtggctcatgcctgtaatcccagcactttgggaggccgaggcaggtggatcacgaggtcaggagatcaagaccatcctggctaacacggtgaaaccccatctctactaaaaatacaaaaaagtagctgggcgtggtggaggggcgccggtagtcccagctgctggggaggctgaggcaggagaatggcgtgaacccgggaggtggagcttgcagtgagccgagatggcgccactgcactccagcctgggcgacagagtgagactccatctcaaaaaaaaaaaaaaagaattattaacagaaaattaaatgtgagcagcggcattacttctcaaaattctgagacctacaataaaaaacatcatgatccagtatacaaagatataaaagaaggagcatgtaatgtgtgtgtactccaaaatcatagaagggctcattaattattgcaagggatcctctctctaatccacgggtacagttaccatctcagaccaaataatgtctcatcataaacacagtacttcttcattgctagtatgactaacataaatatgggtctcaaatccttttctcactgtgaattcaatcaacagataccaaaattataatattaggatgtagtttaagctactcagctaataaaatgatcctggtttcttaccagagcctaatagatagaagctcacatatgcattatttgttttggaagcactggcagggtttcatttgagaaaaaaatgggagctttaaaaaattactaaatactaccaattttacttctttcccataagagactgaatccaagttggcaaatacagtcaggtcctctataatgtttaaactttaaggcaatatgaattttcactcgcgtccgtgtgaagagaccaccaaacaggcttcgtgtgagcaataaagctttttaatcacctggatgcaggcgggctgagtccgaaaagaaagtcagcaaagggagatagggatggggccatttcataagatttgggtaggtaaagggtaaagggggtttgttctctggtgggcaggggtggggcgtcacagggtgctcagcgggggagcttttgagccagaatgagccaggagaaggaatttcacaaggtaatgtcatcagttaaggcaggaacaggccattttcagttcttttgtggtggaatgtcatcagttaaggcaggaaccaaccatctggatgtatatgtgcaggtcacaggggatatgatggcttagcttgggctcagaggcctgacattcctgtcttcttatattaataagaaaaataaaacaaaatagtggtaaagtgttggggtggtgaaaatttttggggggtggtatggagagagaatgggtgatgtttctcagggctgcttcaagtgggattaggggcggcgtgggaacctaaagtgggagagattaagctgaaggaagattttgtggtaaggggtgatattgtggggttgttagaagaaacaattgtcctatataagtattggtgatggcctggatacaattttgtatgaattgaaaaaagaacggaataagacaaggagaaaaacaggtattaaaggactaagaattgggaggacccaggacatccaattagagagtgcctaaggaggttcagcatagccctgccagcaaagatgatttatttactttaagagttgagagtggcggtttggggatagcaccaggagatatcagctgtggtggcttggagaaacagtgtaaaccggcagtgtaaacaagagcgggcatgtatgagtagttgagaatggtgaataggagtatgactagacagaagatagtagggatgacaagtttttgggggcgcagtccaagttggtctggtgtctggaatgagactggggcctaataaaaaggagcatctatacaggagctcaaatgggctgtattttgtcgcattccgaagacaggcccgaattctgagaagggcaagtggtaaaagtattatccagtcctttttaagttggtggctgagcttggtgaggtgtgtttttaaaagaccagtagtccgttctacctttcctgaagattgaggatggtaagggatataaatgtttcactgaataccaagagcccgaaaaactgcttggctgatttgactaataaaggccggtcctctattgaaccgtatagaggtgggaaggccaaaccaaggaattatgtctgacagaagggaagatatgaccgtcgtggccttctcagaccctgtgggaaaggcctctacctatccagtgaaagtgtctacccagaccaagaagtattttagtttcctgactcggggcatgtgagtaaagctaatttgccagtcctgggcaggagcaaaaccccgagcttgatgtgtagggaagggagggggcatgagaaattcctgaggagtagtagaatagcagatggaacactgagaagtgatttccttgaggacagatttccacgatggaaaggaaatgttctaagaggcaggctagcggcttgtaacctacatggaagaggttatgaaatgatgacagaatagaatgggcctgtgaggctggaaggagatattttccttggtctaagaaccatttgctttgtgtgggaagagattgataggtggaagtttcagtgggggagtaggtgggagtgaccaatgcgaagaagaaaaactgaccctgagggacagaagttggaacactagttgcttttttagctaacttatcagcataagcattgtcctgagcgatgggatatgatacctttttgatggcccttgcagtgaatgactccagcttcctttggaagtaaagcggctttgagaagcgtttttattaaagaagcattaatgatagaggacccttgtgtagtgaggaaacctcttgcatagtggtgcaggatatggaaggcatatttagagtcagtataaatattgatgtgtagtccctttgcaagagcaagggcttgacttcaggcaatgagttcggcttgctgagcggtagtggaggggggcagagtggtagcctcaatgatagatgtggaagatactatagcatagcctgcctttgctggtgagtggcaattaggactggtggaactgccatcagtaaaccaagtgttcagggtgaggaacaggaaagaaggaaatatgcggaaatggggtgaatgcccggtggatcagagagatagtcatgggggtcaggtgtggtatcaggaataatgtgggaggccggattgaagtctgggccaggaacaatggtaattgtgggagacgcaacaaagagtgagtatagctggaggagccggggagcagaaagtatatgtgtcaggtgtgaggaagaaaatagattttggaagttatgagagctgtagagagtgagttgagcatagtttgtgattttgagggcctctaaaagtattagggcggcggcagccactgcacggagacatgatggctaggctaaaacagtaaggtcaagttgtttggacaaaaaggctacaggacgcgatcctggtccttgtgtaagaattctgactgcacagccctgcacttcggctgtgtgtaatgaaaagggttgggatgagtcagggagagctagggtggggggcagtctctaaagctgtcttgaaggaatggaaagaggagtggggaaaggatttaggatctatggggtcagctaggtttccttttgtgagtttatataatggctttgttaggatggcgaaaccaggtatccaaagtcgaaagtatccaaccatgcctaggaaggaaaggagttgttttgtagaaggtgttggggtttgagagatcagtcagacacgattggcagggagagcacgtgtgtttttatgaagaattatgacaagataggtaacagatgaggaagaaatttgggtttgactgaagtaatgggggctgtctgtgaagccttgaggcagtacagagccaggatgagccagaaggaggaatttcacaaggtaatgtcatcagttaaggcaggaaccagccatctggatgtgtaagtgtaggtcacagaggatatgatggcttagcttgggctcagaggcctgacaccaatcttttcagacttagcatttgctaagtcacaaactttttattatacataaaaagttcaaaagtaactctaggccgggcacggtggctcatgcctgtattcccagcacttggggaggccgaggcgggtggatcacccaaagtcaggagttcgagaccagcctggccaacatggcaaaacctcgtctttactaaaaacattaaaaattagctgggcgtggtggcacatgcctgtaatccctgctactcaggaggctgaggcaggagaattgcttgaacccaggaagcggaggaggttgcagtcagctgagatcccaccattgcactctggcctggagcaagactccatctcaaaaaaaaaaagaagtaactctaatagaacatccagtgtccagatattagcttctaataccattctaaagcaaaataatcacagtgccttggagaaatggatcattccaaggttgggacatggaaaatacaaaataagcctgagcattctctgatgccagaaatcaagaaatgcattaaaaaagaaaaagagtccgggcatgatagctcacacctgtaatcccagcactttgggaggccgaggcgggcagatcacttgaggccaggagtttgagaccagcctggccaacatggaaaaccccgtctctactaaaaaatacaaaaagtagccaagtgtggtgctacgtacctgtaatcccagctacttggtaggctgaggcacaagaatcgcttgagcctgggaggcggagggtgcagtgagccgagatcgtgccactgcactccagcctgggcgacaaagactccgtctcaaaaaaaaaaaaaaaaaaaaaagaaggaaaaagaaaaagcaagtgtatgtcaaagtggcacaggcgccaacctgaaaaaggtcccagtggtgaaagccagaacaatttgagcagcaaattaaatactgataatattggattataacccatataacaaaacaaatatccatgagcccatactgatacaaataactgaatcaatgaacaggagagaagggtcaactcttccctacagaagggaattttaattaaaaaatgtagaaggaagaaaataggggttttgtttaaccattaggaaaaaaaacccgctaaacaacatgttccacaaatggatgcttaaattaatgaataaaagtttaaggaaaaatggcagtgcaggtttctctcccaagatctcaaatacaaagggaatctggcaaacagattaacatcataggtaataagaagtatcggctagggcacagtggctcacgcctgtaatcccagcactttgggaggccaaggcaggaggatcactagaggtcaggagttcgagaccagcctggccaacatgaaacctgtctctactaaaaatacaaaaaattatctgggcatggtggcaggcgcctataatcccagctactcaggaggctgaggcaggagaatcgctagaacctgggaggcaaaggttgcaatgagctgagatcgtgccactgcactccagtctgggcaataaagcaagactcagtctcaaaaaaaagtattgacatcatgtacccaatatgacatactgagatggaaactttacttctgtgacatttttccccaaaatgcagaacattcatctaatcatgacactaaacatcaagcaaacacaaattgaggggcattctacaaattaactgaccgggtcttcttcactagtgtcaaggtccatgaaaaaacaatgaaaggctgaggaactgtcacagatcagagaaaattaaggatatttagcagttaaatgcaaagtgagatcatcgattggatcctgggcagaaaaaggacagtggaaagacaagtgaaatccaaataaagtctgtagtttagttcattgtattatagtagcatgcccatgttattagttttggcccttgttatgcatgatattatgggaactctctgtactattttttgcaaattttcagtaactctcaaattatttcacaattaaaagttattataaaataaataataaaataaccaacatctttcaatgtttataatggaagggtaatgttagacttaacatgccatctttgtcgttgaaacctttctcatcaagatctcatcaagatctatacaatccagtcaaagctgtactctgaaagcactgttttgtaaagaatatcaataaaaaacatctcttccttactactctggtgtatttatttatgactagctgacattcaaatgataagagagctgtaagatcctcctaaaaaccaagctttaggggatatctctaggactgagaagggagtaagagcactcaactatccacagaaaattacaaaagggagttcaataattctttagcaaaccatccaaagctttaaagggattgaccaataatttgtcatttacctattcccaattgtcattgaccaattcctatattggtcaacccctttaaaatattaacatcaacaaatgtttcctccacctatagtaacttctgtgctcagtgggtttttatccttccaatatcaactttaatttcatacatttggagaaaggccaagagtttttaccaacccacacttaacacactatgggacccagaatcagtttgcaccagggcatcattttctgaaaaaccactttgaactgtcagttttaaactgcatacccactttcaaatgaaactgcgaaaggctaaaaaactcagtcgtctcgtttgaacggttaccgattttctaacaaatatatacacaacgcccaccaacctttccagacacacactctcagcgaaactggttttacaatttactcactcagcttaatagagctcggtcttaaccaaaggctcaggatctcaggatgcgtgcgctcggaggcagcgctttaacaattaaggatgtaaatgttgggatgagtcacccggaccttccaaacaaactctaaagcagcagtttccacttaacaagaccaccaagcatgtgcacggtgcgttcctaaatcctacccagttcctccacaggctgcctccttgccgcgtctctcaatctcagtgggagtggcgggcactgcctcttccctcctgcgcgcccggaaccttttgagtgggcacagcacgcagcccgcgcgcggcacaaccccttcccccaaccacacccggcgcgcccgagcgctcccctcgcgcggcggccggcgtgggaggcgctgcggctggaggtcacgatgggagccggcgggtggccgcctggggagacccggacatccaggggacgagctcaggcagcgctgacacgaacttcctaagccgcgcttcgggctgtggaccgccagagctgaacgcagtggcccctccccagcgccccgggtttccccaggtcggggttcgcgggcgggggtgaggcgtggccccgactgccgggccgcgataagcgccctgcgacccggctgaaagcgcacacgtgtcctgccgcgctgagccgccagcaggactggtaccaccgccctccctcggggctagggtcaccctgccgtgacacgcagggacaagccaaacactcccgcctccgggatcgaacggaatgaaccagagtgattaactacgagaatcaccaggcgctcattgggctgatcagtacctcgtctgacctagctgggtttggtcgccgtcactggccggagcgccgaagcaccggggacgctgacgcacaggttgcccagtcacaagcgctgctcgcacccagagcaagttaaatgggtggtttctggtgaatgggattctgagaaagtggatgcttgcgccccagggcctaaaaaaatcaggcactgaatctaacccaaggaaggaaaggggagaaacttactgaatgaaaatattaccatagtttaaatgttattctttacactcctgtgactgacatacttctgtgcaatattccgatggtgtggaaaggctagaaagtgattgcgcatgttcaggaaacgggccatcaggctttgtgagtgtagccatcccaacatctacctgctgcatctaccctaggaaattagtacctgcatgcagatattttctggtttgcatttacaaacaaaaatcatagtatcatttaagttgtttaaatcaacactaggaataactattaatggttcacccaatgcaggaaagttttagctaggaagcctagataagaaaattgactatacataattttttaaaaagaattttaaatataccataccgcatgctttttaaaagaattttaaggtatatattcatgatgcgcccaaacatttgggtaaaattattcttttgaattaatttctgtcagtttcaagacccttaaaggcccatatagaaatacatgttagtcatacttcattttaagacaaaattaaggccagcacggtggctcatgcctgtaatcccagcactttgggaggctgacgcaggcagatcacttgaggccaggagttcgagaccagcctggccaacatggtgaaaccctgcctctactaaaaatacaaaagttagctgggtgtggtggcgaggctgtaatcccagctactcgcgaggctaaggaacaagaagcgcttgaacacaggaggcagaggttgcaaatgacccgagatcccaccactgcactccagcctgggccacagagtgagactctgtctcaagaaaaaaaaaaaaattaagataaagttttcagacctggccgttaacgactgtttgcaaaaactgaaaaatctccgaaaaataaattttattttaattttctttttagctcacccagataagtgaaaagaataaaattttatgataccagaaaaaatgaaaacatttccagcaagatctgaaggcactacaggaggagactgaacaaaaatggagaaaacacacacgaaactgatatgaagcacatttttaaaaatggatacttagttgaatatagcattctgtaattatgcaaagtaaaaacaaatcaaaaccctatacatagaggccaggcacggtggctcacgcctgtaatcctagtactttgggaggccgaggcaggtggatcacctgatatcaggacttcaagagcagcctggccaacatggtgaaacccttctctactaaaaatacaaaaattagccgggcatggtggctcatgcctgtaatcccagctacccaggaggctgaggcaggagaattgctggagccagggaggcagaggctgcagtgagccaagatcatgtcactgcactctagcctgggtgacaacgtgagactccatctcaaaaaaaaaaaaaaaaaaaaaaaacctatacatagaaaattgctgggcaaggagtgacagctcactcctgtaatcccaacactttgggaggcagaggccaaagaattgcttgagcccaggagttcaagaccagcctgggcaacatactgagaccctatctctacaaaaaaaaaatattttaaattacactgggtgtggtggcttacacctgtaatcccagcactttgggaggaggccagaggattgcttgagcccaagaattcgagacaagcctaggcaacacagggagcccctgtctctacaaacaatttttttttttaattttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtacaaacaattttttaaaaattagctggatgtgatggcacatgcctgtggacctagctatttggggggctgaggtggaaggattgcttgagccccggggttcaaggctgcagcgagccatgatcagagtgagaccccactctaaagaaaaagagaaagaaagaaaatagcaggaaagtgttcatttgttctgggtagtaacatggaatgtcttttatcttgtattttagtgtaattttctaaattttatgtaacaaatttagaaaattataaattttataatgaaaaatggattttaaaagtaaaataaactgataaaatatacatataaagacacatgacaatagagtcctcacttgaaataggactaaaactaaaaaaaagtttccttaattttagtctaattttaaaaatattttagattgtgatgtttcatatttataggtcggtttatttgctaactaaagttacattgggaggcagtggtaaatcaaataaaaattcaaaataaagttttattagttcctaacctcatcctaatattttatcaaattctatttgataagttcagattaaagccagcattttataaatgtattgcactgtatagaaatgagtcattttaacttgtaagttagcattgtttttggagctagccatagaattttagagaaaaaggaccttcctcattaggtcagatgttagatgactttcctcattttacagataagtcaccagtgcaaaggagactgatttgcacaaggttaaaggttaagtgactcacagccttccaagccattgccctctgccctccaccacaggacctttcttttattttaccaggcaagagtcactgcccagtatttataaggccccatattgagactcctgctgaatgcctgtgcaccagttgcaaagagctggtaaggccccagtatgctacatttcttagtgcttactccaaaggtgaactccagaattgtcaattttccctggcaaggtcaggtttcagacaggattcaccatgggcctggggacatttgggttacatatataacagatgtattcagtccgagtatatctattttcattaccactccaagttaagaaaataacagtggaagagaggctatgtgcacagtattcccccacagcccagctcacagctatcagggcctttgactaatatggcaagagaaagttcagtctataatggtgcaaacagttattgtaaataaaataatggaaacagtttaaaactcttcctaaagatttcagtataaaaggaaggtgagagaaaggaatatagctagaggctatcttagggttcagagaaaatattcatttggtttgaattagacagactagaacatgtgtgcatgccaagaggacaagccataaagaaagaaagggttattggtagtgtcaggtcccttaggaagcataatgaaatgggatccagaggaattagaattagaaaagaaaaggaaacttaagaatccctcacgctcttcttttccaaattgggccaggcagaatggctcctgcaaagaaaagcggcgagaagaagaagggctattctgccataaacgaggtagtgacccaagaataagccatcagcattcacaagcgcattcatagagtgggcttcaagaagtgtgtccctggggcactcagagagatccggaaatttgccatgaaggagatgggaactccagatgtgtgtgttaataccaggttcaacaaagctgtctgggccaaaggaataaggaatgttccataccgcatctgtgtgcagttgttcagaaaatgtaatgagggtaaagaatcaccaaacaagctctatattttgttacattcctggttacctatatacttgttaccattttcaaaaatctgcagatagtcaatgtggatgagaactaaccactgagcatcaaatacatcaaataagttataaaattgcctttatatattttttttaaaaaggaaattgatatggttttgctgtgtccctacccaaatctcaccttttttttttttgagacggagtcttgctctgtcacccaggctagagtgcaatggtgtgatctcagctcactgcaacctctgccttgcgggttcaagcgattctactgcctcagcctcctgagtagctgggattacaagcacttgccaccatgcctggtaatttttgtatttttagtagagacagggttttgccatgttggccaggctggtctcgaactcttgacctcaggtgatccaccacctcggcctcccaaagtactaggattacaggcgtgagctacggctcccagcccatcttgaattgtacttcccataatccccacgtgttgcgggagggacctggtgggaggtaatcgaatcacaggggtaattattcctatgctgctgttctgatagtgagttctcacgcgctctgatggtttcataaggggcttttccccttttgctcggcacttctccttcctgccgccatgtgaagaaggatgtgtttgcttccccttctgccatgattgtaagtttcctgaggcctccctagccaggctgaactgtgagtcaattaacctctttcctttataaattacccagtctcgggtatgtctttattagcagcatgagaacagactaatacagaaactttttaaaaaattgtaacaaaagggaaggaagttggatgtatcctcatggaggtaaatggattttttgttgttgttgttgtttgtttttgagacagagtctcactctgttgcccaggctggagtgcagtggcacaatctcagctcgccacaacctccacctcctgggttcaagcaattctcctgcctcagcctcccaagtagctgggattacaggcatgcatcaccatgcctggctaacttttgtatttttagtagagatggggtctcaccatgttgcctcagctggtcttgaactcctggcctcgaagggatctgcctgccttggactcccaaagtgctgggattataggtgtgagccaccacatctggccgaggtaaatgttttaattagagaaaattgaaataaatatctggcccataactatactttctctctgaagttgatggatgtgctgagggtatgggtgtgaatggctgatttgggatttggaaaaatgatgaatatttgaatagacttctattcgttttctattgctgccataacaaatagccacaaacttagtggtttaagacaacacaagtatattacatttctatgggtcagaagtctaaaatgggtctagtggtctaaaatcaaaatgtcagcaggtctgtgttcctttctggaaccttttcaatcttgtagaggccacctgcattccttggctcttggcctctttctccatcttcaaagccagcagcatagcagccctgtgaccctgcttctgtcatcacatctttgattttcttctgcctccctcttccacctttaagtattgttattacaataggcccactgggtaagccaggataatctccctattttaaagttatttgggccaggtacattcatctgggcaggctcacgcctgtaatctcagcactttgggaggccgaggcgggtggattacgaggtcaggagttcaagaccagcctggccaacatagtgaaacactgtctctactaaaaatacaaaaattaagcgggcatggtggcatgcgcctgtagtcccagctactcgggaggctgaggcaggagaatcgcttgaacccgggaggcggaggttgtggtgagccaagattgtgccactgcactccagcctgggcaacagagtgagactccatctcaaaaaaaaaaaagagagagagaaaatcattagattaacaatcttcatttcatctggaaccttaattctcctttgctaaagtaacctatcattcacattctagggaataagacatggacacctttgagaggccatttttctgctcaccacaaggccccaaggaaatggaagaggatgctaatggagggacccactggcacccactgagttggtatgaagagtattttaaactgaaacatttaagacacagcagatacagaaagaagcctttctggagcttcccttatttgactaaagccagagctttcagagagtgaagctgccataaattccctcttggggagcttcactgccagtaaggagactttactgccaggaaggagaccacttgcacctgaatgacgaattgcataaccgaacataatcacaaattgtcgtaccatcatttgtttccctaaaagcccatttgtctttccacaaaagtatatttgctttcccatagaaccctttctctcctcctcccttttcccatattattggcatataaattctcatccctaactgtacagagagcctcttcacctgagtaagtgtaaataaaccttgtctattctcctgttaatccatctattgccaattaatttacaggcccccaagcactggacctaagttggcagaggaagtttttcctcccaacactaatatgagacatagagctcgcacagcaacaccaaggcccctactacttgggatgggactctgtaaacagtggtttgaaagctgcaaatgggcatggctttctcattcacaaagatgtgaaggtaaagggttagataaattctagggtacagttttgttgggtgggtaaggcaatagaaagatgaagcaaaggagtcatgtgagtgaagtgattcatcatcataggaaagcgaagccaggaatagacagagagaaagaaagtacatggaggggtcacatgcagatggcaaaagttgaaacaggaggatcaggtcactgagtgggatactggcatttaatattcacattccaggttttgataaggtcccacggtttgaacacgagagtgaggttatggaaatggaagggaagtgtatttgttttctattgcttgagtaacaaattaccatcaagttaatgtcttaaaacaatacccatttattatctcccaattgtggaggtcagaagtctaggctaggttaggctttgctcagggtatcaacaggccaagtcaaagtgtcagccagctgaaatgaactcttagctggacactcttctctaaagaaccaagcagagtaaggttgttggcagaatccatttctttttggttccaagactgagtttcctgtgtccttgctgaatgtcaaccaggggcaccctcagctcctcttggctgcctgcatttcttcccatgtggcccctccactttcaaaacagtttgagtccttctcaaactttgaacccaactgtcccttctgcctttttttttttttttttttttgagatggagtctcgccctgttgcccaggctggagtacagtggcacaatctcggctcactgcaaccttcgcctcccaggctcaagcaattatcctgcctcaacctcccgagtagctggactacaggcatgcgtcaccatgcccagctaatttttgttatttttagtagagacgggggtttcaccatattggccaggctggtttcgaactcctgacctcaggtgatccacccaccttggcctcccaaaagtgctgggattataggcatgagccactgcgcccaggctctttctgccttttaaagggcttatgtgattaaatcaggcccacctttacaatcttgatatgttagagtcatctgacttaggactttagttataacttcaaaatccttcagatcagtacctagattagtgcttgatgaaataaccagggaatgaactggaattgtaggggttaggggagagggagatctttagaattctgcctatcctggagatggagttgagatcagagagcacagaagctagggtgatgggatgatcatcaaaataaacagagaagttaccaagatagcaataatcttggagagacgagaaatgtcaaaaagcaggcgtcaaagtcttttagacatggaaagtgaagagaaggtgggttttacacagagagagacagcatcggggagggggcaggggattgtgggggtagtaagagcccagatgctggagccagaacaccttggttcatgtaatttgctttatacagcagacaagagaccaattaagaagtaattcatttggttataaagtttatttagggccaggtgcagtggttcacacctgtaatcccagcgctttgggaggctgaagcgggtggatcatgaggttaggagattgagaccatcctggccaacatggtgaaaccccatctgtactaaaaatacaaaaattagctgagcatggtggcatgcgcctgtagtcccagctactcaggaggctgaggcaggagaatcgcttgaacccaggaggcagaggttgcagtgagctgggatctcgccactgcactccaccctggtgacagagctaggcttcctctcaaaaaaaaaaaaagttcatttggttataaagtttatttggttataaagttcacttctaaaaattagactgcagtgaaaaaaaaaaaactacgtattgataattaacctgcagagtcagatagtacagtagagtatataacatttgtctctgcagattaagctaaaaggttaaatgttaagaattcaccaaactacatttcagtacctataaaagtcttttgtttaactaaattttgtagggaagtataacatacataagtcttttgtttaactaaattttgtagggaagtacaacataccaaaaaagtacaggaaatctaagtggacagcttgatatatatttacaaagtgaacacacctgtatacctgtcact

SEQ ID NO: 262 - DNA, 325934 bp, Homo sapiens
tttaaaaaatgcataaaatttgaatcctggtctccttaagactagcccactatcttataattcagcactttttattttattttatttatttattttttgagacagagattggctctgtcacccagactggagtgcagtggtgtgatctcagctcactgcaacatctgcctctcaggttcaagcaattctcctgcctcagcctcccaagtagctgggatctgggattataggtatgtgtcagtacgcccggctaattttttgtatttttagtagggatgaggtttcaccatgttggccaggctggtctcgaactcctgacctcaagtgatccacccaccttggcctcccaaagtgctgggattacagacgtgagtcaccacacccagtcagttcagcactttttaaaaggataatcataaaggcggggcacggtatctcatgcctgtaatcccagaactttgggaggccgaagcaggtggatcacctgaggtcaggagttcaagaccagcctgggcaacatggagaaacccccatctttactaaaaatacaaaaattagcttggcgaggtggtgcatgcctgtaatcccagctactcaagagggtgaggcaggagaattgcttaagcccaggaggcagaggttgcagtgagctgagattgcaccattgtactccagcctgggcaagagagccagactccatcacataaaaaaaaaaaaaaaaaaaaaaaggctggggttcagtggctcatgcctgtaatcccagcactttgggaggccaaggcaggcagatcacaaggtcaagagattgagaccatcctggccaacatggtgaaaccctgtcactactgaaagtacaaaaatcagctgggcgtggtggcgggcacctgtagtcccagctattcaggaggctgatgcagaagaattgtttgaacctgtaaggtggaggttgcagtgagccgagatcacgccactgcactcactccagtccggcaacagagcgagactccgtctcattaaaaaaaaaaaaaaaaattgaataccaggaaataaccccacatatctctttgtaccaccattttgctgcacataagagaacactgtactccattggcttaaacaaatagggggttgtttttcttaaatcacaagaagtctggaaggtggtaactgcccacttggttcagcaggttattgatatcagggcaaatatctatgaaattctctgttctttctctcacgcttacaagatggcaactgcacctccagccatgatacgcacagtgaattcaaaaaacagggaaagaaaaggactacactaataaaatatttctcagcagtccttccagcagattctgacttgactcagaatcatggcttggcccagccacctcactgtattccaggtaatcttctaaacgtccttgtgggtctgatcatcttctacagccacagcctagacatcagtgatgtgagccattcatctgcttttttttgacaggtgaagttttgaggggaatggaaaccggatgctgagctcctgggggaacaaggtgtcagaacaagctttggttctgacaggcctgctaaggtcttctctcgggcgagggaagctggagtcctctgggctctcagttggctagcgtcacagataatttaaactggcttttggcacttggcagggcagcttggtgctaacatctctcatggcaaatcccatgtctcttgaaaactaaataatggtgcttagtttaattttgttgcactcctcttttgtgctggatgtttattatgctagtttctaaaactgactttcaactacctctgtggatgactaacacaggggcccaataaatggactgcaggcattttagctgcctttaattcaagggaaaaagttacttaatatggtaagaagtatcaacccatcctatcatccctgcattccacatttctgtaatactgctttgtgcagaggctatcaatttccccaaagccttgccttctatggacagagtctgggtacaaagaggatagtttaattagctgcttcacatatctcaaactattgggaaataagatttccatcttacacaagagagggaatgcctgctgataactgcctcacctatggattggctacttggatgtgaagagcatcccagggcaattcctattatatgggggatggtcattgtgcaggaatgcccaagggttgagatgccacagacatcttgagaagatgccatgattgcatttagtataatgtgaaagtgctttctagatggcacagtactatgcaaatgcaggcattattatagaatttcaaccagagctggcccttggaagatgagtagaatttcagcagatggagaaggtaatatgaatcattagtgcttgaagggtgtggaaaagtaaaagtaaatgctgagttttgggagaaaatatgtattcctataataacggaatacataattatttagaaagatgcagttacagaagttcaaaaacggggttaaggtcagccaaaccacagaggatgttgaatgccatgctaagggagtgagatttcctgcaggtcatgagaaatcactgacaattttttaggagagaagtaatctaatctgatctatattttcaggaagataatcctagtggcagtgataaggatgacatggaaatgcaaacgtggaggcagtaagaccacttacagagcttactcagtaaggcaacagcaggaaaaatagacttgaaggttcaaattggagaaacgttgcagagaacaaattactagaattatactattgatgggaaattgtggtaacaactgttagtggtctcctaatatctcctttctctcttggattagtctgcttgggctgccacaacaaagtaacacaaactgggtggctgaagtgacagaaacatattgtctctcagttctggaggatatacctctgaaatcaaagtttcagtggggttagttacttgtgggggctgtgcgggagaatctgttgcacgcctctctccttgttcctagtgacagcaggcagtccttgatgtttctcccgtgtgtttctgtcttttcttctctttttcttttttcttttcttttctttcttttcttttctgttcctcctctcctgtcttcattcttcttcttcttcctcttcttcctcttcctcctcttcttcttcttcttccttttctctctctctctctctgtctctttcttcttctttcaacagagtctcactttgtcacccagtctggagtgcagtagtgcaaaaccaactcactgcagcttccaccttctgggctcaaacaatcctctgacttcaggactcctacttcagtcccaagtagctgggactgcaggcagatgccaccacactcgcttaattttggtattttttgcagagatagggttttgtcatattgcccaggctggtctccaactcctgagatcaggcaatccccacctatctcagccccccaaagtgctgggattacaggtgtgaactatcgcacctggccttttctgtttctttataaggacaccagtcatattagataagggactcaccttactccagtatgatgtcatcttgactaattatatctgcaatatccctgtttccaaataatgccacattctgaggtactgggaattagaacttcaacatatcttgttaggggacacaattcaatccaggacatctcatttccatgctaatggagttctgatttccggctggcacatttctacccagaaaggaggctacttttcccagctgtggccacatggataaatgtgggccaaagaagtgaaggtggaagtgttgtgtgacagtatcttctgcaaacttttcttaagggtcagtgtacatgccccttttgactcatcttcatgttttcctccaccctgctttaagaaatagagtcgtaaattccagccaaagtagccttaactcttacagatgaggaggagggcttgagtaggattccaaactgggcctgccagggtcctgcagacactgtgggtaagacattcacagggcactctttcaaacaaaaaatccagaaatcccaactgcagtccactatgagctgactctagcacaaaggtgggcattttttaattttaatttttggctgacacaatttttaaatatttgaatggaaatgtctttactaaagagtaaatggcatttgctccactttttcagagactcaatcgtgccctattaccttacatctagatttacttatgatacatgcctgatctttaaagaatttgactattatatcctttaaatattcaacacttatttagaatagaggctgaaggcttctattctagaatgatctagaaggattggagaaggaaggtcctctggtaggatgtccacctcttctctactactcagagcaatttagctctgctccaactcctaaatacttcattcagcaaaacaaaacctgtgcaattactcgaatgacagcagcagtccttgggattcctgggatcctcatcattccaatctctgtctctgccttcacatctcattttccctgtgtatctctgtcttctaataaggatgccagtcaaattgcataagggacccatcctactctagcattatgtcatcttgactaattacatctgcaatgtatacccatcgggggtggagattttataatcatttactgtcactctagaatgctttagaaagtctctctcaccagtcaccaccatccatccaaccaagtagcttgtgataacatttcttttaacatcatacagtagtctccctgagaagaatttgggtgagtatattactttcaacttgctagcttccagggacattttagcaccattaagagactggcacctccaggccatctggctctgtcctgacttttctaattgcagtgggtcagtttttgaggaggaaataatgagtataatgaatgcatgtaggatttgtgtcaccagtaagccatccaggtagaccattcagagcagggtggctacaacatatgtcccaaagagggactgtcagatgaagtggacttaattgagtcttgctggatgtgttgggtttggatacatgcacacgaagagagagcattccaagcttgatgaggagcactggtaaatgcacttctagtactagagagtgacggagatgttttgcatctgtatgagatcatgcaagactcacgactcatctagaccctaatttttctaacacttttcaatgaccctccatagaatcctcggtgtttagaaatcttatagagttctctgtagcaaaaacagtccattttaaaatcagtgaaaacttgcagcatcaacacaaccactagtagctgctgctcatttggcctgtaaagaacaatttttactggttaatagcaaaaaaaagacaaacaaacaaaccaaatccaaaacaaaaaaacaacaacccccaaaacaaacacaaaaaacacctggctaattaaatgcattggtactgcattttgtgtctatggcaatttgaaaaagctgtaataagcatcaattgtaaggaaaaaaaagagtaatttttacctacttctttctcttaatctttcccaactgccctccagggtaaaagaactctgtcacctcagttcatataaacaaacatgaacaacacacagtaggttctagaagtgtagtttcttaattggttttgagttccatataatcctaaaaagtagctttctcaattcaaaatacagacattactgtgtatttagtggtgaaaactttaaaagaacataaatatccaaaaagaaaaaaagtttaagcaaaatatatgtccatatgatgttgtgctatgcaatcattaaacatgagttttacaatgttttaaataggagaaaattgctattaaacttgaggcagaagaaatctctgtgatgcaagttgttatatagtatgtcacaatcagctaactctatattgtaaaagacttgcaggaatatgctaaaatgttcattgttttctctgggtggagagagtggggaaaatgtttttttaaaagtagcgtttccattttagtatcataaatacgctacatttataatgaataaaaataattcagaggtatcttttctgtaatactgaagactttttccatgcccaggcctctgagggggacatgtcctaactttcacccttgaagtacagataaatggggagaaaaaatttgttccaaatatattgatattgttagaaaatgcttatctcatgtaaatgcagaaccaaaggaaatgtgtaaatatcgaatactgcaaggatatgtataaacacaattcttcctcctgaacttttaagcaacgaccaatagttacataaagttggcttcttggaatacaatttaagggtgacataggagtcccagtcatttcccaaattaacaggtattatcatcagtatgtcagacagacatcctccctgatacggtttggctgtgtccccacccaaatttcatcttgaattgtagctcccttaatctccacgcattgtagggggggaactggtgggaggtaattgaatcatgggggcaggttttcctgtgctgttcttgtgatagtgaataagtctcaggagatctgatggttttataaagggcagtttcctgcacacactcttttgcctgccaccacgtaagatgtgactttgctcttcctttatcttctgccatgagggtgaagcctccccagccatgtggaactgtgagtccattaagactctttttctctatgaattatccaatcacaggtatttcttcatagcagtatgaaaatggactaatacaccccccctccaaaagaaaaaaaaggaatgaacagtctgtctcaattattagaagtacttaagaaagggtatcttcagccccatatatagtctaagaaatattacaacaatcaaagaatatagcttgaagctaaaacgggttcttgaaatcttcccttggtgtttcttatgtttactgctattgatgaaattcaactggatgaggcttttctcctccagtctcactaactgtgtagtagaatgaaaaagataaaaaaaaagacatgcaaatatttcttctatacatagaaaacagtattatctaaatcaaatatggaatcatcataagaatacttagaagtgaataatgtattatagttcataaaaagtaataacttacctaatgaagttttaaaagcaattgtttacgctgtaaaaacacaatgtgtgtagattaatattttccacaaaagttatctgtaaaacatgactaagattgttagatatggtctgaaaagcacagaaagcaagcctggacatgttaatagttatcaagaagttccaaaaattgtgaactgacattctcataaaatagtatttgagtcaagttttatacaaacgcttcatttttttaaagcacaaaactatctgatcatggttggcaaatcatgaaaaaacaaaagcaaacccagcagaataggttctaaatacttaattaagagttatagttatttatttaaaagaaactggtcgggcgcagtgactcacacctgtaatcccagcactttgggaggccgaggcaggtggatcatttgaagtcaggagttcaagaccaacctggccaacatggtgaaaccccatctctactaaagatacaaaaaaaattagccaggtgtggtggcatgcgcctgtagtcccagctacttgggaggctgaggcaggagaatagttgaacccaggaggcagaggttgcagtgagctgagatcatgccactgcacttccgcctgggtgacagagctagactctgtctcacaaaaaaacaaaaagaaaaacaaaacaaaaaacctgaccattaaaaatggctttatgaaaatattatttcattttgtaacaatggggttggggagtcttaataattgtctaacatgtaaagtaggaagggtatatcaaactttgcaaatatcacattaactcataaaactttattaaggctctattgagaggtgaggccagctggacctcctgagacaagtggggacttggggaacttgcctgtcttacaagaggagtgtaaaatgcaccaatcagcgctctgtaaaaagcaccaatcagcactctgtaaaacacactaatcagcactctgtaaaacgcaccaatcagcaagattttaaaagtagccaatcgcagggaggactgaaaaaagggcactctcataggacagaaacagaacactggagaggacaataagggaataaaagctggccaccccagccagcagcagcaacccgctccagtcccctttcatgctgtggaagctttgtcctttcactcttcacaataaaccttgctatcgctcactctgggtctgtgccatctttaagagctgtaacacttaccaccaaggtctgccgcttcattcttgaagtcactgagaccactaatctaccggcaggaaccaattccagacacattattaaggtaggtagatcttcaatagatctactcttttttatttttatttttttggcagtttataaccatgtaccaaggatgcacaattaaaaaaataaagccaacttttacattaagatttaaccaaaaatcatcaataatacatcgttttaatgctagtagaatcttcttctgacatcagttctattagcataattataatgccaattaaaaaaatctagtgggtctcttcattttagtttagagcttgattggaaacattcaggaaaacatccatggcttgcttgctactttctctttacctctagcactatgcttctccccaccagccctccctccacatcctctgactcagagactatttgaagaggacacctgttttaaatggatccacaggaaatacctatgttgccttttcataatccgaacctgcaactggttggctgaaatgaaaatgttgcccacagactgatgcaacttcagtgtgacaacatttactggaaggcaggagggactccagtttatatttattttccttccattaagccctggtagtgtagtgtaagaaaaaagtaagggcaaaaccagtttaacaaccagatgattagtattaaattacacgcaggggttttacatccaaaattggaattttttaaagctgaatgcaatcttgtggcagaaagttatttgaaaatcctttctttatagctttttatctataaacctcttgtccaaagttcatattctagctgatgttatatactgatatgacattattcaatctgtcatggaaaagtgctgcgtagcctacccattgaaagcagaattgagagagtttcctagtgattgacagtcgtttgtcaacactgaaaaccttattgccccaaaatactgaaagtcactcgcggctgcctgtgctcgggtttacaccccacgttcacacccccaccggatccctccgcacggggcaccagctctcggccaactgcaactaccccaggaagcgtcaccgcgattccggggcgggaacatttgtggacactggggtccactccttcagtctaggttccccgccccctcgcccggcccggcgcccactagccacagggcccgcttccccctggagatcagcgcgcacttcccgagccctcgtagcactcagaggtcgcatccacacctgggatgcctagggggcgcctcctggccgggtgtcccgggaccctgcgaacgcaggagcagaatgacgaaggtgacgaaagagatgacgacacgccgcctgccaggccgcggccggcagtggagagcgtccgcaaaccgcgcccggccagtacaggtcacccgggcgctcgcggccgcgccagtccccgggggcgcgcgccccgcccccgcccccgcccccgccccgccccgccccgcgcccgcgcccgcgcccgggttcccacggcgcccgcccccgcgcgcccggcgcctccctcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggtaaggccgtcccctccccctgctcgccccgcaccccgtgcctgtgtgtgcgtgtgtgtgtgtgtgtgtgtgtgtgtgtgtggatgcgcgagcacctgcgcacgtgcgcgcctccagcatccacccgtgtcctcgcctcttccccagtgattgcgtgtgaaggcctggctgcccccgcagcggcaccttctgaaccactcaccgttacctggtagctgggtacccttacctggcaactgggggacaaatggaggtggggcgcagccaggtggtgggctctttggagggggacaccgaactgcttctaagaggtgacacgggaagaatcttcaacaaaagcatcggacctgatcctgaatggcctgagacccattcgccctcaaggtgcttttcagagcacccaccgtgggatgaacttgttgcaactgaaggaaactgggtattgtctagtgatttggaacttcacctgaaagaaccaaatccttctcataagggagagaaagcacctaataaagttgtcttctttgcatctgtttttttcccccattgtcaataatttactttcaacctttaccccgtacatattaggagacagagatgttcaaagtgcatttccaaggtgactgtacacacttctctgtcttcccatgtacaaatttacagtagtttgcataagcagctcctctgttggcacaatatgataatcttgacaggtgcaggttattattagtatatcattttgaaagtttttctatttctggcactaaaaggccctcttcaacctccctggagaacagaacatgggcataaggcccaataatgaactcatggatggacctaggaatttcagggtaaaggtgactaagacacacgctaaaagattattaggaagaggcttaaaacaaaagcaatgaagttctaaagcactcagagaaattgtagaaccaattcctgggactccctgaactgtttatccaagactatacagttggttggctacaccagcaagattataatctcttgttgaccctccattctgatgaagagaacatgatacctgttttaaaaatttccaaaggcttaggatgcctcaaagaaatgcagagaggcttttggtttaaaaataacaccttatatttgcattatattagatactttcagagtggaatttcaattctgttgcccagcagtctccaaactgtgcacatacccttaggcccacaagacttcacagggtatagaatgttgcaagggttttaattttcagatcctcatcttccaactctgcttgaaactaatttccctctgaacatgcgtgatgcctgccagttctcctttcattctccccattcatccaagtgaggagcccgtgacaagactctgaggtgtgcttttctgtctgttccttttagcttccagaagatagatggttgtcaccagggctatctttatatttgattgaacaacaatgtcggagttgccttgacagaaagtcttattgggttgattggcttgtcaatgaggattggctttgccaattatgttgtgtagcagacattttctgtatactgaatgagctaaatctgcaaccctgaggttctgatgcatatgtatatgaagcaagcataccacccatagagcgccagaaagatgtccctttttcaagtgtttacacttaactatgttaaggatgttgagatgttatttaaaaatatgtgcatagattttcagaattctttgaggggctatgtgagcaaaactccttttgggacactgccttatcccattcctaagtcagatcttacttagagctggcctatttgaatgttgctaaagagcagtgctgggcaagaatacagagatgctgtgggagccataggttctagaaacagccctcagcatcactcttgcagtagatgctgtgttgtgggagcaaggcaggggtcagcaggtgaacagaggtagaaattgagggtgttggttaacccaagagatgcctgcttttcataattagcattgcttactgtgcattgaaaaacaaggctcagaagaaatgatatacctctcataacctttgtgtgacatgaaaccatagtagagtcagcttgatatgctgtcatataatttatcttttagcattcaatgattggacttgcctgttttaaatactaatcaccatacaggactttttctatcccagaagtcagacagtagattcaaatgtgaaacatttactttgcttcatatttagcttcagattgtataggacctttagccagcgttgtaattttttactctgtggctcctgattgaaacataataattatctttaacaaagagtgcctgtgagaaagtatgtctgagatatattcataaaaacattcatgcaaagtgttattctttttattatttgagatttagaatccttagagcttaagcattgtacagctgttaaaacaaccaacctgtcaatcctcagtaatggcatgaaatgattaggctactataatttagccattttacttttcacttttaatgttaaaaagaccgtaaactttattacctagtgccttgtacaatattaatgagtctaagtttattggagtaattttgcaagagtttaactttttaaaattgtaatgtgaaggcccttttttctagccaacttggattgcaggaatcatttatcctgatagccacagttggattccatattccatggcttcagtttaccaggatctgagtcaggaatctcaggctctatgcatccaggagcagatgattatgtggcagtggccattctggctgtattcatttctctccttgggtatgagggtcattccagtagattcagagcttatggtcaaaaactgaaatacacattgttgctaccagtaatcttatactgttattctccaatggtttcttttcctagtattgagaaactgtaagagaactaaggtgtttttggaaaattgaagttagtaaatggaaaaagaacactgtcttggtgtggtaggcagaataatgggcctccaaagatgtttacattctcatgccaggaacctgtgaatacattaggttacatggcaaagggaaattaaagttgcagatggaattaagattgcaaatcaattgaccttaaaatagggtaattatcctgagttatcccattgggcccaatgtaattacaagggtccttaaaaggaatagggaaacagaagacaagagcttgttggaggaagatgtgactggaagaaagtcagagagagatacgacaatgctgggtttgaagatggaggatggagccaggagacaaggggtgtgagaggtgtctagaagctggagaggacaaaaaaatggttttcctcctagagtttccaggaacacatacctgctgacagcttaatggtagtgtattttggacttctgacctccagaattgtaaaataataaatttgtgtcatttaagccattcaattgatagtaattggttaccacagtaatagaaaactagtatacttggctttaaagcctctgacttagaaaaaaaacttaactctttttgtacttatatgaaataaatgcagtgactcagctagccctttatgtatagtagataactggttaattttagctttaacaaaaatgcaagttttttcctacttcatccatgaaattatgtggaggagacatacatatgtgtaacagtgggcaatatgaggatttgtaaagactggactgtcaagcgtgtctgtgtgaagagaccaccaaacaggctttgtgtgagcaataaagcttttaattcacctgggtgcaggcggactgagtctgagaaaggagtcagcgaagggagatggggaaggggttgctttatagaagttgggtagctaatggaaaattacagtaaaaggtggttatttattgttagcagagaagggggtgacaaggtacatggtggggagatcataagacttattgtccagaagaagaatgtcacaaggtcggttgatcagttaaggtagggcagggacaagtcacaacggtggaatgttgtaatgttggttaatcagttaaggcaggaattggctgttttacttcttttgtggtttttcggttgccccagacttcttggctcctgcaggccatctggatgtatatgtgtaggtcacaggggttacaatggctgagcttcggcttagaggcctgacatggacaactttggaaaaactaggtctttactatgaagtatttcagagactatcattaagtaacatgtcaggccaggagaagaaatacacttaattggaaataagctggaaagaaagaaaatttaaactagctgttactcaaatattaacactttcttagtcaatatcacagctgatgaattttcttcaagtgatgtggattcattcactagcaaaatgattatgctgtgtgttacatgataattgccccaaaagataataaagaagaattaggataaaaccaacataaataaatgaaaagaaaaaggcaaatgtattttgaggtcttaaagtagtatttggggtataataggtgtttagtaaatgtttaagtaaatggaagctttctcttcccaaattttcattgagtattcttttcttgtcctgtctcctcccaaaaacattcaaaatgataggaatttaaaaatgtatcaaccagaacattattcatatgtatatggtagagtctaacagatgagtcagaatcaacttctttgaaaaccatgaactggattttttagaaaacttaaaatattgatgatggatgtaagacatcttgatttttaaagattgaaacatatctgggaatcccattggctctagtttgtagtactggccattttgagagtcatcctctcttagggccgtatcatacccattattcctcctagactggcttttcattcatgtcatggcagaatattgttcaggccctgcctactcaaagtgcgggctgaggaccagcaggatcaactttgtctgggagcctgtaagaaatgtggcatctccagctccaccccagagcttctgaatcagagtctgcattttaataagatcatcaggtgatttctatgcacattcaaggttgataaatgctgctctaagttgcattgttttttcatttacatggattaattgtaggaccctgtagagcagtcttaatatatgaattctgcctattttctttgttttttttttgagacagagtttcactctgtcacccaggcgagtgcagtggtgatcttggctcacttcaacctccgcctcccaggttcaagaaattctcctgtctcagcctcccgagtagctgggattacaggcacctgccaccacacctggctaatttttgtatttttagtagagacagggttttactatgttggccacactggtctcaaactcttgacctcaagtgatctgtctgcattggcctcccaaagtgctgggattacaggtgtgagccaccgcgcctggcctgaattctgcctattttcaaaacatattacagattgactttcactgtgatataacaaaaaaatgtaagaaattacaatttgaaaataaaagaaagatatgtttcagatacgagagatgggttagttattgctattgagaaacaaatttaaataatcttcagggcaactaaggtgaaaaacaatacacatttgattgtattgtccttatgttgaaagaaaggaggtataacaatttattgggaaaaatacagttctttccaggcactgacttttcaaggtaatttatcactcagatatttatttaaagaacattaagggtgggtatggtggctcacacctgtaatcccagcactgtgggaggccatggtaggaggcttgcttaaacccaggagttcgagaccagcctgggcatcacagcaaggctcccactacaaaaaattaaacattatttgggggtgcttgcatgtgcctgtagtcccagctatgtgggggctggggcaggaggatgacttgagcccaggagttcgagtttgcaatgagctatgatagtgccactgcactccagcctgagtgacagagccaaatcctgtctgtaaataaaaataaaaaaaaaacattggttagcatagtagataatgtctttgattggtttttagtgtaatatatagaaaaatttttatggttaatgtttcttatttgatggttttatgaaagccaaaggcatggtcttatattttggctaggtgaaggcatttttgtagaagtttaaggtaatataatctaggtactttttttgttatctaaatctgtattgcaaaggaatttcagaaaaccagagagagatgaggataaataaagtctcagatgtggaaaagcttggggtgctcaaagaataggaaatagtcaagtgtacctggacgataccatttttgcttttagacatgctgagaatttttgacatttaaaaaatgttaaagagggaaaataagctgcttaagtatactacattttgcatttgagttagtcttatatttatttacatacttatcataaaacatattcttgtctctagttcatgacttaattttaaataggaaataaaataccttgagaagagattctgcatgtcattatgtaactatggtacttagttttgccagtcaaaaccacacattgccacgtgaaggccagtagtttattgagtactcagggaacaaaattaggtggatttttttctgttttttgttttttggggttttggatattatacagagagtgtaaaattgcaatttttttcttcaggagactcagacttgaccctaaaatatgcatataaacttgaaggctcaaataatgttttttcctaacctggaggaagaattgtgagaataatgctttgcatagaatcctcttcaccttctttgcatgtttcttttggatcaggcataaaataggggcctggttttgttagagtgggggaaatagttgatgatataatcacccattccctcttagttgcaaatggtattgaaattacagaaagtcatctgaccactagttgaggtcacttcttttcccattcctgccattcccccatgtctggtataacatttggcaaaattggtaactgctcttgagggttttcatttgtttctgtgtgttcctctgaaatgtcatgtttctgggggaagcaagaacaacagtacaattttccacattgaatcagatgttcatgtgatccaagcgtgcttggaaaaatcttactgcttaggattctatacaacatagctctcttgtgcagtctgtagttagacagttaaagggcccatgcctcacctgcagggtagcccttctgagtgcggtggaagcagagctttcttggaaagtgagacaccacttgatcagatccattgtggaattgaacaagatgtaagacagaagcatggaattctgaaaagtcagacaatgcattagtgcactcacattgtcttatatttaggtctgtcaggttgtgttataattttaaaaattaatttcaaaagcgatacatacttattatagaaaatttgtgcaaatacaggaaacaatagaaatacagggaagaaaatatagtccatcttaattctccctaattttccttgcatcttagcattttagtgcttcaggatggtatttattttggaactttagtacatacaggaacatagagagactacagtatatatgtatatgtgtgttcatacgtatgtagtcagatatcagaaaaaatcatattctttaaaacttattttaaaattacggatatcacttagagatactgatgttagtattttgatatttgacttttcagtcatatatatacttctgttaaaaaaacaaaaaattcaatatgaacatatggtttttataaattcttcatccacatacactaaaatttattcctttttttttttttctcttgaaatggagtctcactctgtcgcccaggttagagtgcactggcgtgatctcggctcactgcaacctccatctcctaggttcaagtgactctcccgcctcagcctcccgagtagctgggattacaggtgcatgccgccactcctggctaatttttttgtatttttagtagagacggggtttcgccatgttgcccaggttgggctcgaactcctgggctcaagcgatccacctgccttggcctcccgaagtattgggattacaggcatgagccaccgcgcgcggccaatttattctttttagtatacaatactgtaagttttgacagatgcatagttttgatagatgcacagttttgatagatgcacaattttccagagtggatgtgccatgttgcattaccaccagcaatgtgtgagagctccacagatgggaactcatattgtatcttcagagtgtggcgttgtcaatttttcttttatttcagccattctaataggtgtgtagcactatctcattgtggttttgagttcccctcatgactgaagttgttaattatcttttcctgtgccttttaataatatattcatgttctttgtgaagtttgcccatttaaaaaatactgggttgttttattattattaagctttgagaggttttatgtttgccaaatgaaagctctttggcaaatatgtgatttgcaaatgttttcttcctgtctgtagtttattttatcaatagtgtcttaaacagagcaaaagttcattttgatgatacaaaatttaccatttttcttctttttatggaacctcctagaagttttaaagttttaggttttacatttttatctataatcctttttttctggtatatgttgtgcaattttccctgcaccgtgtcttgaaaagattgtcattttgccattgaattacgtttgcacctttgtcaaaaatcaattgactacatttgtgtgtctgtttctggattctgttctgctccactgatgtgtgtgtcccttcacaggtaccacacattgttgattgcagctttatagtaaatcttcgaagcaggtagtgagaatcatctaactttgttctttttcaaaatttgtttatgctattctaattacttttcctttttgtttaaatttagaataatcttgttaatatctacagataattgtacttggattttttagtagaatttaattgaatctataaaacgatttggggaaagttggacatcttaacaatatttacttttccaacccatgaacatgacatatctcttcatttatttagatttttaaatttctttcattgatgttttgtagttttcagcatatagtttgtgcgtgtattttgttaggtttatacctattttatttttgattagtgctattgtgaatggtatttttaatttttttttagaaatttttattttcttagtccattttgtgttgctatcacagaataccacagactgggtaatttataaagaaaagaaacttatgtcttacagttctggaggctcaaaagtacaaaagcatggtgctggcatctggtgagagccttcttgatgcaccatagcatggtggaaggcatcacaggacaagagaggcataagagaaagagccaaactagcttttatgacagacccactcttgtgataactaactctcctgtgataatctgttaacacattaatccattaatggcagaatcctcatgactcaatcacctcttaaaaggccttacttcttaatactgttagattggggattaagcttccacatgaattttagagacaaaaacattcaacggcagtgacccttttatatttaattgacattttaattgaggtaattgtagattcacttcagttgtaagaaatacagagagatactgtgtaggcttcacccactttctcccagtggttacaccttgcaaaactgtattataatatcacaaccaagatattgatattaaaacagtaaagttatagaacctttccattatcacgaagatacctcatgtagcccttttatggccacaactaccttctccctttgacccatccctaacctttgacagccattaatttgttctttctatgatttttgtcatttcaagaatattgtgtatccataaccatacatatgtgacttctggggattgctttttttaaaaatcagaataattacctagaaagtcacccaaggtgttacatgtatcagtagttcgttcctttttaattgctagtagtattacatagtatgcatacaccacagtttagccatttatccgttaagggatatctggattgtttccagttttggctattataaataaagctgctgtggacattcatgcagaggtttttgtgtgaccataagtttttatttctctgatataaacatccaagaagaaaaatgctgtattctgtgatagttgcaatttttagttttaccggaagctaccaaatggttgtccagagtggctgtaccattttatatctccaccagaaatatgtgacagataaaatttagccccattcttgccagttatttgatgttgtcaatatttttaattttagccattttaattggtgtatagtgatatctcatcgtggtggtggtggtagtggtggttctttttttgttgttgttgttgttgttcttcttcttcctccttctccctctttctcctccccctcttcctccttcttctcttctttttttttcttttcttgtgtgtgtgtgtgtatgtgtgtgtgactgagtctcgctctgtcacccaggctggagtgcagtggcatgatcatagctcactgtcatctcaaacttctgggctcagttgatcctcctacctcagcctcccgagtagctgggactataggcatgtgccaccgtgcccagattgtttttttttaaattttttttttgtgcagacagggctttgctgcattacccaggctggtctcaaactcttggcctcaagtgatcctcccatttcagtcaccgaaagtgctaggattacaggtgtgagccactatgcctggctcattgtggttttaattttcatttttcaaatggctaacgacgttgaatatattttcatgtgcttacttgccatctgtatatcctctttagtgaaacaaatagtactgttttgttaaattttgctttctggttgtttattgttagtgtatagacatatttaatgtgtatattttgaccttatgtcctggtgatttaactaaacttatttattaattcaaggagctttgctttagattctatgggagtttcttttttttatttagactatcatgtcacctgttaatagagacattttatttcttccttttcaatatggatagcttttatttcctttttatggtttattgccttggttaagacttctagtaggttttaggtagatgaggagagagcagatatccttagaaggatcctttcttgtttcttgttcctatcttaggaggaaaacatgtagtcttttgcaattaagtatgatgttagatatagattttttttttgtatatgccccttatcagttgatcagttgagtaagtttctttctattccaagtttgccgagagatttaaaaaaactacaaatggatgttgaatttcgtcttatgctttgatttgttcatatggtttttcttgacttttttccaaatttttaaaaaataaatttcattgtgtgtatttaaggtatacaacatgatgttatgggatatatttagatggtaaaaagattactgtattgaggcaaattagcatatccattatttcacagatttgcccattttttgattttgtggcaagagccactaaaagccacttgtttagcatgaatcccagatacagtacaattttattacatagagtcctcattttgtacattagatgtctggacttggtcatcctacatatctgctactttatgtcctctgacctacttctccccatttcctccccacttcccactcccgtgcctggtaaccactgttttgttttctatctctgtatatttgaattttttttggatttcacgtataaatgagaccatgcaatatttttctttctctgtctggcttattttacttagcatcatgtcctctaggctcattcatgttgtgacaaatggatctcattcttctttagggctgaattgtatgtatatatacactgcagtttcattgtccatttgtctatcaacagagagttaggttgtttccatatcttggctattgtgaatgatgctgcaatgaacatgggagtgcagatatctttgtgagatggtgatttcatttcctttggttatatgcccagaagaggggttgctgggtatatggtggttctattttttatttaattttattttttagaaacctccatactctttttcgtatggctctaccaacctacattcctgccaacagtgtacaagagttctcttttatccacacctttgccaacatttcttcttttttgacgttttgataatagccattctaatgggtgtgagatggtatctcatagtggttttggttttcatttccatacctgagactgggtaatttataagaaaagaggtttaattggctcatggttctgcaggctgtgtaggaaacataacactagcatctacttctggggaggcctctggaagtttacagtcatggcagaaagtgaagtggaagcttgtatgttatatggcaaaagcaggagtgagagaattaagtgctaaacacttgtaaacagccagatctcacgagaggtcactcactatcacaaggacagcaacagggatggtgctaaaccattcatgagaaatcaccatgatccaataacttcgcaccaggcctcacctccaacattggggattacatttcaatatgagatttaggcaggaaaacacattcgaactatatcagtgatattgagcaccttttcatagacctgttggtgatttttatgtcttatttggacaaatgtctattcaagtcttttgcctgtttttaattgggtcatttgtttttctatgattgagttgcatcagttctttatgaattttagatgttaaacccttatcaaatgttggtttgcaaatatttttcccaatttgtaagttgccatttgatttcattgtttcctttgctgtgcaaaagacttttagtttgatgtagtctcatttatttacttttgatttgtggcctgagcttttggtatgatatccaaataaataagtaaatcattgccaagaccattttctgggaactattcccgtgtattctcttctaggagttttatagtttctggccttacattgatgtcgattatgcatttcatgttgaattttgtatatggcgcaagagaatggtctaattttattcttctgcctgtgaaaatctagtttttccagcaccatttattgaagagattatcctttccccattgtgttcttttggtggctttgtcaaaaattagttgactatatatctttgaattcatttctgagctcttgattctgttgcactggtccatgtttatatcagcaacttactgttttgattaccatagctttgtagtgtaatttaaaataatgatgtgcgatgatttttgactcgaaccaagcttgcatttgtggggtgaatgctacttggttatgaggtattgctcattttagatatagctggatttaatttgctaatattttgttgagtttttttgcctctcagttcatgaggaacatttgtcaatagtgtgtttttcttttattgtttttggctttgatattaggatatgttggcctcattcctcttaagtgttctggaagagattaagcaaaattagtgttacttctgtccagaatgtttggtagaatttaccagtgaaaaccactgggcttgtgcttttctttattggaaaattttattcacaaattctatttgatttcaaaatgtaggactattaatgtcaatttttaaaacagatttggtatctttcaaataattggtcaatttcatctttcagcatttcctttttatctttctcttattgtctgtagggtctgtagtgataatcatacttcattgctgatatgggtaatttgtgccttatctcctttttctttatcagtctgggtaggagttaaacaaatttttattgatttgtttcaaagatcagcttttgatttttttcgtctatttttattgttctcaatttcattgatttctctctttttttgttgctgttttttgttttgttttgttttttgagaaaaggtctcactctgtcacccaggctggagtgcagctcactgcagcctcaacctcccaggtttaggtgatcttcccacctcagccccccaagtagcagggactactggcacacaccaccatgcccagacaattttttgtactttttggtagggacggggttttgccatgttgcccaggttggtcttgaactcctaggctcaagcaatccaccccactcagcctcctaaagtgctaagaccacaggcataagccactgtgcgaggctgatttctgtttttaacttttattattttcttccttttgtttgttttgggtttgttttgttcttctttaactaatttcttaatggggaagcttacatgattaatatgaaccctttattctttcctatataagcattcgatgctaaaaattttaccctaggcaccactttaaatgtatctcatgctttaatacatcttattttcattcaattaaaaatatttttaaaaatttcctttgattctattttacagtgagttgtacactatatttttttacagatagcttttcatggtttacttctaatttaattacattacaatcagagatcattgtttgcatgatttcagttcttttaaatttgttaagtttggttttatggctgagaatatgggccatcatgttacatattcagtgtgcacttgaaatatgtattttgcttttagtaagtggagtgtttcttaaatgtcaactaggagaagtttgttgatggtgttattcaggtcttgtatattcttgcttgttttctgggtctctcattaactgagaaaggagaatcgaagtctctaagtataattgtgggtttgtctatttcctaattcagttttattagttcttgcatcatatattttggaatgtacaccttgttaaaagtacatacacatttggaaatgctatgtagcttggtggattgaccctttatcactataaaatgttcttattcctaggtaaatattttccttgctctaaagtctgctttgtctgatattagtatagcttctccagctttctttgtattagtgtttgcatggtatgtctttttccatatttttacttttaacttatctttataaacacatttaaagtgaatttttttgtagataacatatagttgcatcttatttttaaagtttaatttgataatctctattctttaataggtacagtttatgtttaatgtaattattaaaatagttggacttagggctaccattttattattaggtttttatttattatcctttttttgttcccccacctccatttcctgccttcttctgggttatttgaatttttttttttttttttgagatggagtcttgctttgttgcccagggtgtagtgcagtggcacgatctcagctcactgcaagctccgcttcctggttcaagcgattctcctgcctcagcctcccgagtagctgagactgcaggcacctaccaccacgcccggctaatttcttgtatttttggtagagacagggtttcaccatgttagccaggatggtcttgatctcctgacctcatgatccacctgcctcagcctcccaaagtgctgggattacaggtgtgagcgaccgtgcccggccttgaatattttttaatatttaactttatctgtcggctgtttgtatatatctctttgaattattttagttgtttttctagtgattaccatatacaaacttagctttacacaatctacttagagggaatagtttatcacttcaagtgaaatatataaaccttgtcactttaccctccttgatttgtgtcatagttgtcattttcattatatctacatgacttgagaaccctatagataaggttataatttttgctattaacaataaatatgttaaagaacttagtatagtaaaatattatgttacccagatatttaccatttctgttgctctctttagttcttatgttgatatttccctctgatatcatttcccttcagctttagaatttatttcagcatttcattaagaaatctgctggcaagaagtctcttggtttttcttcattgagtatgctttgttttgccttcattcctgaaggatatttttgctggatataaagttctggttagcagttcttttctttcatcacttaaaagatgtgtcactgtcatctagcctgtgtgatttctgaagagaaatttgcaattatttaagccattgtgctcttaaaggcatatgttgttttcctctggttgcctttatatttttttcctcatctttggttttcagcagtctgcatatgatgtttctgggtatggttttataagtttactttggtaggagtgtgctgagcttcttgaatctccaattatgtctttcactcagtttgagaagttttcagccattatttcttcaaatattttttctatgattacctctttctttcatttcttcttctgccaattaaaattccactttacatccaaccatcactttggctttgaagccgccacttaatattaacacttggtagatgtagtatgactattcttatatgtctctatctactgatgaggatcctactcctttaatactactgaagagtactctttttagatcctgctcttccaggactccattgatatgcatgtcagatctttttattatcattccataggttgctgaggacttgttcatttttttctgtctctctttttctctgttttttagattgtttaatttctattgatcaatcttcaaattcactgactctttccactgtcatctacatattgctattgcatccatctagtggatttttaaatttccaatattgtgtatttcagttctaaaatgtccaccgggttccattttatggttactgtttctcagcaattaatttctatctttcattcattttaacagtgttcatctttacctcatggaggattattgaagagctgccctaaagtccttgcctgataattccaccattggtgtccttttggggttgacatctgttgattgtgggtttcccttaatattgatccatttttcctggctctttgtatgtcaaattgttttggattataccatgaacattttgaatattgtattagtctgttttcacactgctgataaagacatattcgagactcggtaatttataaagaaaaagaggtttaatggactcacagttctacatggctggggaggcctcacaatcgtggtggaaggcaaaaggcatgtcttacatggtggcaggaaagacagaatgagagccaagcaaaagggaaaaccccttataaaaccatcagacctcatgacacttattcactaccttgagaacagtatggaggaaaccacccccatgattcaattatctcccactgggtccctcccacaacatgtgggaattatgagagctacaattcaagatgagatttgggtggggacacagccaaaccatatcaaacattatgtggtgaggctcaaggtcctgttaaaattctgtggagaaatgttgattttgtttatctgtttaagcaggcaaccaaccaagtttcctttttccagctcttctttttgtgatttcttttatactctccagctctcaagatgtccctttttatggtttctgcagccagaaagagtcttctcaaaattttagcctcttatgatgtcatgcggttcacacaattggtgacgccttcacagtgaggcagcaggagaaaagagagagagagagaggaaaaacaaaacaaaacaaaacgtattttctctccactatttacacagcaggacttcctcttgcttggttcctctggtcattgagttggatttttcttggggttttaggtactcatgctaaaggaaaaaaaaagagggaatcataatctctagcagagattatgatagaggacttttcctctatcctcagactggaaagaaggggcttctcctggagtttttgctgtcagtgtttgcttcccagttctagaatgcagtctgcactcaggtcaaataaggggaagaaaggagagtaaaaatccacaaactgtacccttatgggtccttatttatttttgctttagttcccaatgcacctgtcattgtgtaattttcaaagtcctcaggcagttgatttttgtactctgttcagagttcttagttgtaatcaatgggattgataggctgtagtcagcttactccatttgggctggcaccagaagcctacatatgttttcaatatctacttttttacacttaaaatattttataaacatttttccgtgccattatacattctcccataacataatttttaagactgcatattcattcgagtgtttatattgattgtcttagtgaatatatgaataaataaatctttacacacatctgtgattattttcttaggatagattccttttttttttttttttttttttgcagttgcaagatttaatagagtgaaaacagagctcctatacaatgggaggggacccaaagggggttgccactccgtgctcaaatgcctgtgtttatatcccgatcattatccctgccccatgctctctggcgatatatgatttgactatttctttacctcctctttttagcctaatttgtattttagtgagccctctttatacctgattggctgagtgtgagctgagttacaagccctgtgtttaaaggtaggtgtggtcacctttcccagctaggcctaggaattcttagtcagcctaggaaatccagctagtcctgtctctcagtcccacctctcaacaggaaaacccaagtgctgttggggaggttggctgacaaccgctcttaactgcttcatgctgaattggggcatagtaggggtcgtgcagttgagatttccttgggaggggtgccttcaatgtcatcaacattggagcatgggctagcaggccagtccaggggtccgcggtagatcttagtcatggactgcatctggggctccatttgaagaaccatttgtagttttacagcttcgattctggaagagacaaacgtaacaaggaggttaaagatacaaggattgaaatgtacggcctgaagtgcaggggcatatgagtgtgggcggtgcaagtggggtttcctttagaaaaactccgatacaatagggcatcaatatttctaggaagccacattctccatagaagctctcggtaaggggagctactggtagtacagcagcatacagggggtgcagtgagagtgaaagggggtaagagaacagtaaaaagaaaaatatgacaagggagggccaagaggatctacgattctagttactttcctcacggttgtcgcctgaagagcaggcgcagatcctctagaggttcacaggaatagctagcattgtctgctggattttcgggttcctttggcagtatccagggtttggctcgagtgtgacttatccaagactccactccagccacttaactgcggttagggtagataaaatgactgggtagggtccttcccaggatgtgtgtagggatggggaattaaaggggaagggacttgactaataccatgtcaccagggtggaataattcctttccctcctctcagggacaggttccctgtaatgttttaagaactcgttgatatttggctaaggaggtgatgtctgcaactaagttggccgtctctcagtcaagcacaaggtcattggttaggaagggctgtccatacagcatctcatatggactaagtcctgctttttggggacagtttcggattcttagtaaggctataggcaacagagcaggccatgcaaggtgggtttcttgggttagcttttttagatgtcgtttgagtgtttcattcattttctcaacttttcctgaggatcgtggcctccaggcacagtgtaagtgatattgtatacctaacgcctgggatactccctgcgttactgcagccttgaaattggggccattgtcactctgtaaacctcagggaagtccgaatctgggaattatttcatgaattagtacttttattacctcttgggccttttctgtcctacaagggaaggcctccacccaaccagtgaaagtacccagattagtagatactgaaatctctgagatttgggcatgtgggtaaaatctagttgctagtcttctcctgggtaatggcctgttctttgttctcctgaaggagcttggcaataaggcaggggattatttctttggcacacttcacaggccctgactatctgcttgacagttttgaaaaggcctggtccagtaaataatgatttggccatctgatgggtgctgtcaatgcctaagtgaaaggtctggtgaagggttttaagtaatttccattggttagctgcaggcaaaagtattttttctttggtggctggccatcctgaggagaggaaactatgtcctcgtgagtttccccattccatttcttctgctgagtactggagcttggtttcccagaggggattaccccatactaggggtccttctgtaagcatttctaatggagagtcctgccttgtggctcttttggcttcaatatctgcttggcgattccctatatttccctttcctttcctttcctttctgatgaccccagcagtgtaagactgccatctctttaggtttctgtacagccaataataatgtcctaatggtttcctgatgtttgatacgtgttccctcggaagttaggaattccctttctctccatattgctgcatgggcatggaggactaggtaagcatacttagtctgtatatatttaccctttttccttctaattctagtgcctgagtgacggctattagttctgccagctgagtgctagttcctggagtgaggggattactttcaagtattccattatcactgaacactgcgtaagccgcctttcgaagtcctttttctacaaaggagcttccatcagtatacaagttgaggtcgggatcagtcaagggaacctctaaaaggtccccttgagcggcataggtttgagcaattacttgttgccagttatgttctattttttcttcattgtctggaagaaatgtggctggattaagagttgcgcaagtgtgcagtcacagcactggtccttcaagtaatagagcccgatatttaagcaaacggttgtctgacagccacaagtcccctttagcagtgagtatgctgttcacatcatgagatgtccacacagtaagagctcttccttgtatcattttaactgctttagatactaagactgctattgctgccactacccgtaaacagtgaggccaacgctttgccactacatcaatttccttactcaggtatgccacgggttgcaagctggtcccagtttccttactcaggtatgccacgggttgcaagctggtccttcggacctgtgtaaggactcttagagctgttcatgttttttctgtgacatataaagaaaagtcttgcctcgttggtaagcttaacactggggcttgggttaggccctactttaggacctgaaaagccacttctgcttcaggtgtctatcttactaaatgggtattggctttctgagtttccttaattagtgtgtataatggcctggctattttgccatacctgttaatccatatttggcagaagcctgttatgccaaggaacattcttaattgcttcagggttttgggatgaggataagccgatataggctggatacgttcctcactgagggccctggtgcctttggataattttagccgtaagtgtttaacctgctgtaagcagagctgagcctttggtttggaaaccttgtagccacaagtggcgaggaagtttaaaagcgcttgggtggcttgatggcacaaggtttctgaacgggcagctagaagtaaatcatccatgtaccaaaggacatgagtgtccaagtatgagaactggctcaagtcttgggctaatgcctggccaaacagataggggctatccctgaacccttggggtaaaacagtccaggtgagttgagacattgggttcaaaggatcttcaaaggcaaataagaattgagagtcaggatgtacagggatgcagaaaaaagcatccctaaggtccaggactgtaaaccactctgcttcctctagtatttgggaaagtggagtataagggttaggtacagctgggtatagagggacaatggcctcattgataatcctgagatcttgcactaacctccattgtccattgggtttctgtactcctaaaattggagtattgcaggggctactgcatggttttactaggccttgggcttttaggtccttaacaatcttttggagtccttgctgggcctcgggtctaagtgggtactgcctttggtagggaaaggaggcagaatcctttagtttaacttgaatgggatgagcattctttgctcgtccatattttccttctgttgcccagacttcaggattaattccttcctcaagtaggggacaacaaacgtgtgttccttctcctatgttcaggtgtctaatggcccctgcttttgctagaatgtcctctctaacaaaggagtggggctttcaggcataattagaaaggcatgtgaaaagagtaaagttccccagttacaacttattggctgggagaagtatctagtgactggctgtcataggacccctcagatagtgacagatctggaggacagttgtccgggacaggagagtaagactgagaaggccgcaccagtgtccaggagacagttaaccttctggccctcaatggtcaagcatacccgaggctctgtgacggtgatggtatgggctggtgcttgccccgggcaccctcagtcctgctaccggctcatgtggttagtggcttctgactcagaggaccttcatcccctggggcagtgggccttccagtgactcccttgacataaggggcatggacgagggggtggcttatttctattcggacaatcttttttacagtgtccttgtagactgcactggaagcaagccctattaggcatttgatttgcccagcctttccctgttccagagcctccaaagtctgcttgcctgagggccatgactaaagcggtggcctttttcttatcccgtttgtcccattccacctgctcctcctgatctctattataaaaaaccgaggttgccaagttcagtagcatttctaagctttgctccaggcctaaggcggacttttgaagtttttttctaatgtctgcagctgactgagtgataaacttatcctttaagattagttggccttcaatagagtcgggtgacagggaggtttgcttcctcaatgccttccttagtctctccagaaaggcagtaggattttcttcctttccctgtgttatagtggacatcattgaataatttataggctttctcctagtttcccttagtccttctagcacacaagttagtaaatgtctgcagcaccaatctccatgttctgattctgcatcctaatgagggtctacactgggaagtgcttgctggccagtggggaattgttcttttctctgttgtcatcctatcattgacttaactgtaactgagatatcagagatcgccaaactctcgggctgcagttacggtggcacttctctcatttggggttagtgtctgatctagcagtaacattacatctctccatgtcagatcaaagtattgtcctaacccttgtaaaacatcaatatagccatcagggtcatctgagaatttacctaggtctattttaatttgcttcaagtctgagagggaaaaaggtacatgcactctgactgggctgaattctccagaatacatcttaggggtgtttttgccttgtggagaacgtttcccatctgaaaatagaacatagggatgccagcacccctagtcattttctgatgagcattagtcataggtgtcctctgtggtcctaatgcttattcctttccaggacgtataacaacccatggacctctgcttattggattcgttacgctcaccgatgtagcagtcctgcaccccttttcccacctttcttgaccacaaagaaaggggtccaggctgctggattctagtggtccttttccagcgtgcccaacattgcctttgtgctcaggggtgagtcctagagctgggctgggttcctgagtatttcatagcaacccagctgctccatcaagatgcattcccataaacaacagtccttatgcaaattcatttcagagagggtgtaggtaaccttttgagtcaggattgagatagagtttttttgattccgtaagtactttgaggcttggctaagtgcaaacagctcagacatttgagcagaccaattattaggcaattctcctaactctgcttccacaagagtctccctatcaattactgaatacccattgtggtttttctctcaatcacccgggaggtgccatctgtcctcctgtcctgaagggagttcctcctaggtctggtcggacctttgtatggtaattaagatttaaatcccctgttaggaaatctgctgggttaagggaattttcagtgattaatgttaaatcaactttttctaacagaatagccccatactttaagatttttgagttagtaagctacctttttgcttttttgacttagaatagttctgaactggtgaggtgtgctcacaatgaggtttcctctaaaggttatttttctattttattctgttagcaaagcagttgctgctacagattgaatgcatttgggccatccatggctgagataaggatttttgataggaaggctacgggttgtcagtggtttcactgttttcaggctacacccttgtttacactgacaacaaggtagtattggagtgttatagggtcatggagaagaccttcaattatcaattataggttttaaatttaccctggcttttaaaggaatagggcacactttttttctttactacttctatctctctttttctctctttctgcctctctttccccaccccctgcctctctttcccctctctctctctgccttgacttactcaattcactttcatcctgatctgttatgttgttgtagacccagttccagttgttaaagtactgggtcatcagttctaaggccctggcaaggatggtggggaacaggtgtcacataactgcccatgttgagagctgtatgcctaaattgggagggacacgagggacaagacaccctgggttcatagcctagggccctaaggacacagtgtagagcttccttagatccctttggagatacaacttgctctaatacttgggagaggaagtgaaagtctgaagcattagtacctaggaggcagggatcagaggaagtagattcaaaggtaaggagaattttggggctatactttcaagaaagttgtggtcgggacctaggaggtataggtcagaaggaaagatggggcgcacgcatgggcaactgttgaagagagacttctggctgtgccatgatctcagctggcttatgccgggagttcaggacgacagctctctgcctctagttggccctcggcttcccccagaaaaattgtgaaagcggaagctggttccaggcagaccaacgctcccaacccagagggttgggggttgttagaaagcgttttcccaggaagcctcacacctgagtcttaagtcaggcagccatgctcattgtttttaactggccaacaggtgcctagtattttccttcaattctaaggaaggataggacagaatagcaagtgaaagtggtctcatattactcacctctttggagaatcccagtacggtctaccaaatgttaccggcgggtctttgttcttagagctcccaagatggtggcgggctgctcccaaggtggtggcaagccttttgttctctcacctggggttcttggcctcacacattccaaggaatggaaccttgggccatgtggtgactgttgtagctctattagaagctgtgggtcatggaagagaaccatggaacccagtgactagtgttcagctcaattaggatgaacccaggtgcttagccgtgcccgaacattggtgagactttagtctgatcagagcagcaatggacgcctcactcgatcaggagtgcagtggacaccttgccagatccagagggatggaagtcagcggcgggtctgcgacggcggcaaacaacagtggtggacagcgagcgaaagctcagctcaagctgtgaaaagcacagaccagaagagtgtgcagttgcaagatttaatagagtgaaaacagagctcccatacaatgggaggggacccaaaaggggttgcccttaggataaattcttaaaggcagaattgctatactgacatctttaagagaatatcttaactttaaatcaatttagacaccctccaatacttggagtactgatttctctatattctcgctatagaatgggatagaatagatagaaaaataatggcaatgatcactcagggtgtgtaaacctgacaatttcctgtttagtagattaactgcagatctttcgccacatatctcataaatataagtgactagctgtctttggcttgatgtttataaaattcagtgatatcaggcacatttggtttgggctcataaaaccttgagccagacataaatcttcagtttcatagagcatcctaattaggatagaatcggcatggctgaagagagcaggaatggctttctgtgtgcagtaatcatggggtctgccttatgcattccattcatcttgcattaaaattgtgctttagtcatgagtgatttattaggtccaatttgaagagttggcttctcaactttaggagtctgaggaaagggtattttctataacactgcacatctttttttttttgtaattacatatgtatacctttgctgttttaaaatagacatatgaacattaaaaatccctatagaataggaaaatatactcttctaaactattatgacatatactatgccagagaagattacttctgtatcagcccaagccctggcagagaagagaactggtgcactcaaagtgggtaatttgaatgagtttagtgaaagaaccatttacaattgagggcaggatgtagagatcacaaaatatagcacgaaacatgtaggttagtaactggggactggagagtatcacttctaggcctggagctttgacctttggtgctcatccagtgtgcaggctgccttcagagggtgtgtgaacagaacaaagacctcatgtttcctgttctttctttgtccaatactcattggacagtactcattgattaaacctatcagaagtcagagggtcagcatgcctttcaatgcaatgaacacagatctaccaaagtgaatacaggaaacatgggattgaaatctccttccacaaatgtgttccacaaatgttgctggctaatttgcaactaattgtaaatgatggaagaacatttctatttcaccaggtatttatagtagaatataaaatgataattcgtaacataagacttcttagcagtgccaggcatggtgcctcatgcctgtaatcccagcactttgggaggctgagacaggtggatcactggaggtcaggagttcgaaactagcctggccaacatggtgaaaccccatctctactaaaaatacaaaattagccacaggtggtggtgggtgcctgtaatcccagctactcaagaggcagaggcaggagaatcgcttgaacctgggtggcagaggtgcagtgagccaagatcatgccattgcactccagcctgggcaacagagtgagactatgtctcaaaaaaagaaaaaaaaaaagactgcttagcaaaatatactaccaatttattagagaattatatatagcatattatacatctattaatacctatgatatgaggaatatattagactttataatataagggataagcacttgggcttgggagttacacttagtttgaatcccctcttttccatctatgagctctctgacttggggtgagcttattaccttctgtaagtcataaagcttctattttgtttgtttcatacgttacacaggaatataatagtacctaccatataggattgttgtgaggattaaatgagataatgtatttttcttagtccatttgtattgctataaaggaatacctgagatggggtaatttatagaggaaaaagatttatttggctcatgattctgctggctggaagactgggcatctggtgaaagtctcaggctacataaactcatggtgaaatgtaacggggagcctgagtatgaagagatcacgtggcaagggaggaagcaagagagagaggagaggtgccacactctttttagcaaccagctcttgtgggaactaatagagatataacccatttactgccccccagagaggggatttacctattcctgagtgatccacccccataactcaatcaattcccattaggccccacctccagcactgggaattaaatttcaacatgagttttggaaggatcaaactttcaaactacagtagtatggaaattgcataagccaatgtctggcacatattaagtattgtacttaataaatgtctattattctaattgttacacatgtgtgaccagggacaagaatgaagagttgagttggttcatcctctcctcattttaggatgaaactaattgcttaacttagtgtttagaaaggatagagagtttagtaattaagggcacaggttctggagaaaaatcttttgagtttgcagcctagttctgcctctagctgtttctttgacaaatacttatctgctcatcttctcagtgctttaatttcttcatctgaaaattgggtttgatatctctatcatctatctatctatctgtctttctatctatctatccatccatccatccatagatatagttatatttttaaaagtttatatactgtatatataaaaagataagtatgaaaattcattataatatcaaaaacttagaatttatagtcgatctgttttcaggatgtgagaacatagtcccacagaagccagatctggtgaaattgttttccaatataggcataccttggtgagattgtgggtttgggttcagaccacagcagtaaagtgaatattgcaataaagtgacgcacatgaattttttggtttcacagtacatataaaagttatgtttacactttactgtaatctaccaagtgtgcaatgccattatgtctaaaaaatgtacatgccttaatttaaaaatactttattgctaaaatatcttaatgatcatctgagccctcattgagtaattgtcttttactagtggaggctcttgccttgatgttgatggctgctgattgatctgggtggtggttgctgaaggttggggtgactggcagtttcctaaaataggacacctgtgaagtttgctgcattgattgacttgtcctttcatgaaagattgttctgtaccgtgcaatgcttggtagcattttacccacaatagaacttctttcacaattgttgtcaatcctctcagatcctgctgctgctttatcaactaagtgtatgtaatgttctaaatcctttgttgtcatttcaacagtgttcacagtatcttcaacaggtgtagattccatttcaagaaagcattttctttgctcgtctataagaagcaatacctgatctgttcaagtgtgtcatgacgttgcagcaattcaatcatatcttcagactccacttttaattccatttctcttgtaatttctaccacatctgcagttaactttctcctctgatgtcttgaactcctcaaaatcatccatgagggttggaattgacttcttccaaactcctgttaatgttgacattttgacttcctcccataaattacaaatattcttaatagcttgtagaatggtgaatcctctggtgtttagctatgtatagaatggctcacattaaccagggtctctgctctgctttcaaagaagtttcgatctgacagtgcaactgcagattataatgagcttaacaccagagaaatcttttaatatatgttttaaaataaatgaataatgactgtattaataaatgctaaaaatcacaatccttgctgacaacgaagagaaaaaaagctgtgtctctatctttgaaagcactagtctattccaaggcacagttacgatggtaaaacaaaatattgttagtctcatagatgcacatcaatgaaagacagtaggttggcatcttaatagccatagctatagaaatggctctgcgaaactgtaattaacaaaacaatataaactggagagaaacatattttagtatgagagtactaaagttaaaggttccaaatattatcaattaattaatccctaattcattccaggaaggaaagctatacacatgcataagatgaaatgtactattgcttctctttgtttaattttgttacttttttcctctataaaatagtaaattccaagatagtcataaaattaggtgagaggaaacaccatctgtaagcaacgtctggtgctttttaggtgtattagtaatattaataaaataatattttacctaaaaaaaaatggtgaatcctttccagaaagttttccatttattttgcccagatccatcagaggaatcactgcctgtggcagctacagccttatgaaatacatttatttatttattttttgagataggatatatctctctcacccatgctggaatgcagtggcatgaacatggctcactgcagccttgacctcctgggctcaagagatcctcctgcctcagcctctcatgtagctgggactacaggtgtgcatcaccatgctgggctaattttttgattttttttttttttttttttgtagagacagggtctcactttgttgcccagactgatctcaaactcctgggctcaggcagtcctcctgcctcagcctctcaaagtgttggtgttacagggatcagctaccatccccaacctatatttcttaaataataagacttgaaagtcaaaattccctcttgatccatgggctgcagaatgggtgttgtgtcagaaggcatgaaaacattaattttcctttacatctgcatcaaagctcttgggtgactaggtgcattgtcaatgagcagttatattttgaaagaagtccttttgttttctgagcagtagatctcagtagtgggcttaaaatattcagtaaaccatgctgtaaacagaacccttagattttcgaaatggtaaatgagcattggcctcaacttcaagtcaccagtctcattagcccctaacaagagagtaagcctgtccatcaaagctttgaggtcaggtcaggtgcagtggcttgtggctgtaatcccagcgttttgagagtctgaggcgggaggattgcttgaggccaggagattgagactagcctgggcaacatagcatgagtctatctctacttaaaatttaaaaattagctatgtgtggtgtcatatggctatagtcccaggtactcaggaggctgaggtgggagcattgcttgagcccaggaattcaaggctgcagtgagctgtgattgcaccactgcactctagcctgggtgacacagtgagactcttgtctctgaaaaaaacaaaacaatcatccctcccctcacaaaaaaatcactttgaagccaggcattgacttctcatttctagctgtgagagtcctagatggcatcttcttctaatagaaggttgttttgtctacattgaaaatctgttgtttattgcagtcatcttcagcaatgatcttagttggatcttctgtataacttgctgcaacttctacttcagcacttgctgcttcaccttgcagtttatgttatgaagacagcttttttccttaaacctcatgaatcgacctctgctagcttccaacttttcttcttcagcttcctcatccctctcagccctcatagaattgaagagagttaggaccttgctctggattaggttttggcttaagggaatgttgtgtctggtttgatcttctctccagatcactcaaactttctccgtgtcagcaataaggctgttttcttttttatcatttcagtgttcactggagtagtacttttaatttctttcaataacttttcctttgcattcacaacttgggtaactgtttagcacaagaggcctagtttttggcctgtctaggtttctgacatgtctggtttcctcaccaggcttaatcatttctagcttttgctttaaagtgagagatgtgcaactcttcttttcccttgatcacttagaggccattgtagggatattaataggcccaatttcaatattatttaatcttgggaaatagggaggcctgaagagaaggagaaaaatgggggaatagccggttggtggagcagtcaaaacacacacaacatgtatggattgcacttgccatcttctatgggtgaggtttgaggtgccccaaaacaattataatagtaagatcaaggattgctgatcatagatcaccataacagatataataataatgaaaaatttgaaatattgcaaggattaccaaaatgggacagagagacaggaagtaagcatatgctgttggaaaaatggcactgatacccttgcttgatgcagggttgccacaaaacctttaatttgttaaaaacaaaacaaaactacccatctgtgagttgagtgcggtaaaatgaggtgtgcctctatgtgattgatgtccccccatatctgctggtctaaaatctgaggtggcgtccataagattcttttccgtttgactcagagataataagcatctcgaaaggcttcttttcatttcagggtggtagatctgggaggcagccaatgtgttgccaaattggtggcagaaacctagaaaatgggtaggaagaagtagtaaaagcactaacagaagtacgttacatcctgggagatgtaatatacacaaataaagtgttgtaggttgttgctaatggtaagagttagcagcagtgtacactgaggcctgtagtttctattttatgtactccattgcttcggagtgagagaaccagccggtgagtaggggaaaataccttctcaatagagctgaggtttgttgcatggaggcctacaaagcactattttactaaattgagctagaattgtacatacaaacattttcaaccatagatctgggactagaatagcacccaagtaaaaaagtgacccctagataagtctccgtatcctatctattgaaaaatattaatactagcattagacaaatatttccttgctccaggttgatcaaatagaaaaaaaaaacaactttatgcaaccattgaaaattattgtagaacaaaggaaatatatatcatcctgaaaactcgaaagaacaccagtgaaaattatttacaataggaaacaaaaaagtttagaaaactgttcagaatcctcactatattgaaaaaggtgtagtctcagtgaaacagagcacaatgccatgagttgagaattgagaaatgaaaaggcaacaggatgagttgaaaaggggagtggatgaaatgaggttagttgcaagactctaaaaatgcaatggcaaaaacaaaaaaggaaatgcaatagcaaaattaacatccacaatgggggcagtaaaaggtaaaattgatactgtgggaaaccagatcagtgtgatggagaataagctaaagaaatgttttcagaatttagaagaaaaggaaaaagaaaataatgaaagagaaaccgtgaggtaaagagaatggaacttcagtaacaattattgattattcctgaataataaactatagtaattagaaaaaaataataaaacaaaattgaagaaaattactagtgcaggaagcaaaaaaaattaaaagactactgtatgaattgaaaggttaattgtctttcaggcaaaacacataagaaatgacatttagctggactcatcctggcaaagtttgaggtttaaaataatgatcagctatcatataagtagccatgcaagaaaaaccaaataaaacatacacaaagagcactccagaaaattacctagtaaggagcaaaaattacagttttttgaatcatctaaatttattatgtattatttagactctgagtcaaagagagtaacagagcaacacctaaagaattttgaggcaaaaattgtcttctaaaaattttatacctgaccaagttatcttcctaagataattaaaatatattatcagttatgtaagttttcagaacatactatgcatatacctcatcttgttttttcatccctttattactgcattttaattgaacaagccaagaaaggaattaaaataaaaaattcaacaatgaagtagaaatgatataaaactaaaatgtcactaatttgcagactattggtcaaaaattgagctgagttagtgtggttttaattacagctactttatcttttttttttttttttttttttttgagatggagtctcactctgtcaccaggctggagtgcagtggcacgatctcggctcactgcaacctctgcctcctgtgttcaagctattctcctgcctcagcctcccgagtagctgggactacaggcgtgtgccaccatgcccgggtaattttttgtatttttagtagagacagggtttcaccatattagccagggtggtctcgatctcctgaccttggaatttgcctgctttggcctgccaaagtgctgggattacaggcgtgagccaccacgcccggccctagatactttttaatgctgttttcctggttaaagttacagagaaataatctggccagatatttcctacagaaatgctactttaatgagtacttaagaattatttgttaattagcacctgaaagtactgatctgaatatgggcttttcctgccttcattgctgtttacatgaatgaatataaattgataagctggctaaggtatctcttctgaaattttaatatgctttatcattggtcagtttcaaaggtaaattgcagtctaatttaggcctatctagcatgagagtgactaagttattttaaagacctcacccagtcagatggcttctcttcttgctcttaaattgcggttttaaatagcagaatcaaaaagagaagatgaagagtgttgtattattgtcactgtaaatagacttatgcttaatagctcactgtgggaattcccctgagatttcatttatgggtacagtatcagaatgtcatgctgatatggatggccaatagataagtatatattaataattgatagtttcttaatgacgcttctgtctttgaaaaaatgattttaaaagaaggaatatctttcaatccagttatggatctctatcaaatataagtcagaggttaataggactgtgtcattgatactgtaatacaattgcaattgccttattcctactttacatttttattgaaagtcaacctagcatataattttaaaatgattttttccatcttatacatttaatttttctatatattagcacaaattaaactcatagcttgactgtaatcaacatatgtgaaccaatatctggttaccacagaaaaccattattatatgacctaatttgatatttaaaaaattgccattagtgaccttaggcacaaatagaaagggaatagccctgtaacagcagacttaaattgtaaaggaaaagtgaagttttttgtttttttttttcctaagagaatgcctatcagatagaatctcccttgctttttgatgaagtggggcttgctctgttactttgtagtgggagaatttctcagacattctgctgtagcaaaaaatttagaccttatcacctttcccaatcctataccccctcatttcctcattatttttcttagtggcttagagtgcatggcccaaccttataagcacacccccagcataccctcatcatatcctgtttaccttcaatcttactcatttgaaaaatctataatccggattaaactcaactacttgtctactcatgcctgtacactagcagctaagaatgattgaagaaaatcacagaagcctcccgtgtgatcttgcttgatgtttataaccacaaatatccaatgagcgctccgtactgtgctgaccaaccagctactacacttacctaggcagtttcatcttcgattctcacagtgcctctttcacctgttttcctctatcctcaaatcttgggcatccctctctaatcctctcactcagctgtctctttcactcagagagcaatcttcatattagccaaagggcatggtgaccttgctgcttgtttcagtataagacaacaaaagcaatcggaagaagcttctacattctcccatcatcaaatttctcaaaccacctccacttgaaactctactatactttctctcctattgcagtagaagaagtgtctgtgcttctaaggacaactcttccatgtataccttggaatctataacctcatacctactcgagcattttattactcagagtatctctcctccctcctgtgttacagttttccatttcaattgcttcatttccatcagtccacaaacatagtgtgctatcatctctcatcttacacgaaacaagacaaaataaaatttgtctttgtcttaaatctcctagtgtcactctatttttctggttctattttcagcaaaactccttggaagaagtctacacttctggttttcacttcctcttcctccattctctctgaaacacactctgccccagtgaaggaagtctaatcaaggtcatcagtaaccactgcgtcaacacatacagtggctaattctgattttttacttacataactcacaggaatgactagcctagtaaataaccttctttttcttgaaggattttcttaaaacttggattctgggaagtgacactcttacctttcttctgaccattctggctattttctgtttcttcttagcctcccttactggttcctcttcctcttcttaacctctcaatgttgaattcctgagaaatcagttctagaccatcttccccttatagtctacattcactaccttggggaactcaactagcattatggtggctttaaatacattctatctgatgttggtcccccaaatttatattttgagccccagtctctcttgagctctatattcttgtatctaaccacctgcttttcaaacttatgttaaaaaacttttcttgattttacctcccaaacctgcttctactcccttattctctatctaaataaatggcaccccatcatccaagacttttgtgttgtacaactccggggtatgttgttcttatggattaattggacctttgttagcatcttctgtgcatttttttcccatgggtatctcatttatttgaattggactaaaaaatgtaaaccgtttggtagctgtatttagctcttgaaagtttcagtctatctgggtagctgctatactaattacatgatgaaaatgaacagctaatattcttttgtttgagaaattgccaaagatcagagaaccatcttcatattgactaaagtgcataactcaaaaaataataattttaactttaacttcagatcttggaaacatttcagtgaagagtttttgatttaaaaagaccatcagttttcacttaccatttaggataataaccatataatatttttcgattccaccaaaaatggccacatttctctttgactaaaaagtagtaaatatcagcagctctttttatttgctgctactactgcagaaagcttcataaacttttcagccagaaatattgtaaagatcaaagagctttcaaatgagtttctaactaacaatgtagatactctgtctgcattagccaaacttgctatgctctgttccctagagcacaccatattctaagcaagacagggattattaaaaagttaaccgtggaataaataatcaacataaaatagtatgcatgatatgtgcataagtttttaaagctaattataaagataattttacctctactgctgttttccatatcatgttattttcccagactgtaattttgcctcctgccctgaagtagctgccatcctgaattttgtgtttatatcctcctccttttttagtagtatatactcctaaacaaaatattgtgttggttagttttgcttgattaggggcttcataaaagtggtttcattatgaaagctttctttatccaaatagaaatagtgtgtttaagtggggtaagcttggcagaacaatggaccattgtgatatcatttacatgcttatgttttttattgccttcagtactatgtaatttggtcttgtcactgattagccaattaggaattggaaggatgatatgtaaatgttactgtctaactgacagaatgatttattagaagtgtgtatttgtagaatttcacctgctttgttgtttgggaggctcagtgccaaacctaaacacaagggtcaatggcagacctgtggccagcggtttataagaaaattcagccacagttgaatttcattcaagtacggttttgtttgcttgccagtggtgccatgctgactttagaatatatttaccttttctatagtttccatcagcattgttgatttcagcatgtatggatataacccgtgggtcctgatgccacccactgacagcactggcttggtttttggccctgcttgtgctggtactttctattcttccaatgtcagtgtttctactctattcttactgccaaatggatcctctgaaccgtaagatttacatgaagagggcttccctttgctcttggaaaactgtgtggctcattgacctaggttgtttcctttgatttcagagatgggagaggttttgttctcattaaaaatattcttttgatttcacgattttgtcttaatgtgttttggatagaaaaatgctaaaaataatactcttacaaagaaagcagaaaaaaagaaggaactgatatttgtccatagctttaatccacaaaattaaaaagcattcacttattttaagaaataataggagtcatttttatgaaaatgtgttagttagagcttactaagtttaatcttctgatgtccttattctctttattttaaaaagcaagcaatatatacattgcaagcctctgtaaagattgcgtaagatgctaatggagagaagatagtaatatagtcatacttaaagtttattctctttttttttttttgagatgaagtcttgctctgttgcccaggctagagtgcagtggtgctatctccactcactgcaacctatgcctccaggttcaagcgattctcctgcctcagcctcctgaggagctgggattacagccactcaccactacacccggctaatttttgtatttttaggagagatggggtttcaccatgttggccaggctggtctcaaactcctgacctcaagtgatccacccgcctcggcctcccaaagtgctgggattacaggcctgagccaccgtgcccagcctattctcttatataattaatttaagctcactcttataaaattttcaagttttatttcatgtcatctttttatgcatgcctgagaggttatttttcatataattttttttgcttactgatgctttaaataaccagtgtaggtaatgtttattaaagtgagatgtcaggttgctggctttcattgttgaagagtctgttttaggtgaataaggagagaaaatgaggtaatgaggtggcgcatatagtagcatctcggagaccactgagaccaatgcaggaaaatatcctggagtgcacagtccatcaattccagtatgagtagcctgcaaggatgatccacatcaacattcacaacattgtgtaaattacactaattaagtaatcactttgtttttcttccaccattttagaagaatttccaaggaattattggttgggggaaagagggataagttggaatagacaaggagaggaagataggattaagggtctagattccttcagtgaatggtggctctgagcaggtagagatgaaggggaggagactggagactcttagaggactgtatgagggatagagctctgaaaactgggaagacggaatccagagtggtttgtcaggtgtgacaccgtagaaactgcctattgtgttggactttggagacttagggggaaagggtaggaagtgggtgagggataaaagactagaaattgggttcagtatatactgctcaggttatgggtgcaccaaaatctcacaaatcaccattaaagaacttattcatgtaacgaaatgccacctgttcccccaaaaccaatggaaataagaaattaataataataataaaaacttctactctaaaaaacaagaaaacaaacaaaaacaatcacttggggagtttttacaatttctaatgcccaagtttccctttatatcaattaaataagaatctctagtggtagacattggcatcagtatttttcaaagatttcccaggttattccaatgtgttagcaaagtttgggaaacagacctagcctatgctattcagtctcctacagtattaatatattcctgaaaatgtgtaagagtaaagtgatgttttttgctgttgtagaatatgttcatccctagagaacttaaaatataaatattttatagcttgctttatgacatattattcactatattgataatattttatatgactttattctttgtttacatttgaacacaatcttgtggatatgtggtgctaatattttcctcttttggcacatctaattagttccatgttttctcacaattaagtttataagactgaaggtttttattcttaaaaaacaaacaaaaaaaacacctattgtgactcctcaattaatgtccgagaaaatattttcagccggaagggaaggacttaaaacgtttcatgagatattaaatggaaatgcattgttcagggcctcttaggatatatatatatatataaaatataatatatataaaaatatataatatgatacataatatataatataatatgtaaaatatataatatagtatataaaagataatgttatataaatatatataatataatatatatagggtcatagaacatatcccaggggagattatgttaattgtctatcattgcatttaacatgtaacagtattctagataaaataatagtggttgatattgttttttcatcccctctctactcctttacattttgttttggttaacagataactgacttaataaaattaaaaagttagttatgagcagagacacatgtagacatgtcaaaatagtcatgcatttccatgtcaagccaaatagtcatgtatttccatgtcaagccaaaggcaaactaaaagaagcaaataaaactccatacaatggatttttactttatttttttgtttgttttatcccagaatcctgaagatttacattaggtgaaaatctagtgtacatatatatcttaggaaatggatattagagtacaatcattactagagaatctgttcttccagaaagtaccactaaattacacatttaaaaccagaacaaaggcaatgaaggaacagtcatttttattagttgacttatttatttgataaacactttctggataccagtgtgccactctgctagttttagtaatacaatgacaagtaacacacagctcctgccttcaaaaatattgtgatgtaatgggggtgtcaggcccaatcaacagcatagaagtatagtgaaagaggcatgtacaggatattacaaatgattaaaaactctaccccttccaattattgttggattctaaggtaacattgattagctaaattaagtccacccacattaggagccacactgctttgtggaatgtatatatacattctgcctttgccctggggaagtcaatggctgtatttagaagtacaaagttttagcactttgaggtcatttatagcattgacaaagtagatgtgataaatacagaagttttcttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccattttagccgggatggtctcgatctcctgacctcgtgatccgcccgcctcggcctcccaaagtgctgggatagaagttttctaaaatgagctactgaacatccttcttcctgataagttctaacacaaaattgttcacttaaaggagcattacctgggcctttgaagaggtttggtcactggccaggattcatattagtaagtgaatgaaaagtactctactcaaaatgatttgccttcattttctgccctaaatggaaggaattgacaatgtttctgattgctgttgctgctggtggtgacaatagtggtggggatgatgggaagagatttctgtttttattttaatcaaccacagacttgttccccagaagccatgtgatcagcaaatttagaggtgagggttggtctatactggtttctgagaaagtcccctttgttgccttactagtccctctttgggacctttttaatttaagagtgaatcttgcagccaaccattctgtggaaatagaaatgatgctacaattaaaaatagaaacattgaaaagttaccgtgcttagagcctattacataaaagtctttacctaatattcctctcatcccttcacagaagtaaatgaaagactctgcctctcttttaattatgagggtgaagcttccttctgaccttgctatagtgaagggattcctttctccatgggagtccctcattccaggctaaagatgccatctgtgcagaaatatagtggttgtttgtcccaagtgggcattttgtagttccaaagacctttgagtatgtgacatttgttcaccaaagacctcttagcctttcccaggtgtgagctcttctgtttgtgtttttatgttttagtgctggatcagagaaaacatagaaactatagaataccctgagtgtagggcttatggctataatcccagtactttgggaggccgaggcagggaggactgcttgaggccaggagttcaagacctgcctgagcaacacagaaagcttcatctctacaaaaataaaaaataaaaaattagctgagcatggtgatgtgcgcctgatatcctagctacttgggaggctgaggcaggaggattgcttgagcctaggagttcaagactttgatgtgatgctgccactgcactccagcctgggttacagagcaagaccgtgtctcaaaaaaagaaaaaaaaaaaaagaacattctgaatgtgtgcaagagatatagctagtaggcctcgaattgaactccaaaggtgaggcttgtctatgctgggcataaaatggcatattaacagttaagctcaggtaaggtaagatctcatgattcctcccagctcattgctgcatttctacattttgataaaattttgaataaaaataagggcaacatggcacagaccagtgagatcatagcatagtagtgagggtgtggtcaagccagggtaagacagatggttaatggagcatcccatgccacaagagccagataaatcaaagactgagagaacgtacattacaccaccacggccagatacactgaaacagccttgtgagagcaaaaggaagaccctgcatggccctcagaagcgggtgtgagtagtgttcaagatgaggttgctgaggaacccatgagagtgagccagtagggcacaggccttcacacaccaggaagcgcagaaatctgttgtgcattgtaatgataatattgctcacatccttaagtccaaaatatttgtccaggagtatcatagctggaatgcttttctcaagctgactataaacactatggagagtgggttttactgagaaaaaactgccgaatgataccaatatttctcccacagctccagaaaaatgtgtccacaagcacagtcctatccttgaattggcaatataagcgaaggatcgttttaggttaggggatgtattgctgagttctctaacttgtcttttggacacttttgagtagtctgggttctgccatggggctttgctttgaaagttaagaacaaggtcaggcccctcacacagctgtcatatgcattcagtggtagtagtacatgttccttgaggttttagctgtgcaggcagccaacttccacaatgggcagatggcagaatcaggggactgacttttggaaatggatggtaggaatggaggccattatggaaatggtggcttttccacgaggatgcccaaaggtctggtgaatggttctagtgagctcgtgtgcttttcccctctgttctcattgcctttctgaattgttaaagattgaattgtgtccctctaaaattcatgttgagttcctaacctcagtactttggaatgcaaccttatttggaaatcagctcatttcgatgtaattaatgaagtttaggtgaggtcatcctggagtagggcaggccctgaatctgatgtgactggtattcttataaaaaggggaaatatggaaacaggcatgcacacagggagaacaccatgtgagcatgacggcagagatgggagtgatgcttctacaagccaaggaacacggaaggttgccagcaaaccaccagagaaaagatatggaacaggttctccctcacagcccatcctgccgacatcttgatttcagacttctggcccccaaaactgtgagacagtaatttctgttgtttaaatcatccagtgtatgatgctttgttatggcggccctagcagacaaatgcatggttatctgttacttggctgtctcttctagggcactctacattcattgaggtcagggactgtgtcctgatcatttccaaatcctcatcacatacagcagtcctggtacacttaggcctccccaaaatatttaccaaatacaaaaagtagatatgttgatttctgccaataaacatttagctatctctcaagtaggaaagcatatatactgttttcccaattctcaaactcatttcagtttagcaaccttgaccttgggttaggtttggggtgacttccctgtgtcttagtctatttgggctgctataaggaaatatcatagactagacggcttatcagcaacagatttatttctcatagttccctcaggtgggaagtccaagataaaggtacttacagattccttgtctgatgaggacaaggaatgatggcttcctagttcatagacagtggaagggaggaaggctctctctcgggcctcttttataaggacactaataccatttatgagagctctaccctcatgactaatcacttcccaaagctccatcttcaaataccctcacattgggtgtggagttgcaacatatgaaagttagagagacacacacattcaaaccatagcaccttgatcagttcttcgtctccctaagtcccatcaattaccctcattatactgtatttaaaaagttaagcctaacaactttcatagtatccacaggtaaatgaagtttttataacgtagcactgttttaggaaagccttcattaaaagaatgtgtataggcagtatcaagaatttgattaagattttcttgagaagaaaagaaattacttaattttcacacaaatgaaggatattttaatataaagatacctactcattgtgaagacatgtcctgaataaatatggaatataagtggacaatttatttagacagataaaagtctccaaaacatattaccatagatgcagacatctgtcttctagattgtagaagctagctgtataaaattatggtgatatacgagtgaactgagatatttttaaactataagtgaaaatgtaggtccttaaaagtaaactagaataaagcttccttcataactgcaagcaaaaaaaaaatatgccaactggctatatctggaaacctcagtatctatttacttgaattttaacctttgtgctaaaggtctgggaagcagagggaaaagaggctgactggaatgagatgacacaggacaggaaagaggggaagaattctaggtcagaggtggaagggacatattctgtaatagttttctgggccctcgagttataagtcatttctgaaagcttagagatcaactaaaatatccttccactgtgataaggtggaaacatttttaacttcatttatcttttgtgtgttccattttctgtggtttcttgtgtttcttctaacagagggaaaaaaagaattctttattaaattcctgatctagttaaatatatgacagacagcatgattttacataagactttctctggaaactgatttgcttgatttactgttgttttaagttggcttatatgttttgcttaaacgtttagacctgtcaaaatggccacccaaagctttgatgccagattgcatctctcaactgacagttaagtaaaacatagttttagaatataggcaaggtcttaccctatgtaacagaagcgactctgcagcacttttctctactgtttgtttactgcataagcacattgtaacgggtgtgatttagaagcactagactcaaatctgtttaaaaatcattccagatttactctactaaaaatactaagagaaaatttttctttaagatttcttacttgcaacatagcatttaagaaaaattactcaatgtaagacaatatcttgagaaacctaaaaccaagtgaaaagacttggaaaacatctcctgaccacgatggtcaaatgtttgtggtgtctatttgatagcacaacaagcgaaatagaatgccttaacttttccttttccctgatctaacctctgtttctaggaataaaaaacagaagggcagtttgcagctcagagatttctcacttaacaacttcagctgggatggggcccagaatctggctctggtgtataaaattacacttttaactgtatgtgaggatattaacacttgccttcgccagttttcaacagacacatatatgtgggatgcatgtaggtatttaactttctaagatgtttatagttagaaatgcctttaaaacccctggactatgggtgttttcctgtggaatgccattatcctgtttatttgtttatattcaaagcagtgcacacatcttacatgaattgactacagcttacagtgttctgtttatttgtatatttttattttcaaagcaaaccaggtatacggagaagtcttatatgaacagctcaatgagtttttaggaaacacatctgtgtaaccaccacccacatcaacatatcaaacatcaccaataccccagaagctactctatcccttccgtgtcattagccccttaaaggtaaccaccattctgacctctgtcactgtagattatagctgctcattcttcaattctacagatttccatagaaattcctatggtattctgtaggaatcatgcagcttacgttgctgtttttttttcccctagattcttttcttcagtgtgcgtctgtgaggttcattcttgtggttgtgtgttctttttcattactatacaggactgcatttgttctttttcattactatacaagattccattttgtatgttttaaaatttatactccattctattgctgatgcatttctgtgttgtttccaactttcagctatcaagaataatgcttctatgaacgtgcttatacatgtaacattggtacacagggatatgcatttctggcgaggaagagacttactgggttatagagtccacatatgttcagcttcgtggagactgccagttttccaaagtggttttaacaatttacattccctgcagcagtgtttaaaagttccagttatcctgtgtcctcaccaatgctttgtagtgtcaacgtttttttctgatttattattttttttaattttagctattctattggctatgcagtaatcttttgttgtgattttaatttggatttctctgatcactagtattgttaatcatttttatttccttacctgccatttgaaattggtctttttaatgacgtgtgtgttaaagtcctttgccgtttaaaaatactgggtagtctttcttttactctggcttgtagaaggcaagttttaaaaaaaatttgttcattttcagttatatacatgacaaatatattttctttctttatggcttatcttccctctttatgacatcttttgatcaactgaagttcttactttcaatgaagtttaacttattaatccattctattattgcattgttgttttttgtccttttcagaaatatttacccaatccaaggtcatgaagatattctcctctgctatcttctagaagctctgtcattttgcctttcgcatttctggtctgtctgggagtaatttttttgtataatgtgaggtaggaggcaaggatcattttttctcacatgggtatccattctttttcccagtggcagctttgccctatagcagttgaccgtttatgtgtgggtctgtgtctggactctgtgctgccccactggtctatttacctatccttgcactgataccataccattccgatgactataactgtaaattaaatcttgatatctggtaatataagttctccaactttgttcttcaatataattttttttattcttgagcttttgcatttccatgtaattttagaatcagcttgccaaatttcacacacaaagatttagattattaattgggataataatgaatcaatttaagtagaattgacatttttcaatattgtaccttccaggaacctagtagatgcctccatttcttaagtcttctttcaccttgtcagtaaagttttgggttttctttgtggaggactgcacatcgttcactggctttattcctagttatgtgtcctcttttcagtagagagctgcttccagtttgtataaaagcaaaatcttcctttacggtcacacccttaaacaaaacattatagaggaactattttgaagctgaagagaggaagtgcccttgaaccttgaggaggaggtgcggagttttttttggttgttggtttgaggtaggtgagatgcagtatgtcttgtccagatggaatctttggaatatccttaaaggcagcagatgtgtgtgggaagaatgacagagtatatcgagaagcagacttaatgcattgagtaatcgcatagttgaatgaataaaccaatgcatattttaagtatctgaagtacattcattgatgcaaagcaaatgaccattctaaacataggttatatcctggatttaccttcttaaatctttgatttaccatccccagttgccagagatgaagttataaattaaatgattaaaatattatcaaggtaattgatggtttagatttaccaccaattatatttcccattaaataagaaacattttgaaatttaataactcatgtgtgagtcagtgacagcatactgttttagagttaaagtctcttggagttcctgctggttactactctgtttttcttttctttcccaatcatgctttgggaaagaatattccttcttgctgacaccagtgtctcagctccaattcacttctcataccagcccctgactcctgacatccatcaaaactgttttcatccttaagacccaaagacctcataattgccagattcagtaaagaagttttcttcaagttctttcgacatttgagattattgaactattccttctccttaaaactcttcttttgcggctttcttgatatttattctcctttcctggtctccttcctacctctctgactctttctcaggctgtcttcattccacaaatgttgttattgcacatggcctgcttcagactcattgcttcttcattgtgaattctcaatctggtggaactcgttcactctgtggcttcctgacaatcagtcttctgacgtttttgaaagcttatcctgaaatatcctacactacaaacacgtatatccaactacctgttggacctctccatttgagtgccccagagacacttaaaacttaacatgtcagaacaggaaacatcttaacatgttctgcaccttggtgaatgccaccctttctcctgggccagcagcctggaagtggttattgactattctctcttttttgtttccccatgtctagtgaaaacatccaactcgtcttcctccttaatagccttaatatgtctgcagtcttgaccctcttctctatatctctctcttttttctgttcccaaatagccttacacctggctttttaaaacaggctcctaactggtctctctgcccattcaatatggtcatcctccaatctcatatctgctttcaagatgatctttccaaaatgtactacttctctatttaaaactctacagtggttctatttttccttcagcacaaaagccaagaccttcaatatggctttacaaacctagccataagggagctccttctgcttctctagtctcctcttgacactaccccttttcacctgcctgacctgttatccagagcccctgcagttccttccatcactctgtgccttcccttcataaatactctgcttctgcccagaacagtcacatctctatccacaacttcttctgtgggtggtttcttactcattctccaaaacttaccttggttatgtcatgctctagggggaaccttttctcattcccctgcacacaccagtctggaatatattatattgcattatatgtgtttctttatctcactctgaacttttcaaaggcgaaaaacacattttttcacgtttgtatcctccctctgcaggtacttttagaaataggcactatgttaggctctagagatgcaaagatgaataagacattatccctgcctatgaggctctcatagtatagaaagtaaaacagaaacatcaaaagatagttaccgtgcagtttgacaagtaccagatgacaggtatttttaaaacatggaagatagagcacctgattctgggtctgagtgagttctatttaagtgtatacaaggattgtttgagaaatatggacggacaaataatcctcagagtaaatatcctctccaggaaaactcctggcaaccccatcacccatttcaccagttgatctccagagactgtgcatttttgatcctcacatgtagagaactgcatgggagataaaatattaacaaataggacccaaacatgtaaataaacatgatatggcttggtgggagaggtaaacgtattaagccatattttaggacttagttgagacttgaaaaaataagcatcttattttgtgtgctcaggagctgtctgacaaaatcctaagcctgactgagatcatagtccaccctgactttgtctaaaaatgttgctgactgggcatggtggctcacgtctgagatcctagcactttgggagactgaggtgggaagatggcttgagcctaggaggttgaggctgcagtgagctgggatcacgccactactgcactccagcctgggcgaaagagcaagaccctgaaagaccctgtctcaaaaaagaaaaaaaaaaagagaaaaaaggcgtttgcctttatggtaataagaacagcctaaagccttgaaagattcattctactttttcagatacaatgttaaaaaattattaaagatttctggcggggcgtgggggctcacacctgaaatcctggcactttgggaggctgaggtgggcggatcacgaggtcaggagttcgagaccagcctggccaacatagtgaaaccccatctctactaaaaatacaaaaattagccgggcatggtggcatgcgcctgtagtcccagctacttggtaggctgaggcaggtgaatcgcttgaactcaggaggcggaggttgtggtcagccgagatcacgccactgcactccagcctaggcaacagagagagactccatctcaaaaaaaaaaaacaaaaaaaaagttacagatttcttttttccaaagcagattcataagctgtcccttacgctatgaaacttactggaacgacttttaggtttggtgagttttcttaggacagacaaacactgtaaatgttttcttaacctagtccatgtttatcttatgtaaatgttttcttttttttttgagacggagtctccctccgtcacccaggctagagtgcagtggcgtgatctcggctcactgcaagctctgcctcccgggttcatggcattctcctgcctcagcttccggagtagctgggactacaggcacccaccaccacgcccggctaactttttgtatttttagtagagatggggtttcaccgtgttaggcaggatggtcttgatcttctgacctcgtgatccgcctgcctcgacctcccaaagtgctaggattacaggtgtgagccaccgcgcctggccggaaatgttttcttaacctgttaaacaaacagaatttcaaacctaacaaataacccaaatacataggtaactgctttcatttcatggccctgaatggctggaaagttagtagaaaagtatatcttcaagctgagctttcaaaacacatatctgttttcaaaaatcttgtacaggtgaaatatgtaatgcttggttttgttttggttttgtttttctcctaaaaaaccagtgtgactagtttaaaacaatgctaaataattcctaagggaaaatgctgcgagaacctttcacctaatgagtttactgccttagcttgctgttttagttacatgttttcaagaagttctcagacgtatgaatggaagaacatctctgattccactttaaaatagatgggaaaaaaatgcaccaaggtggaagtggttggcaggcaaagaagaagaatatgaacaatatgagggcagcactatttttattttattaaggattagacatagtgcattacaattggaataaaacgttcaggttgtaagtatgtatttttccacttgaataagtcagttaaacttagaaactattcaatgggtgtcagcttgcaggttctggatcaatagaacatagtatcatggcatactgtctaccattatagtatcatgattgtcagttatttggagtattctggctaaatgctttatttctaaatcattatttcttcttatgtgttttaataaatttgaggttatgttatatgtaatatgcttttctgtgcctctacttcttcatttgtgagatagagatagctggagtcctggctcgtggagttgttacgaagagtagatgagaggggtgactaaagtgcccagcacagagcctggtgcccagtcagcatccaagtagggtttgttgttgccttacttgttttttatactttattatacatcgtgagcattttctcaagttgctaaccattattcaaaaccatgatgtctcatggatatgtaacaacccacttttctcttaagatttaaataatgtcattttggtcagttttgcaatttccagattggcaataacataaattccactgaactaaacattcttatgcagaagtctttgtgaccaagtaagatacatttctaaaatagaatgattggtcaaaatgtatacatattttaaaggctttcattttcattcatatgtccaaattccatccctgaaagattgtagccatttgaaagtacccctttctcttgccatgtttaaagaagaactaaggaaatgtaaaagcatgtggcaaaaataatagaaggctggaagttttagagccagaatatttgcatttatttattacttataccatggtatttatttataccagggagggaagataaataaattcctataatttctcatatttaaaaggagcttttgtgtgataaagtaaaagcactgcattgactttaagcagcctgtttcttatattgactgatacaggattaaacaccagcttgaggaagtcactctacctctcatagttacagactcacaatttgcaaaacggtgatatcatacgtatactataggacttttgtggcagttaaataatattctgcatgagaagcaccaagcaaaggtcttggcacatagtaagcacctgtagttgatcacaggcttattgaccatgagtatcatttttgctgcagagccagccttcagctttcctcgctttattgcatctgtagattcataaagtagtagagttcccgacaggtgtactggctgtgtcctgaatgaggagagggcagaaatccatgacatttttcagctgtaatgtcaacacacttgatggtcctggttagcattaacatgacatagttttatgacttgacttagtgcacatctagcccctgctttgtgtcagacactgaatcaagagttggtgatacaggaatgaataaaaggtaatctttgtcctcgaagggctcataatctagacaggaagtgtttaccatcttttctgggtgaaattcttcttctgtttatacttattgaacattcatttgtgctgttcccgtaagacatgcactggtaggtatttggaggtgaaagtaagtaatgataaagccagactgtgcccctaagatgtttagaatgtggtgggtagttcagttaattggcatgctgtggtaggaaaataatgggctttcagtcagaagaccttagttcatattcaggcctcaaaacatacttgtggaatgatgggttgggcagggaaggcccttgtgttctaagcaagaaaatgaaaagagttaaaatccagttattcattcatccatttggcaagtatttattgagtacctgggattcagcagggaataaaatatacaaaaatccctgccctcatggagcatagattcagtgggggtgacgaaggatgtaaaaactgctgccatgaaatttttaaaaggcagtgaaggaagctatggagaattggggaggagaggtggcatgtttacagagagtggcaggagaggcctattttgccaaatccctttttaagccaatggggatggcaccaggttcaagaggcagaagagacccagagccagcacacgagatggggttttattggggaactttcatactggggagagagtctagtagtggtgggatggacaggagaaccaccttacatacagtccaggggcggcaagtgggctggacaggaaaaccacaatggcttgtgaaaggcatccagtttatatagcattttcacttaacaccctctccataatgacctccacctggcaaccttcatgcaatcccaaatcggggccttgattccatgggcagcctgtgttgcataggacagtatgggggctcagatgttcctcatcgacaaggaacgaatctctgtttcgccattcccggattccctagctcagaacacacattcagtgtgtctgccgtacagggtctttctcagggtgtgcttaagttattgctgtcaggtgcctttaacatacagggcctcattacaaactaacatttgaatgaagagctggaggaagtgagggtgcagttcaaagagacagccccaaacccaggagaccagtggcactggagcagagcgtgtatggggtgcagttagggggaagtggcagtggcaggaggcagggaagggcctgtgggacatgttgataaggactttggcttttactgggcataagataggaagcctttgaaggagtgtgaacagagtgatggaaggatgttcccacaacccagggagatgtggaccaatgagatagcagtagatgtggtgcacagggtcagattatggaggttatttttaaagatagagccaacaggatttgctaaagaatggcattagcagggtttagagctgagttactatgaagcctgagtggccatccattgagatgaggatgacggtggaagaagcagattgtcggggagagctcaaggagttcagatttgcaccagttaagtttgagatgcctgtctgactttcaaatgcagaagtctggctaactggagttcaagggagaggtcctggctgaggacgaaaataccaggatcattaacatagaggcagtatctaaagtcaagagtcgatcagatctctaaggtagtgattgcagctgcaaaagagaagagctccaacgactgagcattgtggtaaactatcatgtagatagtagttataactattatgcacttctgggaaaatgtggtacctcatgaggtaccttcactctgttcactgtggccgcctccaaaaacattgtgtttgtttactaaatgctgtcttcatgacatgaaaaattgaaggttttttcctatcagggattggattgattcaggcacaaagataatttgggcaccactggagttgggcataggcagttctgtgcaggatgcttcacaatagtatttcaacagatatagtgatctcggcttctgattttgttacataaaaacacattgattcagaaaaggacaaaagcaatgtaggtccacaaagattaaaacatcactaggccgggtgcagtggctcacgcccggtgagcacatcatgcccggtgagcacatcatgcccggtgatgtaatcccagcactttgggaggccaaggcagtcagatcatgaggtcaggagatcgagagcatcctggccaacatggtgaaaccctgtctctaccaaaatacaaaaaattagccgagtctggtggcaggtgcctgtagtcccagctactcgagaggctgaggcaggggtattgcttgaacccaggaggcagaggttgcagtgagctgagatcgtgccactgcactccagcctggcaacagagcgagactccgtctcaaaaaaaaaaaaaaaatcactaaaatggatgtgtacattatgtacagcatgctttcaacattaaggtaaaaaaaaataccgaaagattggacttaagacgggccagtttttctaggttaaagatgcctttcagaaaaatgtttgttcagccatgctttagcaatcacttatgtgtagagaacttttccacgtctcctgtatttattcaatcaacaggaattagcttagcagcataacccaaagacttatcatttatgttgccttatgactgatagtgctaataagtaactaagtcctatgatcctattaagaattttacaacaaagaggggcttgagtgacctaaataaaaatcagtgccaaaaaattcctatatggaacttctggagagtgtcccaaagaaagaattttctttttttttttttttgtctttttgagacagggtcttattctgtcacccaggctggagtacagtggtatgatcatggctcactgcaacctcgacctcctgggctcaattgatcctcctgcttcaggctcctgagtagctggtactacaagtgtgcaccattgcatccaactagtttttctattttttgtagagacagaatttcatcatgttgcccaggctggtctcgaacttctaggcccaagggatccaccctccttggcctcccaaagagcaaaagaattttcaaagtacatagcgtgcttatcacctgctgacaaatttctcagatcatgtctgggagcacgctggctatgtggggattgtagatttttgcctataaatgctcaatttaagtatcaaacactccataaaccttgcggtgcatctctttagagatttttaaaggctctacaattcaaaagtattgtaataattttcaaagtatgccacattctcaagaggtgtccatctatggggtgatacttgggtagggggaataaagtccacttctgaattgtgggtaataaacacaagtccaaaagtgcacaggcaggcagcttgtacttaccttaacagatgcatactttggaagtgaacagcattgaagcattagggctttctacactccagtggcagcgtgggccttacaaaactgtagggccttcacctaagacaaagataacacttttgtgtttgcagtaactcatggacactttggacttagtttctaaggggcttatcccttctccactcagtgtttctggacttcttcctggagtaaggaccttgggaagaagccttcgttcctgtctgtaacccctatttagtgcactgattggggtgcttagcacaatcacacataacaaaggaaaataatgccactaaaaagaaagattgttctgactcaatatttgagaaaatttcattcaagatattttgaagtcacagaagagaagttggactttgtatatttaccaaaacaatttgtcctgggctcagtgttggtaatattaatatgtccttttttatttttatttttgagatggagtttcgctcttgttgcccaggttggagtgcaatggcatgatcttggctcaccacaacctctgcctcctgggttcaagcaattctcctgcctcagcctcccgagtagctgggattgcaggcatgtgccagcaatgcctggctaattttttttgtatttttagcagagatggggtctctccatattggtcaggctgatctcgaactcccgatctcaggtgatctgcctgccttggcctcccaaagtgctgggattacaggtgtgagccaccacacccagcccaatatttccttttttaaaataactgaggcagatgttgtgggtattacatataaacttcctcatagacaatctgtaagttggcagaatttgatgaacacctttggataatgtattagtccattctcacgctgctaataaagacatacctgagactgggtaatttataaagaaaaagaggtttaatggactcacagattcacatggctggggaggcctcacattcatgatggaaggtgaaggaggagcaaaggcatgtcttacatagaggcagggaagagagtgtgtgcaggggaactcccctttataaaaccatccgatctcatgagacttattcactatcacgagaacagcatgggaaaacctgcctccatgattcaattacgttccaccaggtccctgtcataacacgcggggattatgggaactaaaattcaagatgaggtttgggtggggacacacagccaaaccatattagataatattttcagttcagctctgggattcactgtcaattatggcagaaaagatggatagagttgtgttgggagcaggccctccataaactggccccaaaactggccataaacaaaatctctgcagcactgtgacatgttcgtgatggccgtgatgcccatgctggaaggttgtgggtttactggaatgagggcaaggaacacctggcccacccagggcggaaaaccgcttaaaggcattcttaatccacaaacaatagcatgagcaatctgtgccttaaggacatgctcctgctgcagataactagcccaacccatccttttatttcggcccatccctttgtttcccataaggaatacttttagttaatctataattgattaaaacaatgcttatcactggcttgctgtcaataaatacatgggtaaatctctgtttgaggctctctgctttgaaggctgtgagacccctgatttcccattccacacctctgtatttctgtgtgtgtgtctttaattcctctagcgctgctgggttagggtcttcccgaccaagctggtctcagcagagttgctcttgtttgcccagtatgtcttcaagtatgtgatttcttccagcatttaccagtttgaatcatcatctctcaggtgctgctctctgatcaagttgaacatatcatgtaatatacatatatttttcaaagtgcctgagcataccacaactttacattacataatccttttttcccaaagatcatttatcttcctttcccttacttcccttcctcctttccttccatctatcctttcttgtttatctacagacagaattgccacaaagatgtcactgttagctatttggagaagctattaaaaccatttgctaggagcaattccagtgtgtgtctggttagcaaccagggctttctctgacaactggtagaagggtccagttgtgcatgtcttaaccattcataaaccataggtattttattttcactagtaaaactgtgtgataattatttcaaataatgttattgttaatgactgatttttaaaacacttctcaggaaaatattacttggattcacttagaaatttataaacatcttttcactaaatgtaatatatcataccaagttttatgtcaacttgtttttcctcgctatctttaaaagttagtataaatttagtaagcttcctaatgtaaaatttaatatacttcctgatttctaacaaagcacagtttagttttgtttatggtattctggtgaaaaaattattgatagttttaaaattagtgtaccttataaagcagcataaattatgtattttctttgttctgagttcttagagctcttagtgctatttcttcctgattttagatttgtaaattttgtttgactttttgatgtgtgggcattgaattagtttctcttaggagaagtttccagatgagtactgcttttagaaaaagaaacatatatttttattaatacctgttggaacttctctggaaggttttggatttgttttctttcttctgtctactacaaaagtgatgagactagccttatcctttcatggagtgctttcatcaaaaaaatgtttgttgttctgtccatgtacaactttgactattgatggttctatttattagaatttaaacatatactttgtatgtttgtaagaatagaaaggtaaaaaaaaatcaaaaggatatgcatcactttaatgtaactcaacagaaaaaatgccattgtttatatttctgttgatgcaagatactccattactattcactgttttataaacatacagtttatattaataattgtgtacatagttgatagatttataaaatctctaatttttagaacatatgtttctttctattcgattctaatttctcttaactattttcttgccctacaatttacagtaacataatgggtacatgagattagttcttcatagtgtttttttatctcctcaaatccactgagttttatctcatccacctgggagcttactaccatggccacccctggatttcactgtcattgagaacagcttgacctttaaaaccccctactggcaccacagattcccatcttttagtttgttccctcccaccatacctgtgatctacccaagcacccttgttttctctccctcctgactccatgtttttctttaatcattctaagccctatgatctatctctaattattcatctcctgataccctcagtgccccagtgtcttgttgagcttccttacaaaccctcagacccattaattcccattggcatgtcctataactatggcactgggcactgttgaaaaaacaatcctgtaacaggtggaaatatactattatggcatccttccttatggggccctccgcatttcctggctgtccttctaccagtcccaagtcaggtcccctcccactccactcagctgccttcactgctatattaattctgtaattggtaaatatgcattaatactacatcccagatgtgtgctaagctctagggatatgatgttgaaataaaaactctacccacatagtctgcaagagagtcagacacttataaagtagcaacactaatgatgatttcattacacttgaatcaagcagtgaaaaacaaaatgttgcctgagaatagattgagatagagtcaggcagactctaacttggctatgtgcaggcttttcttactattattgccttacttttccttattgtttactatatgtggattcctgggttaatattgttgtttctttcatttcttttcaaaatttatttaaatgacattatactttttcagtcatttatatcttgcttttatttttcaacattatgcccgtgcagttcatccatgttgatacatgttactttaggcagtttgttttccctgctgtatatatattttttaatatttctatttatttatctatggttgagtctgtacatatttgggctactttctattttttgttattctttatagaattctgatatgagcaggaaagatgtgataaagattggttaattttcaatatacagtttaaagttaccttcagccattcactgtagccttctttatctaacataagcatcacacattactaataaattagcccactttgaatgttctaccatatttaaaacaataagataatgtcttcataggttttcctgatctactttctttggaagaggattgaaaataattaaatgtccaaagtcagaaagacagaactcagactgccagtctgaataatttaaaagcaaatgttttaaaatgattcttctgcagttcataagaagaactgaaatagtgtcagcaatgctactaaaaatcaacaaagtcatggtgaattacatgctatcatatataacatctttcagttccaaatcacccttcaacaccttctgttccttagcagactggattttatgagcatttctccttcacagaaaggccgatgttgagctttctcagtaaagagcgctgaagggccattgcaggaggaagggcctctcttactgttttcagctgctgccccactcatcagtggtgtaggtgtaaggacatccagtgttgctctgccccagccacaggcaagggaatgtgcagtccctcagtgacttcacagccccagcctgttccggtgaccactttcctgcagccctcccaacgaggacactacatgctccaggtctcctgcccacggtggaccgtgaactccttctgtgcacctgctcatcggtggtggctcacttgcccctgggaaggctgcttcctgcttgcccagctgctgtggctcttccagcaggctgcaaacacaccttttccagtgaggtcttgtattagtctgttctcacactgctatgaagaaatacccgagggtaatttacaaaggatagaggtttaattgactcacagttccatgttgctggggaggtctcaggaaacttacaatcatggtggaaggcaaaggagaagcaggtaccttctttacagggtggcaggacaggagtgggtgcaagtgggggaatgccagatgcttataaaaccatcagatctcatgagactcactcactatcacaagaacagcatgtagaaaccacccccatgatccaattacctccacctggtcctgcccttgacatatggggattatggggattacaattcaaggtgagattttgggtggggacacagccaaaccatatcaggtctgaagcccatctttggggaggacgtccttttccaagttttgtttttttggggtactcttcctgagctccagggtaccttttatactttatatttcatttaggtttcagagttatctagctctttaatgatatttttagcagttaaattatcttctgttgaagaaaattgttaccatgaataaaaatttagtgggacaaaatattttacaaagttagaaaatttactgcacttcagaacatgatcaaagatgcaacatcttttttcccccagtaattgcttatcactattattgtgcttaaatctaaatgtcatatacttagcaaaaggagatactgctaagttagaggttaggcacttaaaagcatattcacctttgtagcagagtgcatactggtttcatagtgtgcctttctgcattagtagtttactaagtgctttgtacatagcaatcaataattatttgttaaaaaaatcaatggtatatttaattcagtgttcaaaaagttcatgctaatattaactatgtaaaaatctttaagcttgtaagatttttgagtagctcatagagtcagcatctgctccacccgggtagctgaggaagctcagtcagaacaccctgggggggaattttctatcataatttgcagattagaatggagtctctggggaggtccctgctgtgtgtttatccagcaattgagggaacatggcgtgactgtacccattactgtgtgaagaatatccaaatgccttctttagacggttgttgttcttgctacttatatattaaaagcaattatgtgatattgtaatgaattatgttgacaagctttcattcccaaagctgcttatctatgtacattatttctgactggaaaacttatgttttttcctgcccgtttgaatgaattgcttgccactggtgacttatggcctgtttcatcgattttcagtaatgagatggagcagtatgaggtaaatatctatgcacaaaagcagggattctaaatcacattctgcaaaccacacatttgatggtgcagttagcccatctcctcaaaaatgtttgtggtgaagtttccttgaaaaagcttgggcttaaagcatgtcacttagatgacagatttagaaagaatttcggtcattacagtgagaagtcctctttggctcagtcaggctaacccgctccaagggtaggagaggataattcaccaggcggtgcatctaatggacatcgtctctggatgagggaggtagagagagcctgtggttcttttaaatgcattgatttctctacggagtagcattcaaatatgtaactgatcatggactccaggtaagtgatgatggactcccctggttgtagaattgctaccgggtgttcagatgtctcaggcaaggaaagcagtgaaaacagaggcaaaggaaacccttgtgggattcactcatctggtttcatactgagtcactgtctcacggggatgaagtaccgttggagttcactcttgataacagggagaaagaattatgcgctgttaaaaagaaagatgtctgtggaaagcgggggatcccttgaagatggtgttttatagaactgctattttatggctcttatatcctttccatgcattatttaacttcttttagtctttgctgaacatggatactgcctaggttggtttccagcaagaactgcattgaaagtttgatgaactgaaaacaaaataactttttatgctataaagtacctcatgatatgtgactgtaggtgaaatacaggaaggtctcaagctcacaccatttctctgaatgtgctactttcatttctgcatatgacaaactactctctcttttatgtgtatataactatgtatgttttatatgtacatatcatatatatcatatatatctagatagatatatatagtccctacttgtgctcccctactcgggactatagtacctatatagttggtactatatattcggtactatatagatactatagtcccaagtaggggagaagaagtagggagatctacagagtaatatctatctatctagacatatgtgacttttatagagagattttatatgtagatagactattcctctctggattacatataaatttattaaatgtcacataatactttatgttctctagttagaaaagagaccaggtcgatttttcatttcttccttatcatttcccctttaattaatggttttatcctcatatggggactcttccaggcctttctttatgacaccaataaatctcactgcctctttcccatttgttctctccacagttttccttcattccatgatccatgtcattccagtttccattgctgcccttctcagcattccgtcttcttgtttcttctgtctgctgtgcctaaaattaacttgaaaacatgaaccatcttcaagacaaatctatggtgttctttacattaattttataaaagtacaccataatcaaaatgtggaacaccttgactaccagtcactggggatatggccaaaggtcaagacaaatatactctggccttttaaaattcatacaaataatgattccatttttatttaaaatgctgcttttcttatttgattaattcttgtgttttgcctgagtttagtcaattatgtagaaatgtacaaattagcaactaattaaggacataacttgatattgttttttggtgctgacctttcttgttttttttttgagacagagtcttgctgtatcatcaaggctggagtgcagtggtacaatcttggctcactacagccttcacctcccatgttcaagtgattcttatgcctcagcctcccaagtagctgagattacaggcatgcaccaccacgcccagctaccttttgtatttttagtagagatggagttttaccatgttggccaggctggtctggaactcctgacctcaagtgatccacctgccttggcctccaaaaatgctgggattacaggcatgagccaccacatccagccataattaaatttagttgaggatattgaagatgatgtaatgggatgaaataaaagcaattctggataaattatatatgttttaggaataaatggtagaagtctaatgaatttgtcctatattacaaacaggagtgtaatagtttagtgcattccagagaagaaaaataatagactattacattaatttaatcaaaaccaattgtgcatttcaaaaaagataaagacatgaatggaatttgagtatacttccatacttgcgaaaatgaatttaaaatctaacatgactcagtaaatcagctatgatttcctgacagggagagttggggaggtgtagaaaaaagatggagaaggaattaaacagtagagaagattttagagaaatgaatactgagtgactccaaagtaatcctgggatttttgttgttgttgttctgatctattcctatttatatttcttggagagacatgatacatttgaccacttcatttcagcatgcaacgtaaaataataagagcaactagcctgctaagaacccaaagccagatggtgtatatgtgtgtcatgctgagttgatggtttggaagtgccagctctgcagaatggctggagtcgaataatacttcaaggtaatcctgcttaagatccacttgtgcatctccatataacttttacatttttaacagttaagttaatgaattttaagttgcagtggtcagcaggattcatgtaggcaacagaaaaacacacataaaatgtctgtaatgggatttgttaactgtcagttcaaatcaaactcttataaactgacagaaacctcaagtgttttaatagtattggcaaactgcttcttaaataagcaaatagccaaaagtgagtttatgcttctttcctgagaaggatagactgtttcatcatttttagagattatcttttgaggactaaccagtgtgagttaaagaaatagtagcataacccaaacatgtcctctttgtctccttgtgtttagaaaataggaaaaaatggctgggcgcggtggctcatgcctgtaatcccagcattttgggaggccgaggcaggcagatcacgaggtcaagagattgagaccatcctggctgacatggtgaaaccccatttctactaaaaatacaaaaaattaggcgggtgtgggggcaggcacctgtagtcccagctatttgggaggccgaggcaggcgaatggcatgaacctgggaggcggagcttgcagtgagccgagatcgcaccactgcactccagcctgggcaacatagtgagactccgtctcaaaaaaaataaaaaaagaaaaaagaaaataggaaaaaatcattttgtagtacctcctttccctgacctccacgtacactctttggggaagtcttcttagcagttcaggtgaggtgggggctgtactatagtcccaagtaggggagaaccagtagggaggtctacaaagagtgacaggtaatagtgaggggactgctgtgttagatgacaccattgggtaagaagatgaatcaactgtagaaaagtataagacttcatttgtacatactgttaattatataaatctgagaaagtgttgcttagactattacatttagatttgcagaaattattttgttttttcgctctcctagaattcgagattctgtttttccctttttttcatgttaagcttccttcctattcctatttcttttcttttaagtctttataaaagcaactgtttcacaagaattagtaaattacttatttatacaaaaaattgttgagtaatttagttaaattagtttctttttcctctattttgaaggtctgatattaggtacatctatatttaagatcattatttcttcctgattaattgattttttatcattatgaaatgttcctctatttttggtaatattccttatgtaaatagacactttttttttttttttttggacgatgtctcccttggtcaccaggctggagtgcagtggcatgatcctggctcactgcgacctctgcctcctgggttcaagtgattctcctgcctcagcctcctgagtagctgggaccacaggtgtgcaccaccatgcccagctaatttttgcacttttaatagagatgggggttcaccatgttggccaggatagtcttgatctcttgacctcgtgatccacccatctcagtctcccaaagtgctgggattataggtgtgagccaccgcgccctgctgatagatactttaaaaaaaattaaagttatctttttattgagatgctggctatcctgaagtttgtgaagtaggaaaatctaaggtctcacaaagaaaaatatatctctacagtgttgctgactatgaaggctcaaaagagaaaaaagtgttccctactgtatgcttagcttgctctggaaacctatttaataaaaagaacttttggggccaggtgtggtggctcacacctgcaatcccagcactttgggaggctgaggcgggtagatcacgaggtcaggagttcgaaacctgccagtctggtcaacgtggtgagaccccatctctactaaaaatacaaaaattagctgggtgtggtggtgcgtgcctgtaatcctagctactggggaggctgagacaggagaatcgatttaacccagggggcagaagttgcagtgaactgagatctcacaactgcactccagcttgggagacagagcaagactctgtctcaagaaaaataaaagaagttttaaattcaggggtacatgtgcaaatttgttacacaggtaaatgtgcatcattggggtttgttgtacagattgtttcatcacccaggtattagcttggtacccattagttattattcctaatcctctccctcttcccacctccacccctcaatagaccccactgtgtgttgttcccctctctgtgtccatgtgttctcatcatttagctgtctcagttataagtgagaacatgctggaaacctactttaatgttagtgtagttacttcagccttcttatggttagcatttgcattcatttacttttaaccaacgttacatttatacttacatgcttttttttgttttggtttggtttttaaaatccagtctgataatccctgcctttgcattggagagcttaaaccatttatatttagtgtaattacagacattgttgggttaagtctgatatcctattttagttttctttttgttccatttattctttcttcctttcccccaatttttgactttcctgaattaatttaatattgctaatatttcattttatttccactattggcttactagctatgggagacaaaattttttaaatggcccccagagatgtttcacactaatgtcaggaacctgtgaatatgatgagatataattcctttcattgtgttatgatatatggccttaagaaatgaacactatccaggtgggcttgattatatcacatgagtcttaaaggcagagagctttttcaagccaatgagagatgaggaaagcagaaaggaaagtcagagatctgaagcataagaaggattcaacattctcttgctggctttgaagatggaagggaccatgtacaaggactggagaacagacacaaggagccgagagtgaccctagccaacagccaataaagaaacacgaatcttagtctcacaatgtcaagggactggattctaccaacctgaatgagcttggaagtagatcttttcttttggcctccacgtaagggcctagcttggccaacacattaattttggtgttgtggtaccctaaccataaaacctagagtaaccttcctgggcacctgacctacaagctgaggagtaatatattggtggtgttttagctgctaagtttgtggtaacttgttatgcagcaatggacaactaatacattagctgatcccctctattcttttgatggttgctctgtggtttacaatatgcatatttaacttatcacagtctgctgtcaactaatattatacaactttatgtgtaatgtaagaaccttacaactatataccttccattctttcttgtccttggtgctgttgttattataaattttacttctaaatattcttaaaacctcacaaaatagttatatttttgctgtagttaattatcgttaataaatgtagaaattagaaaagtaaaaatcttttatatttattttcatatctatattatccacatctatttttcagcaattgtcattgatctgtatagatttccatatgtgatatcatttcttcattcctctaatatatcctttagtgaaagtctaatgatatttaattctctcagtttctgtttatctgaaaaagtctttcacctttgagagttttttctccattataagacttaaaagatattgtttcattgtttcttggcttggatcgttttacacaagaaatatgtgttaattctttttgttctgtatggtgatatgttttttttccctccagtggctttaaaatttccatctttgtcaaaattttatgaaatttgattacactggggattgatacggttttctttgtgtgtactccactgttgagcttcttggatctgtgggtttatagttttcagaaaacttcgaaaaacttcagccattatttcttcagtttttttttttctacctgacctttgggtctccaatacacatatattagactgcttgatattttctcacagttcacttagattgttaatatttaaagtctttcttctttcagtgattaattttggaaagtttcttttcatgtattcatgttttctatgtattcaatttttaatcttttcttttttggtgtctaatctgctattatttccatacagtgactttttgatttcagattttttttaacttttgaatattaactttgattctttttaatgtcttatttctctcgctatttttatgtcttcctttaactttttgaactgatttaatttagttatttaatgcacttgtctaccaattccaatatttctgttatttctacatctgtttttattgaatggcttttattttggttaaggatatttttctactgcttgacatgttcagtaatttttattggatgatggacattgtgcgctatgttgttgaatgtctggaatttgttgtcttcctttaaataaagtagaattttgtttttaataggcatttaaactacttgtagatcagcttttttttgtttgtttgagggctatttttaagtattgtttgggtggatctatgttagcctttattccagggctatgttagtgccactatttaggcatgagacttcttgggtctctactgaatgcctgttgtagacaataaggcctcttctatgtgattagtcagaactggaatacatctctatcctgaatgagctttgagaattgtttagcctattgcttgtagtaggtagacttctaaaatgacccccaaagacattcacctttgtgtattcccctccaattgagtttgggcaggatgtgaatatgattattcttgtaactacattactttatgtgggaaaaaggaaaattttctaagatgggcttgatttcatctggtaagccctttaaaaagagatttatctgactgattgctgagtaaaaagtccattatctgaaaagcctggttcatatatttagtccaaatgtctagttgtttatggtgtgaaggcaaacctggtccagttactatatcatggagtttttaggtgaacagttgtagtgaattaacttgtccttggagggtatcgcaatagctttaaccagaactttctttcttggacttatcctccatcatgtttccttgctttccaggctgcataaaacaattaagtggtctccaggtatttacactttatcagtaccaaggcaatattctacttcctctgcctataaacaaaaatcccacagaaattttacatataatgcagtaactaggctttttgagcttaccaaaccctattttttagtcaatctttaaaactaagggatattgaattagaagggaaggatttgaaagaggctagccaactatatttcaaaagaataaaaaccactctctttaaacttttaagttatttgaaaatattttacaccagtgaaatatagagagaataatacaatcaatttcagtatgccaaataaccaacttaagaaataaaatattatttgtacagttgaagccctgtgcagataatatttcctccaatcttatccttctctctctagaggtaccttaatgcaatgttattaattcccatgcatttcttcatgtattacttcatatccctgcatccttaaatttatctttgcatttttttttgaaattgattttaattgtcagaattctttcctggtttcctttttttttttttttttggtttaacattttgttgtgaaaataaaatgtttatattggtttagatttccattgtatgaatataacaccattatttatccagtcaactattaagaaacatagttatttcaacttttttgaagcaatgaacactcaaattaacctttggtagatatgactagtacacatatatgagagtttctgcaggaaatgccctttataattatatcacgaaataaatagagtatatgcatctttaagttactatagatggtccacaactcagaatttttgacttattatatttcgactttatgctggtgtgaaagtgatcgcattcaatagaaaccatactttgagtactcatgaagccattctgtttttcatgttcagcacaatatttaataagttacatgatattttcaacattttatcataaaacaggctttgtgttagatgatttctcccaactgcaggctaatgtgtgtgttctgagcacattttagataggctaagctaagctatgctattctataggtcgggtgtattaaatgcatttccaacttaagatattttcagtttactatgagtttatagggacgtagctgcatcataagttgaggagcatctgtagatattgtcagttgtttttcaaagcggttgtccagatttgcattcctaccataagctttctggttgttctacatctttgtaacacttggtattgtaagaattaaattgtaaataattacactggtgagaaatgctacctcattgtggtcttagtttgcatttccctggttgttagttacctttttatgtttactagccagattagctagtaatgaagaataatgaagattattctcctctggtagggtcactccagtttaatcaaactccattagggccaacatagagattcaaacatctaaagtcctaggatatgaaaaatagaaagatatgaataggaatatatgaaaaatagaaaatagaacatttttctaagtatgaaattattccctgagtcatttaagttatttctagttatcaaaacatgactcttgccaacacttttattgtgtcgttctcaattgtggcagtcttagcttcttttactctggcttttctggctgcagaaagaatgacagtaaaccttaagtcactgaagctaaagacaggctacgttatgaggaaacagaacattactctgcctaagactgactaataatagtaagatttgatgaactccaaaaagcctaggttaacaatttctgtgttctagtgctatgctaagtgatggaactaaatactttttaggatccttcttcccttgtgaggaccctatccacagagctttcacagactctttctactgccaatgaggaaatttaccaaaaaaggtccttgctatcttttctaaagaggcaatgagtaaaattgtgtcttttacaaagatatcatctgtaaactattttcagtaggaaaaaagccagaaaaattttcctgaatctatccttggtgctaattgggtatgactttgtgtgcaggggatacattttctgccctttccataatttgaatgatcatctatctagctgcattacagtatgctgcctgcagtgttctcctttgcaatagtccaagtaaataaaacatagctgatctaaatgcttccattcataattgatttgaggaatgtataacctgtagtttttttgggggggcggttagagaaattgtatgggtatctctgtttatattactttggaaatattttatttcataaatactaaaaacctgagtagaaggtcatttagttcaagtttgacaacagaaacttgtttcatatcagccttaattattacattcagtcgatttttttatgactcaaggacccacttcctaccacttcctttgatagaaaaaatatctaaatgtaagagatgaaagcataggaaagtttttcacatttagactgaattgtcttgttattcagacagtcctcacccttttgttttcacttcttagatatttgttaaaactcactagttatattgactagtagaaaccatagatgtgatttagacatgacatagaagaaaccatgacaaaccatagacatgatgctttaaaataatggccctgctggtttgatcgttgatacttctttctgatgggccctatttagatgtgtgtgtgcatgcatgttttgcacttgtcccgaggtgagtgaaaatggaagtggtgttttaaagatgaactttctgtataaaagcaagttgtaaatgtctgttctctatttctaggagcagctctttaaaatatgcttctgatcctttcttattagatgtcatgttgtacaccagcagctcatttgctgttccacagcttgggtctccagatcttaatgactcataccggctgttgtccccctacaggttatccaggctgtcttttttggcatctgtgtgctgactgatctttccagtcttctgactcgaggaagtgggaaccaggagcaagagaggcagctcaagaagctcatctctctccgggactggatgttagctgtgttggcctttcctgttggggttgtgagtatgatggaggatgcatttagccacaaaagaaacttggctcttatttcagacttctaagagaaaaaaaaagagttcattataagaggtttctgtattattagtttgctggagctgtcagtaccacagatgcggtggcttaaacaacaaacatttattttctcgtagttctggaggctgaagtctgagatgcagttgtccacagggttcgtttcttctgaggcctctctccccttggcttgcagacagcgccttctgactgtgtcttcacacactcatccctctgtgcctgtctttgcctaaacttcctatttttataaggtatagcagtcatattagattagggccccctaatgacctcattcaaccatatataatcacctcttgagaaacccagtctccaaatacagtcacattgtgagattctgggggttagggcttccacatatgaattttgcagaggacacaattcagtctatcagtttcttaagcagcccaaacttgaaaggtagggtccttgggtcaaccaggcttttgaacttgggagaggagatcagtattagctcatacttcttcagttacccagctgtgccattagctactatcactgaagtaaatgcctcttaatgtttgggtctgttttgacttcattgattttcattgttttcagttagattctcttcataactcaacttccttcacaagtctgttaattttccattgtctgcacataaaccatgtttttttaaaggccctcagagaccctacagattttaacctctgtgtagccaggagaagagaactcatatatatcacaaactgtaaagatgagtaagaagttgttatttaattcaaattcagacctttcatttgccagctgatttcgggggaaaacagaagtctcagtgatgtggtctagcacatgcaccaagtccattgtaggaagaatcagaaagttgatcataagtccttccagtggattactcatatttgtcaggtttgtagctggtagaaggccctacatgcttgctttaagaccaattagtagacactcagatggtcactgaattgctttttctgtgtgccaaattatattttcttggatgaaataaatagcccttaaccctgagaaaaacacaatggccagagagcattataatttgttgacactcctcattccctcatccttgtcctctgaaaacttaaataaatgagtactcagattgaagctaaccagcaaatctctcagattccattgtttagcatagcagagtttaatgctttccatattacttaatatttccttctttggactttccatataaaattcaaatactttctatcagaatagtcatctaagagaaaatttccattagcataaagcacaaagatacatactttctgcataaaagaattatctagaaaatctcagtctctctgtgtgtacatgtatatgcatctatatctaatatctaatatatgcatgtatattatatatatcatgtatacattttttcttttttaacgtctactcccttggaatttctatagccatgtcattgcctgtggaagccttcgttggctagaaggattacaatagtaatacaataaaaaagtaggccaggcgcagtggctcacgcctgtaatcccagcactttgggaggccgaggcgggcagatcatgaggccaggagatcaagaccatcctggctaacacagtgaaaccccatctctactaaaaatacaaaaaatgagccgggcgtggtggtgggctcctttagtcccagctactcaggaggctgatgcaggagaatagcttgaacctgggaggtggaggttgcagtgagctgagatctcaccactgcattccagcctgggcaacagagcaagactctgtctcaaaaaaaaaaaaaaaaaaagtaaacatgagtatagtgttaacatgttttctcttagctcccttctgtatgtgatatcaaattatgtctctacagggaaaattttgacttatgttgtaaattttgctactctcctcaaaagctcatggcatatgccctttagacatttttgaccttcctttgggggaaacttttgcacctgcctgaagcttgaagtatatgtcaactcttggtgtctttcctaaagttatcccatgtatgtttcatggtttataaaacaagtggtggcctttttgtttagttatttgttttagtacatctgatattttcctccatctatcactgtctttgttgttttgcctatgttttagaaaaaagaggaataaaagtgcctttcatccccacccaccccatccctcttaaaccagaagtcccagcatcacactttcatggcgtgtgggtgcagctgtcctagtggctctctgacagcccagccagtcctcatcactgcgccagggcctcccgtgtcacccagcacatggaggggatcagtgctcttgagaatcacaaaagaaatcaaagaatagataaggaatcagagatgtgtaactcactgatgtttttaactcattttttttttgcccattgatattttgtagtcactatttccatctttcataatcatccctgttactgtgagtcactgttcccttcatagttactagtctattattttcctaaacttttaaatgttcctttcaaagaaagtgacatttctttctctcttttcccccctcctttctctctctcctctcctctgttttaagaagaatctaggtcagtattctctagaaatcatcatatgttttctactgtttctgtcttgctatgctatttgatgttttgtatctatttatgcaatttccaccagacttctcactctaatacacagaaattcattttgaggccaaaaaaagcctgataaattgttcattcccaaatcccattaattttattgcaaagtcatatttatacaatatatgaatgtgcctctttacaagtatttgtatttgtctgttctcagactgctaatgaagacatacccgagacttgagtaatttataaaggaaagaggtttaattgactcacagtttcacatggctgtggaggcctcacaatcatgggggaagccaaaggaggagcaaagtcacgtcttacatggtggcaagagagtgtgttcaggggaactcccctttataaagccatcagatcttgtgagacttattcactatcacgagaacagcatgggaaaaactcgcccccatgattcaattacctcccactgggtccctcccacgacacacagagattatgggagctacaattcaagatgagatttgcgtggggacacagccaaactatatcagtattttaacacaaaatttttttttcactaaaacatttaattttgtgatttttcgtctttctgtctctaatgttatttcccacctttcctttccaaggtgctctgtcttcaccgtggcttcagagcttcccctgtcctttctgtacctttttccctgttcccgcaactgctcaaaagggtctagaatcctgctgtagtttcattcttatgacttaggactttcttccttattaaaatgcaaactctccctggagcaatgccacaaggaatcacatgaagaagcatcatttttactttttctgtgcctcctggcctggaatggaagtgccaacctggacggttcattacatcagaaggatggaagagcattaatggccaggaactgatggaagcagaattatgcctgtaggaatctgtagcataaaaatgcttatcatgtgtgcagatgattagtgataacatttagaagtaaacatcttcatcactttggtggacacagtcaaaatcctaaggggcagaattcttaagcaccctctctgtgccaggggagtaccagacatcctatagctacaggcgcagagcctcagctttgagtcctcctgcagtccccagaggcctcccctgctctaccaccctgactgctggggcactgccaaccttgcagagtgcttccctggctattatctactgtctttctttgcctactgcctttctactttttgtcagtcagaagttgaaagggaaagcaaagttatttttgcttcatggtgcaggcaaatggcatcgggcataaaaagaaagtaaagagtgaatgcattacctctgtacagctggatttatcaactttgcacaagttttcctgaagagacctattggcccctgagcttttcctgatgctcccattatcagtctctttctttctctctcacctcagctgaaaccatggcagcaagaaagacatgggtggtttatctgggatttgtattttctacattaatgcttcctccagtaacgaggttaattgagagttgacagtaattgctgtatgtgagcatgaagccctaaatatgattttgtgacccatgcacctagtgcatccacttcatggtctctgttcatctcaaggatacataaaaatcatgaaacattccaatcaaagataattggaggaaagttttatttcagcataacctagaagaaatcaggcagggttgcttggatgaacatggcatgtatcatcctgatttgtgtagattcccataaatacgaagctggccttgattagtaatgctaatggccggaaaccaccaccactcccaaagccttgcaactaattttgcagggataacccatgggaggctcttcttaccatgtgcagtttatttctgaaccctgtcacccttttaaagaagcattacaaataattctatgacattatgtggtctggaagcactgaagtttattagcagcaatcagaccaagaatgtcttttgtctcctgtgagtttgttgacttttgtgttggcagataccattatggctaagagactaggcttaggcttttaaccaaaaaggggaggggaggcatgagagaagagcagaaacagcaaataaataaataaataaaatatatatatatatgagtttaatgactatgaaagtgcccctctcaggaatcttaaatgtgtctccaactgcctaccaaagcagccgtttaatgaaaaagaacaattatttatatattttatacattttaaactttctgtctttgttttatagaggcagggtttcgccctgttgcccaggctggaatgtagtgcaatgatatttcactgcagcctaaaccccctgggtttaggggtcctctcacctcagtctcccaagtagctaggactacaggcatgcaccactatgccctgctaagttaaaaaaattattttggagacaggggtcccactaaatttcccaggctggtcttgaactcctggcctcaaatgattctcctgcctcagcctcctgagtatccagattacagggacaagctaccatacccagctaattatacattttttattcattctagattgtgcatcctattcatttgtagctgcttaacttgaataatgcatgtaatctaacctcataacctcaccagtacacttttgccctggtgttggtttggttgctctagccccagtgctggtctgctgcatcgcggtatgaagatgatagccctttctgagtgggcctgaggagatcttggaggttttgatcagttctaacctgggatgggtgtccaggttattaggagcaaactggcatgtgcctgtattaacttttcggaaatttgaccttcttatctgagtttagactcaaagctgtttgttaagtaactatttttagtgttataatcatgtcttgtaaagacttagtgaagattttataggtatcaacctattctagaatcctttaaaacttgattttacttgtaatgggactgtatggtatctgcttccttaggaaacatggaaaatggatttaaaatctcaaatgcaaactcaaagaaaaagtatattgctattgttttaaacaagtaattcccaaaagtcttcgtttgttgacatagtagctaattctaagctatctttaagaggttttgagatgcatataaatttagatagtcataaacctacaacttaaaaatcgcagtttcattactgatttttaaatgaaagagattggcttaaatgggaaaccagaaaattaatattgatgactaatattaaggtctgttaatataacacataaaggaagagaatttgattctatttgagattataaataaaagcaaatgtctttccttctgttttgatattaagggggaaattaaaaaaaataaattgtttaccttattccacaaactctggattcaacttaaaaatacacattttaaaaatgatcatgaggtcaggagatcgagaccatcctggctaacacagtgaaaccccatctctactaaaaaaaaaatacaaaaaattagccgggcttggtggcgggtgcctgtagtcctagctacttgggaagctgaggcaggagaatggcgtgaacccaggaggcggagcttgcagtgagccgagatcatgccaccacactccagcctgggtgacagagcgagacttcatctcaaaaaaaaaaaaaaaaaaaaaaaaaaaaatatatatatatatatatatatatatacacacacacttaatatcttctgatcctctctttattaaattttcacacaggtacctaaagtcaagacttttctattttctttaagccttaactgatgttttaagtttctttaaatgtccttttcctttcttttcacctctgaagttaaaagtacatcagctaggtcatgttttatggtagaacccagtacactgcaggtggagttaatcaaatgcttgccccctgcactgaaataagaaatgtgaattgagttacctaagaaggaaggtttatagatgaggatttattcaagatcaataaggaaaatgagccatgttttcccaataccaggagaaagactcagaaaactgtaattaccaaaactaggtgagtggtcttacaattattttttaatagcttttcaaaagaccaaggacatcatatgtttaaatgtatgtacctgataagaaaccaggttgcttctcaatcatctcatatattcttttctcctaaatgagaaccaaagattttctgcttaggtgacctatttaatttgcacacatttatgctagctcagagtggtcagcttttttgatgcttccaagacaaatttcttaaacacaatagtcacacattaacaaaatttcacatagatgcccactttaaaatatatgacagggaaaaccgtgcatttatatgtagactgttcaaaggacagaagttcttgttaaatcagtgattatttgtgggaccatggagcctactgtgtagcaagtactgagtgctaagagtcaggatagtgttggctgagaatcgatctgtccttcaaaggtttcacagcctagggagggtggctttataagctatatcaataagtaaattaaaatagggtgtcatgagtataataatacatgtgtttaaggtgcagagaagtatccccaaagagagaggggttaatttaagtgggtgggaggtcctgaaagacttctcagaaataatgacatctaagctctgtttgaagaatgactaagaacttattggatgtataagttaatgaggtattcagttgcaagtaagagaataccctcagaaatccacctggctcactctttcacttcattcaagtctgctcaaataagctcagcaaagctgctttgaatgatctatatgaattagcctctcattattctctgttcccttaccttgctttattttatccatgatgattaccactacctggcatattatgtttattcttttatttgtgtagtgtctatcttctctgacttagttcagactctgtgagaccagggaagttgtgtgtttcatttactgctttatcccagcattaggagcagtgtctaaataattcaatattagttgagtgtaatccagccaactatggtttaagtaataaagatatttaatatctcacaagacgtggagcttgttgacaggcagtttcagggtggtattgctcagtattttcatattttgtagtttttattgagatagggtctcactgtgttgcctagactggagtgcagtggcatgatctcagctcactgcaaactccacctctcaggctcaagtgatcctcgcacctcagcatcccgagtagctgggaccacaggtgtgtgccaccatgcgtggctaatttttgtattttttgtagacatggggtttcaccatgttgcccaggctggtctcaaactcctgagctcaagcgatccaccaccttggcatcccaaagtgctgggattctaagcatcaaccaccatgcccagccagtattttcatttgagacttgtacattttctattatccacgtctgtcttcagagtattacctttttgtacttggagttgccacctaaatcctaaagagggttattaaagcaccaagcatcacatccttcacaaccatgttcaaggacagaaaaggaagaaactctagggagccctcccccagtgtatgtctcttcatcaggtgaagagattattcccagaagctccacctgcagatttcaccataggtctcattggtcagaaccatcacatagctagaaccagcagtgtgggagcctgggaaggcaagaagaggcagaaggaaatgaagttaccatgagggcttaaactaattatggtttatccttaggggctgggcatattgctacccaaacaaaatcaggagttttaaaaaatgtaataagtaacaaatttagggaataacaatatgtaaaataagtaaaaactagtaggattctaggtaatttattttttatgttagtatgaaaaatatatacagtaaagttgataagactaatcatggacattttctgttgtaaccaaaaagatatatttttcccattcattctctaccaatatcatttttagtacattcttaccagtagtatcataaacaacaactgaaatctgatatttgaagaagtccttctcaaagaaagatttcttacacatttgatgaaatggtttaatttctaaagctccatataaaatttgtcagaggtgtcccttgctttagaccacaaactcaagagattcagacaacgggttcaataagtaaaatcttccttgaacacccttccccctagaaattatcatgtcctatagatcatttcacagagttcctactctctctggggaaaaaaaaatcacagaaatatctcacaaaatgaagatattttcttcccataatcatagtcataagtaaaatatgtatttgaaatttgagatcaaaaaaaggtagaattgattttcatgaacactagacatgtgattcctgtcctcaacaatgtgacccgcaaaaccaggatcttatatatgcccttgttttggggaccagggacaagatgcaatattcttgattttaaaagaaaagaaaaaaaggattcacacttcttccttccctgcatatctcactcccccctctttccctctatctccccaacacccccatctttctctctctctctctgcctcaccctcttctctctttctctctctacctttctcctttcacctcatccctccgccctaaacattgctttctatgtagaaaaggaaactaacttattggctgtgtgggtgatcctgaaattactactgtccctgtgggttttttgaggtaactcttaactcctttagctggaccaaagtgtactgttacatcagctgataaaaaagtaatttccctttaaggaaggaactagtggaccttccacctacacaaaatttactaacttaatcgtgcccatgtgattaccattccaatgatttgcttattttaccacaaatagccagtctgggataggactttcattcattgtacctttttctaatcctcttagggaacaaaagttaaggcataattctggctattgggaaggtgacgcagaaaatcaggtgggaaggtgggaagatgaggagagggcagatggtgaggagagagagtgtagccctgccagccagctcacagtctcctaagcacccctgaagagcacattttccagaagtttcccaccagagaatgtccttttaggttaggtctgtacataggtaggctacgttggtacttgatttacccatagcaacaaatgtatactaggagtttgaattgtgttggtgaagctgttgccacgtgaggaaattgaaggaagctatgccgcagagggagtgaaaggagcccttaagccttggtctgcttttgtgcttttctggattctctgcgactttgttcatttttgaccagaaaagattggagaggaatgtgaaataagaaaaaatcctagacacaaaggagtggcatgcccaagtttacaggcatgatgggagaggaattttgtcaccttgccacttgatcctaaggacatctcccctcccctttgtttccttaaaaatcaactatgaaataagaagactgcattgatacacgcacacataactcaaaagaaagaagactccgcactcccttggccagagggtactgtgagtatgccctggcccagggggcggctattacactagataataaaattagcattgagtcaacaaaggaaaatggcccccagattcattaataaagcaacgttttggtctgaatattcagaaatgctacctgcacccaccccattagctcagagttctgaagaagacaccacatacggaagcctctgctgtcacctctgttttagttcctgcctgtgaatgagcagttccacttgcactttctgaggcttctcaccgtagcccttcccaaggtggcaaaacctacaaacaacccaagagcctgaaaaatggaataatgagagttgactttcacttacatgcttgctgtgggccaggcactgtgctaagggctatactggaacgatttatttaatcttcacatccccagaaggtaggaatttccatcattttacttcgcagaagactcttctgttttgcagttttacagatgggattcccattttatagcttgcctgcttgaggtcacacagcaagtaaatgatgctggtaaatcaaccaggctttgaaccctaacactccaactaacggagtgcttgctcttagcaaccacagttatgtgctgtataatgacgttttcatcagtgacagatgacatatacagcagtggtcccataagattataaacctatattatggactggacatggcggctcacacctgtaatcccagcactttgagaggccgaggcaggcagatcactagagcccaggagtttgacaccagcctggggaacatagtgagatcccatctctacaaaaaaaaaaaaaaaaaaaaaattagctaagtgtggtggcacacgcctgtagtcccagctacttgggaggctgagctgggaggatcccttgagcccaggaggtggaggttttagtgagctgagatggtgccactgcactccaggctgggcgatggagtgagaccttgtctcaaaaacagaacaaaaagcaaaacaactgtattaggggccagatgtggtggctcatgcttgtaatctcagtgctttgggaggctgagatgggaggattgcttgaagccaggagttcaagaccagcctggggaacaaccaaaccctgtttttacaaaacatttaaaaagtaacctgcttggtagcatgctcctgtagtccctgctacatgggagactgcagtaagactgattgcttgagcctagagattcgagctgcagtgagctgtgatcactgcattccagcctgggcaacaagagcatgactatgtctccaaaaaaaaaaagagagagagagaaaagagaaaaccaccaacaacctgcctttactatgtttaggtgtgtttaaatacacaaatagttacaattgtgttgccgttgcctgtggtattcagtagtctgtagcttaggagcaataggctacaccatctatagagcctaggtatgcagtaggctataccacctaggtttgtgtaagtacactctatgatgtttacaggatggtaaaatagcctaatgacacatttctcagaacctgtctctgttgttgaatgatgcgttactgtactccaaactttttgacaaacctaacctaattttgctcttcattatatgcctgatagacatttttatctatgtacatgaggcctgagctgaccaaaatttctaactttggagaatgtatcagaataagagtaggaggctgggtgcggtggcttacacctgtaatcccagcactttgggaggctgaggcaggcggatcacaaggtcaggagatcgagaccatcctggctaacatggtgaaaccccgtccctactaaaaaatacaaaaaattagccaggcgtggtggcgggtgcctgtagtcccagctactagggaggctgaggcaggagaatggtgtgaaccctgaaggcggggcttgcagtgagccgagatcgcgccactgcactcgcactctaggctgggagagagagtgagactctgtctcaaaaaaaaaaaaaaaaaaaaaaaaagaaagaaaataggagttgtgtagaatctggatcaaaaataactgctttatctttttccttgaggtggcttaacaaaagactatattcatttgagcttctgttgtttccctttgatacactgtttcacactgtagagccaatggttttatacagttttacggaacagcttgcaaagtgcaagttttgacaagaaaagaaaatctttcctgctttgtcttctcatttcaaatattgcatgcagatttaagctaccacatgtttacccaacgtgcttgtttctaatatgtgaaaataaggttgtatcagtagaattagctacctttaaaaaattggttgcaaaatgtatccagtatatcatctgtgaatcatccctgggcttccaagaaggcatggtttgtagctacacaactgcaaaaaactttttggcaagaagtgatccaatgcattccatagaagtagcagcatcctaaaaactgaatgacacctacaccgtgaaatattttaaaagaattcccaaaactctgcttcatcaagagtgaattttcagtcaaatctgcttttctttttaaatttataattgattcctccacccattttaaacaaggatttgaggtggtgtaagtcaaatctgtcactcaggcaaacactctagcatcctgagccctattgttcatcaaagtccttctgtaattaatcttggctgtttgggtaagtgccttctatattttggtgtaagaaaggcagagcaactttcttatgccttttatcttaaaaagggatgaaagtaaggaaaatggaaagaagccttcaatagaccttctggcaagttctgttatatattgagtgctaagtgccagtcactaagctaaccactatcatatgatttcactgactctggaagaggatcttacctaataaataagagacactgagcaacaggaagccactcatccctacagattgtgatgtcaggaagaagactggggcccattagggtgggaaaactactgccattgtggctgtggcagctggttctttctctgcctctgtcctatcgcaagaaaatgcctgccctattagatctggtcagtaatgtttgatgaaccacatttgtgcttgaagagtctcaagcaaaaaaagggtagtaagagaggagaaagaaagaaaagctcatgggggaaaaaaatcacccacatgaagtagatttacattggatccccaggttcccttcacagatcagcgtcaaagcagatgtttctccccaatcttggcaccttcctcaactgctgatactcaaagttaattagtttagtataactttgtgtctcttaattgatgaaaagtgtttttcaacaacaaaaatatctataattggtccacaattctagatggggcctaggcagttgacagggaattcaggtagaccaaatgccaagaaaaaacgctctgaagtgctctcaaacagaaagattgcagactcgtggacagtatatgtctatctttgagtcatattggttccaaagatgaccaattttttttgctaactcctcccactttatttatacagcatagatcatcataggaaaattttaaaggcaaaatacaaaaatccacaccaatttccacaataagcacttattacccttataataagaaagccccacagaaaggtattagaaaagccctcatacaactactcatgtttgggaaataaatcacaattgtgtttgtaagtgtgctcccatttagagacattcatgttctaaatgtaaatggcaaatggttcatagagaaaaacaaaaaatattgatatgttattgatacaataccaagaaacaaatatgccagcctctccaaaagttcttttcccattgcaaattatgtgtataacttgctatatattttcctagtttttaatgtatataatctaaaataaacaaaacacagaaagccatagccttcgtcctctcctagccccatagcaattccagagcagtgagatagtcatttgtgggtgtcctagtgtgctaggaagtcccgaaatattcttgtagcccaggacactctgttttgttagtctattttgagataatccttctctcagtaagtgaacttatgctaacgaaatgattatagactaaagattaaatcagacagataaataatttatgttgtgaaaaaattatcaggtggactaaaaaattgtcagattgtccacactctccctagaggcaataactgaagaagccagaagggaagccgaattctgggtgaacttgaattggatgatactagtggctagtagtcaaattactataatctgatgaattcggttgcacagtagggattgactggcttggtagaccagaatgctttcttgggtggccagagaaccctgtcctgtctacaaagctggtgatgcattattgctctttaatgcccatacacctactcactattaagatcatttttcttctgttaacatatctttcttgggtaggctgtatttcatttgattagccttcagtttccactgttacagtagtattctggtcatagtattctgttactctgctactacacccaaggcatcaaatagaggcattgacacatagtcatctaacataggatgcttctaaaaaaagcacggttgatttattaattaacttttactagattggattaaattagatttttcttacttttatcctcaggtaactgagatgtgtttagctggatgtctctcctgtgtacttatagctaccctttgaatattcatattaatgtaattttatcgaataactatagtccccttttatttaaaaaatgagaaagaaagacagcaagagtttgattattcagtgattttatggtggagaaaaggcccaaatagttttttttttccaaaagaaacttaaatcaatcctaattgatagtggttccctaacatattaaaaggtcttatgtgaggtttatggatatctgtttaattattttatttattgtcacttgacagagcgtgaaagaagccttgctttgtttgtttggagtggagttcaattctaaatggatctaactctgggcccataacaggagggttagttattagaatggtaaaatgttcaccttatgggatgatctcacctgtgtgaggcataagaccaccagatatacaaaagtttcctccctccaggccttattttcgccacaccctaccctctcacaatgcacaccaccttgccaaccagacccttcagacatcactcttcacaaaataagactgccaccactggaagccaagcccaggcaatttgggttctgtaggtgggaaagaaaatcaaacctaatagccatcattctcatgttttggtcagtggcaaaactggccagatagagatgctgaggctgtgagaagagacagaactgcaggcgtatggcaagattggtgtggtttcagcctaaagtcacgggatgacacagggtacaacctcagagaccccatctgcaaatccagagcgacaactggtcacagggatccatccatgcaagctggcattctggggaaggatttccacctcaaagatgaagtgagaatatgataggagcctattaactaaaatttgagtagggaaggaaatgtgcgaggtacaaggcaagacccaggtatcagttaggaccagcaagtattctaagtcactgctacttctctttcttatggatatgaatttcctagagggaagatgtacctggtcaaataatcctggttgaaatgcttgagattttattaatgctttttatttttatttttgagatggagtctcgctctgtcacccaggctggagtgcagtggtgtgatctcagctcactgcaagctccacctcccgggttcaagtgattctcctgcctcagcctcccgagtagctgggactacaggtgcctgccagcatgcctggctaatttttttgtattttagtacagacgggatttcaccatattggccaggctggtctcgaactccgtacctcgtgatccacctgcctcggcctcccaaagtgctgggattacaggcgtgagccaccgtgcccagctgagattttttaaatgcatttattactataaaagacaagaatgctgctaccctgtggccttgtgaggcatgttcaatccagaggaccagcttgatgatttttcaccattcatgaccattttcctttgcctttagtttcttctagaatgattaaccacatttactcgccaaaacttgagttctgactatatgcaggttcttctaggggacccagaactagctatgaaataatagtctctgacatttaatttatttattcaaccaattattaatagattcaaaagtatctagtatgtacaaaaaatgtttagagaggttgaaagtggccaggtgtggtggttcatgcctataatcccagcactttgggaggccaaggctggaggatcacttgaaaccaggagttcgtgaccagactggaaacaaagtgaaactctgtctctactcccctcgcaaaaaagttaaaagcataggggtctcactgcctgacctcacattctggtttggacattattaactttttgactctgggaaacttactaaaattaaaattttctaaagatatgttttttttcatctataaggctggataaaataatagtagctaccttaaagtagttatgattcttaaagaacatgttgcttgtgaaatctctggcccatacattgttaagactaaacgaagtcaagccagccttaataaagcactgagaaagattgcatgcatataatagtctcaaaatgatgaaactgtagtgatgaagaacaaatcaacagttgccaggagctagttaaggttgtggggagggtgtgactatcaggagttagtaccaggcctccctgggcgatagagtgagactctgtgtaaaaagaaagaaagaaagaaaaaaaaagttagtaccagggagtttctttgtaataacagaatacttctgtatctcgagcaggcagtcgtgatacaaatatatatgtgtgataccgctcccacctccaccaaaaatgagtgcgtgtcaaagctggtgaaacccgaatttggtctatagtttatagtatcgtatcaatgttaattttctggttttgaggatgtaccatggctatgtaagatgatatcgctgggggaaggatacacaggaacactgtgttatcttccaatttatgagtcttagattatttcaaaattgagggcttttttgttttgttttgttgttgttctgttttgtttttgagacagtgtctcactctgtagcccaggctggagtgcagcggtgtgatctcggtgcactgcagcctctaccttccagattcaagtgattctcctgcctcagcctcctgaatagctgagatttcagacatacaccaccacatctggctatttttttttttttttttgtatttttagtagtgatgtggtttcgccatgttggccaagctggtctcgaacttctggcctcaaatgatccacccacctcagcctcccaaagtgctgggattacaggcgggagccactcaaaatagtttaaaaatataaggcacgaaaagagatgtgacagtgtaacagagaagagatagacttgtctctgcccttatggagtttacattctactgggaagagaaaccagtaattacacagtcagttatttcatggtaactgtgctcagtgttacgaaggaaaaatgtaatgtgctatgacagcatgtgcaaagacaagggggcccaaagctggggcagctcaggagaggcttcttcttgtgggggggatatctaagctcccatttctatggtcgggtgagctgggtgggatggtgggaggcgttctagggaagggagcaacattgatggggacctggagggtgaaagagcctttggcagcttagaggaactggccgccgtgcaggaatcagagttaagtaggccggtgttacaagcacagtgttgtgggggtcaaggagagaagtatgtctgacaagaaactggggggagaaaacaagtgcaccatgatggtagcaatggataaagcttagattttgaaatgggttgttttttaatgaatttaaagctgcaattataaaacgcacaaaggaatggatacttcaagtgtgtgatgagtttgggaagccacacatagtctggtgaagagggtccctggaagaaactggaaggggactgggaagagcatttggggcttgaccacaaaggaagtttgattttttgtcctgcaggcatggaggagccattgggacttctgagctggcaagttcttcaaagtttactcagaggccaagataaagcatagatggagttaaagagaactgaaaccagtgagcctggccaagaggctactgcaggagtccaggatagggacattagagcctgaagctggggtgaagggagtggtactgggacagggagtgacaaaggagcctcatgtcagcaggcccagccaacaatagggacctcagatcctggagcatctctcctagtatttaggttggtgcaaacgtaattgtgctttttgcaatttatccctctgaggtctcttgtaggtatataaaaacatacatgtaacacatctactgtggccttgttggaaattgggaaattggaaagaatgcatgtatccgttagtgagtacttgagtaaactatggtacataatcctacaatggggttctatggagcacttaagaaccatggagtatcttcttaaaatattaagtcagaagaattgcagaagactaggtatagtatgacctaatttcatagaataatgtgtagagtgcattttacatgcatagaaaaagatcttgaaagatatacctcttcctttggcaataaagatctttgcaggtggagattgtaaagaatgtttactttttatacatttccttatagtgatttatttattacaaatatgttcatgcttcagtatatctgtctgttgcacttctacgtgaatggtgttgtcttagattggactcctgtgaccaggctttgagatggagaccacatgcagaaggaggcagcccttgggaggttcccctgttaggaagtaaggaagacagcattgggcagagagggaagctcacccatattgcagttgtaactgagacatactaggagcttttgagctgggatgacccttcagagtcatcctaaattggggcagggtctttatatccttgcgttagccagtcattgggtttggactgccttgaggagggagcatgaccttgggctagtccattccctgtagctgagggcaactcctgttgaaggatgcagctaagaatggccagcaactgatagtcctatgcactggccaatggatgccctgactctgaagagggaatctgggaaagcactacagtatccattacagttatttggtgtaagtttaaaatttatttttagaccttgcagaccttgcttaattatcttaactttgctttcactaatacaaaggtaaaagaggaaaaaatgattatctcaatgtgaaaaaaattaaatgaaattaaaaaacctttttgattaaaaaagtcttggcaattaggagtaaaaagcaatttatttgccctgataaagagtactttctccaggctcccctttctctgaaggtgtaggccctctgcgggccaggctcctctggcttaatttcctccaccacattgtgtggcctcaggccttgccttccttctccttgaccacaatccgcagagtgctctgattctcatattggtatttgcctccaggcagtcccagtttctgaatttccttctgttttcatttttcctctcttcttttttttttttccttttttttttttgtggctcctagtgatttcccttcctttcttgtgtgctcagcaatacatttaaaagtatatttgttgtaatttatttagcacctagtgtttcacagcaggaaggtttttcagtgtatctggtccacagttctgcagaaagctaaaccccgactgtcttcaccaaaggcaatttttccttttgctgcctctaatgtgactttcagttttattttttatattttatttatttcataagttcattcacctttatcctcttctcctcttgctctatcttctatcgaatctcagtttttcttctttgacctcttttctttaatggagaattatttgatcatgaattatacctattggggcaaacttttctggtttgtatcattcagctgactttttaaaatcatattcctctctatgttttttgtgttatctatgactacattccatactgtttcatttcttgtgattatgcattcttaaattggtttgttcttaccaagccagctatttgtgaaaggatagaactggagacagactagggaatggagctagggcagcttgaatttccatctattttccactactgcctttcctggagaacggcctctgtgtgggctcaactcatttctctctcctcagctcatttttatcacagctcttttggatggtgacataaagcttggtctccatcagctgagcatgagccatatattcaggcaccactcttttcttgttgaccttagtacacccacatcctgctctggcagagatgacacactagcctgtttccacgtttagcatcatcacctctgacccctaatgccaaacaggggtcagagcatttccccagtgctcccatgcatcgagacctcatgttcccagcaagggtcatttaatgtccttcagggtttgccacctgtaaagacctctctgttctgctcactaaactagagagctgcaggatcttgtttcttccatcagtctccccatgtccttatttaattttcctaacacttggcagccttttaaagagtgatgtttggattatgggtgtttcctagtgtttcatcagtttcacttctgtttgtcgttctcttaatttttggttgacttaaggaaagagagctttcagtcttgcacttgatcttgaagtccagaggattattataggatgatagaagacttaagcaggtgagggacgagctatctcatagatgatctgagaagggctgggccataagagtagcctggaaagaaggagatttcttccttacacacagaaggacaaaaatccacagggaacatacaggaggaattttaggtcgataggaagaaaaggagtaaaaaggtacttgctcctgtgggagatgtggagtctggcatgtacaaggaacagcaatagactttattcatttattcagcaaatttttatcacatccatgctatatgccaggcagtggggaaccagtaatgaacagggcaaaccaattcctgttctctgatacttcactttctcatagaagagccacagaacaaagaagaactgagcagcagcaacaatagcaagagcctgttttctgccaggttctaaaatagacaacagagccctggagggtctagtggtggcttccatgtggaggtgctatttaagctagatgtgaaagaacagagaatccagccatgtgaaaggaggggaagagcattcctggcacagagtagaaaatgctatggccctgaatcaggaaagagcttaataattttcaggaacaaacaaattactggttggacttgaaggagcaagacagaacatggcacaggccgaggttggagagaaaggaaggaaccaaatcatgtaggcatttgtaggagctgggtttgtattctatcattacttcctcagtcagtagagataatgaagaacagaaatctaggcaaatatggataaattataaatgtaccaaaatgatgatagttaaaacccacgaaaaaaagagcataacatcaacaagtgctttggcaattttctatgtggagattctggttttaagataatttgggcagaattcatagcataaaaaattaacattactcacagacttacattctaaggagaggaattccatgtcatgcttttaggaatgaatcctagaaactgattgtcctctggaacaaaggagactgtggcattttagagagccctaagcttcactatgcgtttctgaatttgaggatatggttgaggaaaattagtcagaaggaaaggacttggacactcaggattccatagatctggaaagtaggaaggcaagggctgtgctgaaggagacattcactctttgcatgggggccatcagagacgaagccagatagcatgcacaacacccagcttattctcacacccatactttctctgtttgcaaagagaaatcacaatggaaatatttctaaagattacccttctgcaacagaaagaattgactggaaagtaagttatgaaaaagaaatctggaagcaaggtaatagagccccaaacagaatttaaatcttttcctatcagtatttggtagagtctgagtactgacttatcagaatatatataggattttatccagttgaagctgcagactttaaggatgtatccatttcctcccctcttccctctgtccttccctccctcaacagtgaatgtttgagatgatgctatccagcctttatagaccaatctatagataagtgactcttctttttagccttcttcatggcgaatttctctccaacattctttgcattctaattggtcttactcaattccaaagaatttcccattaatcaataaagcttcttcttagaagtggactaaagctgaagtttcagcttctgtcagactccatgtgagagactcctttcaaaaagaggcaaactgtaaatccagttttcttttggcattaatttcctagtagttctgggggttcaaatgagacatcagtgactagctgtcactcaagtattttatctcaaagcttaaaggactggaaagtgactgtgctccttccactctcagtttaagtacagtattctgttcctggcagccaagaagcagcaggtgtaggatgaggaatagctggccattgctcctggccagagaaggtgcttcttcacaacagtggaaggtttcagtatcgcttagcctgtccaagagaaactatttttgttccatatccatgccctggtaggagagttcaaatttattttgggtttgctgatggctatactatcaggaggatatcagtgcaggaagccaagaagctaccatctgtgctgtgtttatatctaaagaattatttagaagactgattactcagttagctgggcctcctgaccttctagtattacacttagaaaggtaactaacactttcttgaaagtcacttcacttttaataacccatataattccctcaatataaggtagggatcaaagtattgaccaaagcttcacactgagtctcatgtgttgtggatgctatgaatgatcacttgtggttaacagatagtgactcctaacagtgatatgttagtaaatatttaacaatgggctctctagggaaaaataactgattcatagcatttgccagtttccatgatggaatagtaagaacaattttataaattcaaaaacatagatgaaatatagaaattcctcaaaagacaataatgaccaaaatcaactcaagcaaagtaggaagcccaaatagccctatatttattaaagaaaatgaattcacaaatctgcccaccagaaaaattgcaagtccagatggctttactagggaagtatatcaattgcataaggaataaattacactaatcttgcacaaaacccttcagaaaatagagaggaaacacttcccaactcaccttttgattccagaatttatactgttaccagaattaggtgaagacattatgagaaaagaaaattatagatcagaaatcagtatacttcatgaatagagatgaaaagaaaattctttgcaaagtatcagcagattgaatccagtaaaaacatatattatatatatatgtgtgtatatatatgtgtgtgtgtgtgtacatatatatatatatataaattatcatatatgatgaccaggaatgtaaggttggtttgactttcaaaatcaactgatataattcaccatattaacagaataaagagggaaaactgtatgattgtctcaagtatgaaacaaaaccatctgaaaaaatggaaaaattcagcacttattctttgtgtatgtatataactcccaaataaagtaagaatagaagagatttttctcaacttgataaaagacaactaaaagaagcctgcagctaatatcagacttaagtgtggaaagactgaccactttccctaagatagagatgaaggcaaggatgctcactctccatcacttctattcaacatattgctgcagatcacaggcagtgcaataaaaaaaaagaagtaaaatgcataaaattgtaagggaaaaacactgtctttatttgcagatcgtgtaagtataaaatgcaaaactatttctaaaatagctactagaactactacatgaatttagcaaaggtataagctacattgtcaatattcaaaaatcagttcattcttataaactaacaaaaaagaatgtaaaaaatgtaatactctccacagtagcatcacaaaacatgaaatatttatggacaggttcagcaaaatatgtgcagtatctgtgcattgaaaaccacaaacattgctgagagaaattaaagaagacccaagttaggggatacaaatgatcttcatggattggaaaattcaatattgttaaaatgttagctctccccaaacagtcaccatgagaattctagcaggatatttgtgtaaattaataattggagattctaacatttaaatggaaatgcaaaggacttaaagcagtcataacaatttggaaaggaagaacacagtgggagcctatgataagcagaattccaacatgatgccaagattccatcccctgctgcaccagtgtgtacaatccccttctgtagagtatgagagagacctgtgaatatgatgggttgtcactctcttgattaggttatgttatatggcaaaggtgaagagatttgcatcagtggctccatccaagactgaagtggcttggtgcctgtgtttggacacccagaccaaatgtaaacctttggtcctcaccctccagaaacacatgtgcctttaccacccctcaggttaaggcaaacacacatttatcgcacagtctaccttcggggtcagactgggggaggaggtccacaaatgccctgaggcatactcatgactatgtgggcagggaattccaggctcacagttactccaggtgtgatctcgaaaggaagaggtgcatgctccgcataggcaagccacttggccacgggatgtcttcactccatgggaagggaggaggctcaaggtggctgaagtagagcctccccaagcagaacatctcaaacttatatgtgcataagatcttattgaaatgcaggatcagagcagatcagagtgagacctgggatcctgcatatttaaaagctttcaggtgacatgagtgctgccgacccactttgaatagcaaggctggaatcatggggcggggtagtactgctgtgatgcctggcagtgcatccctggcattggagcacatgatcagccctaattggtttggtgtcacttgtgaaatctatccagcaaaagaagtgaaaacagaatggctatctttaattaagtgtttactatctgtcactaatatctttaggtgtgataagtcatgtaattcattggtaaccactccttgccaagtaccagcttagaaacgctagccagttgcttaaagacgttcttctgatctcatagcatcccttattttcaaccttttatctgtcccagttacccaagccattgtgctacaaaattcctaggatcctcaagttttcctaaaccctctttttcctaaatcctcattttcacggacctcaggacagcctgggaaaacatcctggttggttctactacaaaatcttgttattagatctctgtggggtcctcctgattcatggcagtcttccttttaaatattttatggacttcctagtacgttatccacagcagtgccccaaatccactctttgtgctcagctctatttccaactgtcagcaaaagtgcttgcatttcactttaaagggaagaatgcttaatctgtgtttataatcctaatccctttcttttccttggctttgcttatcagttgttccctgtctttctatctccttttactctgacttttagccaatcaaaatactgcctggatctcctgttttgtaagatcatatacaccctcctaatccctgttacatgtctcaggcagccagcctcctttgccttccctcactgcccactgccatgaaacaggagtcaccttttactgcctctacctgccacctacaaccactttaatctcttgcattctggccttttcttccaccgacctacgaaaccaccaatttgaagtggtattaaactatttattatttttattaataaaatatgggagcatgaatgagatataaaatgaagtcaaaattgtttctaatatttatgctgtatttttccattttgtagcattttttattttgaggcatcactctacagagacttttatctcttcctgtgggatggttccctttctaggccacattttttgacatttacaaaaacacacactttttcttttaaattcagtgctgaaggttaagaccttgggccattcattattttatctgaacttcttttctcactattatttggaagaagggtaaaataatacattgagtactctactctcttttgatgattatgttgctcttgggccaaaacaaacctttggaacctagatgaacttctaagttattccaagagaattaggaatcttcctttaccctccatggacccagcttctcagtgcagctaaagcccttgcttagtctgtataaattaatacatttgctggaaatgtgactttaggagattttatagcagtggtttcaatgctgctagtggtgaagtggaaatttgagaatgtgaagattagtttaaaccacatgatgggttcaaggaaaagggacatagctggcagtttcctgaatgtgtgctaactctagatagtgggtaatgggatccgaaaaaaccaccagtgaacttttaaaccctcttgagaggaatcaaaccagcacaattagccctgaaacggagctgtacacgaaaacaggcctcttctctctccctcagaaaccaatccctttgcctgaaagaacaccattcggagatcagagagagaggaggcaccttaccttttactgctaatggaatgaagctagacctgtgtttccaatcattagctggtttactgagctgtctttcatcatagattccaaattctgttggattctttcaactattgttaaccaataaattgtatgttgtggatagtcgatgaacttgaaataaaagatttctttttccttccagtttgttgtagcagtgttctggatcatttatgcctatgacagagagatgatatacccgaagctgctggataattttatcccagggtggctgaatcacggaatggtgagtggattaaaacaaacggctttcttttattttaaaaaatctattaaatagctatgatctgctatttagaccttccatagaatttgcctaaaaagccatgaaatcttggaaggttataatgggagattaaaattagagaatactgtaatatttactgaatataaatagaaacttcttcccatggaatggagtcattattcaaacgatgtagtagatgaatccacagattattaaggttggtgtgtcagtggtgttaaataatataattagccaattctgggatgaatttaatttctgtgccattagaaggcttgtcctcagagcccaaggatggattcccatctacacagccaccaccagccctccgctccacctgcgcctcacatcgtctggattttgtttgaagtaactattgcagctggacagtttccctcagatgggcagcaaggctgtgactttctttcagagatctgctgcaggcatttggaagtgtcttttgcaatggaattgtttgcctcgtagggttcttcccaagttagggtgttcgcctgtggctttgaggccttttccttcttctcagtctaattctttctggtgctttagccatgatgttgccctcactagtttcaaatccagtgctttggatggtttccacatcattttacaacatttgaggatatattttctgcagtgaaattttgtttcatcttccctttcagtttttggaattgagcactactttgttattaactaagaagcatgcattttggttacagcagtttttagaatatgtcccagggtgttcctggtgaaaagggcagcccatcacaagaaattataggggaaggaagagctggaaatcatgagtcttgagtacaaaataacagtttcccttctgcccccaattttggtatatttgaagaaaagtggtgtgtctaacaaacaaacatcactgtactgaagggttttgatcaattctttcttaagccaattcatcaaaagtggcacatctcagagaattggatttttttttagttcaattagagccacactcttgaaggattaacatggcacctctggtctatttccaaacatatcagctgggtcttgtcagttcaatttagccatccacggggcctggcatggttactatggccttctccaactttttccttttcttgaatgtgaaaagcatgtcgtaactccatggctttgcaatctcctgccccaaatgcccttctcagtctttcctgacaaattcctgctagcttagttcctatcttctttaagaagccattcctaactccccaagcaaagttagctattccgttacttgtgcttgcacagcactttcatatctctattatgcatgtctgtatccccacaaaaatgttaagctcctagtgcaaaacagcctttgaattccaagcacttcgcccagttgtctggcatacagtaggatcaatacatatttattaaattgatgaatgaattcgctatagccaatttccataattctttgccagttacatagctactattattttttttgtgccaggcactctacagtgattgtatcattaaattttcacagtggcgctacaaataaggaatgatcgcaattacaaatgaagaaactgaatctcagaaaccttatataatttgcccaaatgacgtagctcaggatggtagaagtgggatttgaacccaggcctatctggcctcaaatgtgtggccacattttatctgaacaagcaaaacattaattgattcttgataaaaacagttacattgtatagcttttataacagtaagttaacaaaatgtaagaggaacatcttcagggtattttgaagcttagtttcaaactgtttagcgtatttcagctgtctaagataaaccagtcaataattaggtacgtatttttaagaaaaagacattatgaaattcctgatctccaagagctgagttgtaaatggagataggctttgtaaatcatcacttcaaacattacaccaaaaaacattgtcatgtgctcaatcaggagcaggctctggccaaaaggcaagcatattcttgtgcaaatagtatcctttgtgatatctccaaatatgaggaagagtaatatcacctagataactctaattagagtgtccaaattgtgagtattaaagggagactcttgaagttgctgcctccagttgaatgtgaaatgatgtcagttaccttgttctgacattacgagagactttgctgacaacaaataattgcatcatgtgctatagaattaaagtctcggccactttggcttattgttaacaggcctgaactgcacaatattaccttcatgccagagaatgaatcacagcctttgtggatcctggttctaaatttttaatgttttgaacaaatggcttatgaagcatgtatccagccattagaactttgacttgcctctcttaattttaccttgattcactttgatgtcttaaaactcttactcctggagacagatactacttagaaacacaaggaggaattgaatgacacaaatatttaggaaagagaaaagataaattagttaatatgtcaaatcctctgagagataatatgagttcaatagattctttcacaatgaattttgtgtcctaatagtgataaatgaccagttctttggttttcctcatgttccaattgatagttccagaattactgagaaaaaagaagttgcgcatggtggctgatgtgtattttgcaatattaaacaatttacattacttgaattctgtatctgtgcaactatagatacaaaatggataaaccatgatgctgatcctttagactagcaattaaaatatgaacattaaatgctggaattatgaataattttcataaaatgtgtaataaaatgacatttcaaataaatgagcattttcttgtttaaataatatttaaagttttaataactattaatttgtacttgcttttaattctaattggtttttaatatttaatttaaaaatagcatttttaaatatatggaaataagtccattccaaatttctttttttttaattttttaaattatactttaagttttagggtatatgtgcacaacgtgcaggtttgttacatatgtatacatgtgccatgttggtgtgctgcacccattaactcttcatttaacattaggtatatctcctaatgctatccctctcccctccccccaccccacaacaggccccagtgtgtgatgttctccttcctgtgtccacgtgttctcatcgttcaattcccacctatgagtgagaacatgcggtgtttggttttttgtccttgcgatagtttgctgagaatgatagtttccagcttcatccatattcctacaaaggacatgaactcaatccattccaaatttcttaccagcctggataacttggtgaaaccctgtctcttaaaaaaaaaaattagctggatgtggtggtatgaacatgtagtcctagctactcaggtggctgaggtggggggattgcttgagcccatgagatcaaggctatagtgaaccatgatcatgctactgcactccagcctgagtgacaggagtgagaccctgtctcaagaacaaaaaaattctcacatgtattttaatgtatgtattttattgaaaattcaaattgcataaattttgattattttattttcaattgatcttttagattattactatcagtagagcgaacattttgtgaaactttccattataatagcatatttagtaattttgctgacatgaaggcaagaaaaatatagttttagaatatttatattcatatattaaatattttaatatttatatttatggcttaaaaatatatatgttttactacttatccaatcacatattttctattttgttttataaaactacatgtgacaatgtaggaggataaaacattttatttagcacttcattagctttatttgtagctttttaaaaaaatgtatatacttattttaattttcaatgggtaacacatacatatgcatgaaatttaaatgtttccctgcctcctttgtataccagctacttaattcttttttcctttacttgtacctttgaaaattaattttaacatacatgtaattaacatagttacagggtacagagtgatatttcaaaatatgtatataatgtgtaatggccaaatcagggtaattagcatatatattttctcaaacatttattatttctctatgttgagaacattcaaaatcctctcttctagctttttgaaaataacagtaaattattgttaacctatattcattctgtattgctatagaacactggaatttattcctcctatctagctataattgtgtctctgctaaccagcctctccatactctcccctcctggctacccttcccaacctctaataaccacaattctactcactacttctatgagctcatcatttttagctccatcttattccagatcttagaggaaaagctttcagcttttgtctctttagtatgttagctgtgggtttgtcatatatggcctttattgtattaaggtatattccatctatacctaatttgttgagagttgttattgtaaatgatatttaattttatcaaatactttttctgtgtctattgagataatcatttgggttttgttcttcattttgtttatgagatgtatcaaatttattcatttgtgtatgttgaatcatcctttcatctctgggataaatataaacttttggatgtgctgttggatttggtttggtagtattttgttgaggatttttgcatctatgctcatcagagatattggcctatagtttaaattttttggttctgtccttgtctgattttggcatcatggtaatgctggcatcatagaatgagttaggaataatgccctcccctttaattttttggaatattttcagaagtatttgtgttagttcttctttgtaagtttggtacaatctagcagtaaactgttctgtcctgggctttacattgttcggatactttttattacttattcaatctcattgcttgttattggtctattcaggttttctgttttctcctggctcaatgttgataggttatatgtgtccaggaatttatccacttcctctaggtttttcaatttgttggtacacagttgttcataataatctgttatgatcctttgtatttcttgatctgcagtcaagtgctgtaccccggagctgtacccctcctgatccttcgtatttctatggtatcagttgtaatgtctccttttctgattttatttatttgagtcttctctcttttttcttagtctacctaatggtatgtcagttttgcttatcttttccaaaaaaacaagtttttttttttttgttgatcttttgaaattttttgtctctatttcaattctgttctggtatttattatttctttccttctattaattttaggttttgtttgttcttgcttttctagttccttgaggtgcatctttagattgtctatttgccatcttttctttttagtacttcattaactttaattgtaaattttctttgtttatttgaaatctgatttctcagaaatcaccactaaagaatttattcatgtaactagacaccacctgttccccaaaaacctattgaaataaaaaaaaatccattcagatgaaaaaggaagaaaaagaaataaagaacaaaaaaacaatgaaggaagcctgcaggacaaatgggacaacattaaggaaacaaatattcccattatagaaatttcagatgaataagagatgggaaaaggcataggaaacctattcaatgaaataatagctgaaaactttccaagtgttgggagagatatgaacatccagatacagaaagctgaaaaatcaacaagtagataaaccaaaaaaggttctctctgaagcaaattatagtcaaattgtagtcttttatccctcatccacctcccaccctttcccttgagtccccaaagtccattttatcattcttatgcctttgcatcctcatagcttagctcccactcatgattgagaacataatgatgtttgattttccattctcgagttacttcacttagaatgatggtttccaattccatccaggttgctgcaaatgccagtattttattcctttttatggctgcgtagtattcaatagtgtgtgtatatatatataatatatataatatatatataatatatatatttaatatatatatttaatatatataatatatattaaatatataatatatatttaatatatataatatatatatttaatatatatattatatatatataaaatcacattttctttatccactcgttgattgatgggcatttggaaaggttctatatttttgaaattgcaaattttgctgctgtaaacatgcatgtgcaagtatctttttcatataacaacttcttttcctctgagtagatacccgggagtgggatttctgtatcaaatggtagatctactttttgttattttaggaaactccacactgttttccatagtggttgtactagtttacattaccaccaacagtgtaaaagtgttcccttttcaccacatccctgccaacatctattattatttgatttttcgattatagccaccttcacaggagtcagatggtattgcattgtggttttgatttgcatttcccggattattagtaatgttgagcattttttcctatgtttgttggccatttgtatatcctcctttgagaattgtccattcatatccttagcccactttttgatgggattgtttgatttttttttcttgctgatttgtttgagatccttgtacattctggatattggtcctttgtcagaagtatagattgtgaagattttctcccattctgtgcattgtctgtttactctgttgattgtttcttttgctgtgcagaagctttttagtttgattaagtcccatctatttatctttgtttttgttgcatttgcttttgggttcttggtcacgaagcctttgcctaagccaatgtctagaagggttttgctgatgagccaacctctagaatggctccaatgagatgatcatgtaattatttatttttaattctgttcacatggtgcatcacatttattgacttgcaaatgttaaaccatcccttcatccctggtataaatcccacttgatcatggtggattatctttttcacacgttgttggattcagttagctagtattttattgaggatttttgcatctatgttcatcaggaatattggtctgtagttttcttttgttgttatgccctttcctggttttggtattagggtgatactggcttcatagaatgatttagggaggattccctctttctctatcttttggaatagtgtataatagaattggtaccaattcttctttgaatggctgatagaatttagctgtaagtctgtctggccctggactttttttgttggtagctttttattaccatttcaatctcgcttcttgttattggtccatttagagtttctatttcttcctggtttaatctagggaggttgtatatttccaggaatttatccatctcctctaggttttctagtttatgtgcataaaggtgttcaccgtagccttgaatgatcgtttgtgtttctgtggtatcagttgtaatgtctcccatttcatttctaattgagcttatttggatcttctctcttctttcttggttaatctcgctaatggtctatcaatttttttatctttataaagagtcaactttttgtttcatttatcttttgtattttttttttacttcaacttcatttagtttttttttgacagagtttcaccctgttgcccaggctagagtgcagtggtacaatcttggttcactgcaacctccgcctcctgggttcaagcagttctcatgcctcagcctcctgagtagctaggattacaggcgtgcaccaccacacctgtctaatttgtgtattgtgtatttttagtagagacagtgttttgccatgttggccagactggtcttgaactcctgacctcaagtgatccacccaccttggcctcccaaagtgctgggattaaagacgtgagctgctgcgcctagacagccaccatggcctacctcatttaattctgctgagatcttggttatttcttttcttcggttgggtttggatttggtttgttcttgtttctctagttcctagagatgtgaccttagattgtctatttgcactctttcagactttttgatgtaggcatttaatgctatgaactttcctcttagcactgcttttgctgtatcccagaggtttggataggttgtgtcactattattgttcagttcaaagaattttttgatttccaccttgatttcattgttgagccaatgatcattcaggagcaacttctttaattttcatatatttgcatggttttgagggttccttttggagttgatttccaattttattccactgtggcctgagagagtacttgatataatttagattttcttaaatttgttgagacttgttttgtggcctatcacatggtctatcttggagaatatttcatgtactgatgaataaaatgaatattctgcaattgttgggtagaatgttctgtaaatatctgtgaagtccatttgttctagggtataggttaagtccattgtttctctgttgactttctgtgttgatgaccagtctagtgctgtcagtggagtattgaagtcccgcactattattgtgttgttgtctatctcacttcttaggtctagtagtaattgttttataaatttgggaactccagtgttagatacatatatatttaggattttgatatttccctgttgaactagtccttttatcgttatataatttccctctttaaagcaactgctgttgctttaaagtctgttttgtctgatataagaaaagctactcctggccaggcatggtggctcacgcctgtaatcccagcactttgggaggccaaggcgggtggatcacgtggtcaggagtttgagaccagcctggccaagatagtgaaaccccatctctattaaaaatgcaaaaattagccaggcgtggtggcaggcacctgtaatcccggctacttgggaggctgaggcaggagaatcacttgaacccaggaggtggaagttgcagtgagcagagaccataccattgcactccagcctgggtgacagagtgagactccgtctcaaaaaaaaaaaaaaaaaaaaaagaaaagctactcctgctcacttttagtgtccatttgcatggaatgtcttttcctacccctttaccttaagtttatgtgagtctttgtgtgtcaggtgagtctcctgaagacaccagatacttggttggttaattcttatccattctgccattttgtgtctgtcttttaagtagaggatttaggccatttacattcaatgttattattgagatgtgaggtactattcacttggttggttaattcttatccattctgccattttgtgtcttttaagtagaggatttaggtcatttaccttcaatgttattattgagatatgagctattatgctattcatcatgctatttgttgcctgaataccttgtttttttcattgtgttattgttttataggtactgtaagatttatgctttaatgaaattctaatttagtgtatttcgaggatttatttcaagatttagagctccttttagcagttcttatagtgctggcttggtattggcagattctctcagcatttgtttgtctgagaaagactatatttccttcatttatgaagcttagttttgctggatacaaaattcttggctgataattgtgttaaggaggctaaagataggaccccactaccttctagcttgcagggtttctgctgagaaatctgcggttaatctgataagttttcctttgtaggttacctgatgcttttgcctcacagctcttaagattctttcctttgtgttgattttagataacctgatgactatatgcctagactgtgatctttttgtgatgaatttcccagatgttctttgagctacttgtatttggatgtccagatctctagcaaggccagggaagttttgctcgattatttcctcaaacatgttttccagatatttggatttcccttcttcttcaggaacaccaattattcttaggtctggtcatttaacacaatcccaaacttcttggagcctttattcatttttttaaattctttttttatttgtctttgttgagttgggtttattcaaatgccttgtctttgagctctgaagttgtttcttctacttgttcagttctattactgagactttccagtgcattttgcatttctctaagtgtgatttcttcatttctagaagttgtgattattttttatttatgctatttcactggagatttttccattcatatcctgtatcaatttttgatttcttttaagttggattccacctttctctggtgtgtccttgattagcttaataattgaccttctgaattctttttctggcaattcggggatttcatcttggcttggatccattgctggtgagctactgtgatcttttggtggtgctaaataaccttgttttgtcatgttaccagaattgtttttctggttccttctcatttgagtaaactatgtcagacggaagatctgggattcaaggctgctgttcagattctttggtccctcagggtgctcccgtgatgtggtgctgtaccccttcccctaaggagggggcttcctgagaatcgaactgcagtgattgttatttatcttctggatctagccacccagtggagctgccaggctctggcttggtactgggaagtgtctgcagagtcctgtgatgttatctgtctccaggtccctcagccgtggatcccagcacctgctctggtggaggtagcagggaagagaagtggactccatgagggttcttggctgtatttttgtgcactggttttgtgttggttggcctccagccaggaggtggcgctatgaagagtgcatcagctgcgggagtatagggaggatataaacttaccctagggtcgcctttgggtaagtattcaagtttctcaggtggtggggccgggctatagatctctcaagagattgttttttgtcttgggcttccaggacgggtagagaaagactatcaggctgggacagagttcagcatgtctgagctcagactcttcttcggcagggcttgctccagctgctgtgggagattgggggtgtagttcccaggccaagggggttatgttcccgggggggttatagctgtctctgctgtgtgacacaggtcaccagggaagtgagggaaagccatcagccacaggcctcacttagctcccatgcagcctgctgcatgaaaagctggtctcgctcccacctcccaccatgccacccccaacagcacacagtttatttccaggcagctggtgagcagtgctgagaacttgccccaggctacaagcctcccagctgagaaagcaagccaactcacagttcctcagctgtcccacagggcctgcagcggcaatccgcctccttcaaagggtctgtggtttctcttggctttcctggtatgttcctgcagtagttcttggagcaagttcatgatgtgagtctccacacatggctttgtctgagtgggagctgcaggttagtcctgcctcttatctgccattttttcccccgcattctccctaaatggattattttaaaagaactgccttcaagttcagaaactcttctgcctgatctagtctattattgaagttctcaattttatttttatttcactcactgagttattcagttctaacatttctgtttcgttctttttaatgatatctatttttaaaaatttctcattcagattatgaattgtttttctgatttcattgaatctatttgtgttctctcgtatcttcccaggtttccttaagattgttattttgcattttttcaggtgattttagattggttttcctttggggtctgttacttagagaattgttgtgttcttttgaaggtatcacgtttccttacttttccatatttcttgtttccctatgttgatatccatgcgtctggtgacacattgcctcttctgattttatggagtagctttcatagggaaaaatgtttttctgtatatgtatacgtatcataaatatacagttgggtaaggtgctttggctttggttcagtatgggggcagtaatgtagtctctgatttcttcagctataatcagcatcattggtgtctgtgagtacctcagtggcctgtgctgtggttgcttgtagaggctattgcacggctttgctgagagcagggacaccaggcagatcagtttgggggctccggcagtagggagcatgggtgtatggcaggtctaccactggagtgggcaggttctctgacaacagtgggcctgggtggcttcatcactggaggggtcagggtcactggtgatggcagcagccctggacagctggtccttgggtccctgagggatgcacttgagcatgaaaccgatctgctgctggaggggctggggtcgccagtggtggcatatcttggccaggctggttctttggcacctggagggcatgtgtgggtgtgcagcagttttgctctggagggagcaggttgccatcagtggtgggcctggtcaggcggatccacagtcctatgggaggggcgtctgctctgctactgcaaatgttggggttgctggtggcagcagcagcaggcttcaggcaggtagctcttggattctgaggagtgcgtgcattgcctccctcttttccgtgggcagccttcccactgtattagactgcctgttttctagggtgtggaaatactgtgtgtgctcagattctggggtcttggctgcacagctgctatcatgactctgcatccctctgggtggatgtggtgggatgtcccagggaccccaaggatgtggagatttaggggtttttgggccccagggcaagatgcacactggtggtggctctgctctcaacatgatgatgtgctgtggcagcctgtgtcctgcgggcatgggacccagcttgatttcctctatggaacaatgcaatcacatggtttccaggtagctccctatactgagctcagggcctgtcagggctgggggctctcctcttattaggactacaggcatccagcatggaaatgtggactgctggggatcttcaccttacctttttcctgtgcttgaggtctctctgggctctgagccgatcctagccagatgctttgcttccgtgtctatgctgctgtcccaagtctccatccccagaggggctttgtcacttctttgctgaattccagtgttctcccctagactctctgttcaacatgtgactggaggaggtgaatgctgagtacctctagtcagccatcttgatgatgtcttctgtaacttttcactatttctgcaaatggttatgatactgtaggcctggctgcctgtgctataaatgggggagtaggtctctttgttggagtttgtaaggatcactccgttatggccccagaaatcacactgggagagacataagaaattaaaggatctgttatatatactcacaggacttagggacaagaggcatggcaatccccaccacatagggcccatataggagctctggggagtgggctcaaccaggtagatggggaggggagagagagagaaaacccatggataagtgcctttattgggggcttgagtagagtacacaaacaaaaggtgtgaggggatttcactgatgtgtttgaatgtcactagaccactgtcaggagagggctaatgggaacttgtgacaagtaccagcattatcacactggtgcacctggtcacctggttggagtgcttgtaacctgctggtgggggatgttgagggattgggaaaatatgaatttttaaacatttacagtatacagtcattgcctgttgagatctgtataattaaaagaattccaagaaagaatgcacacttttcttgtgtgcagaatcacattcattatttgaagagtctctacatagtttctaggaatctacagcccaggaccacagaactgagatatagttaagtgtatcacgacaccatttcagaacacgtcatcaactcggtcttgaatttgcagcattcaactgcccagcacaaaattagtgagaaaacaggcataagaaagcttacaggatctgaaatccacagggctttcgtttttgatttacactaaagttttagaagttagacatgattatcatgaaaggagaatgtcatatcccttcctttctattgtctactttttttttctcagcaaccaatcctagaatttatttgaagaggagaagaaatgagtaaatcgatgaattagaaaagtaacgcaatctttttgtataaatactaagttatctccaggatctatgaaaatatcaaaagagagaattattgttttaatttattgtaattaaaaatataagcatatacaatatagcacatttaaatggagctggctcaatatctaaaatcaaaaatcgttctctccttatagcctatttaactttatattctcagcaacttgcagcacatgacaaacattaggcattcaataaatgttggtgattgaaagaatgtttatgcatgtgcttttgaaacttggaagaatgtcacatttacatttctatccttccaccgtctttctgtcctcagtccactgatgatcagatgaaagaaaagcacaggtggtgttagcaaatgaatcagaatttccaaactgtaatgcaggtggccatggacagttgtaggagagagttctccatggcctgcaacatgtggacctggactttgatataattcaatctaacaaacatgtattgtaaatctatgatctgcaaatcaccctgatagatattgtgaggctgcaggatgagaaaaacacaaaacagatgcagttttaaaggttggaaatggcatatttgagatagaagaaggcaagtaggaaaacagctccgcaagccaacagcatagtccccaaagggccattttcagtttgacaaggagaagcactgtcgttattctggcctgtttcctcattgcaaaaatagaaccatgaacctttctcttctgctgataataattttaaagcattgtcagtgaagtaaatatatactgaaagcaataaataaataaatatttaaactccagaaagattgctgagcttcagtgatgctataacaggaaataacaacaatcagatagtgcctcggcttactgaagaactaattcatgtttataaagtgctttcagaatgcaaagcactgaagaaggttaggatattattattattaccaaagatctttaagcagacaagatcttggtattcttataatcacagcaggagttgttcatttcccatgtaatttatgaggagaaaaaaataataaaccccacccctcttcacacttgatttgtcagttgttcttgttatatgaaactgatcctcaagggaaccttaatttaggcaacgatttattctcttcaatattattttgacatttggtaattactacagattttgtgcatctgtctttcccagaagagaaggcattaaatgccacttggatgatcattggttttgcaggaactcagatttgatgttattcttttggtagatagcatgacttatggtaagtttccagctctgggatacacagattgtgcctttcattactcatggagtctgtgccacactgatattagatatttcataaaaataagctattggttgaaagaagaatatcttaaatatttcatatgaaaaaaaactggccttttccaattttccacacgtattctaaagtaactaagatatctggaaattttcaaaaatgaaagtaagaaactggaacagagatcagaaattccttaggaacctctctctaggactctcaaatggacctcccaaagaaaacaaataagacccccaaaaaccaggaacaaggagagttacatcaacaatgagtcagatgctttcagaactgcttcatgctattcctgtacataagcttttttcttatcaaattttatggatgatgatagcttcttccattgtaaattttcatctgtgatcattagttctaacaagtccagtcctcccatgttagattttgcagatttaaattttaatatgaagatttgattattttgtttattcagatcagtaataaatttcaaggcatttacttttggctattgccaatgatattttttatttgttattttaaccagaatattataaactggaaaaaatgtattatttttaagatgatgtctgaatgaattgtgaactactttgtgagatagaaagacaaggaaaactggagggagaaaggggagacagggagagaccaggatggagaaggaagaaagatagaggaaaagagaaaaagaaggatagtatcatgaatgagaagatgtgagacggccatagaaaagaggaagacaggataagaagttggaaaagggggagaccagaggagaaagagggttaaaaatgttctagcataaagaaagcagaatggcagagtcaaatcatacacttctccatggctacttaaggtttagggattaattttttctctctttctctcactctctctctctctttttttttcttttttttctttttaaagacagagtctcactttgttgcacagcccaggctgaagtgcattggtgcagtcatagctcactttaacctcaaactcttagtcttaagggatcctcctaccccagcctcctgagaagctcaaactacaggcacaccccaccatgcatggctaatttttaatgtttaaaattttttgtagagccaggttctcactatgttgcctaggctgatctcaaatttctggactcaagcaatcctcctgcctcagcctcccaaagtgctgagattacaggcataagccactgcacctggccttttttctctttagtgcctggtatagtgcctggtatattataggtactcaataatcatttgatgaatcagtagatgttaatggatcaagctagcctccttctggttccttgagcaccccaggtacacttctcttcttggactgtgtccccagagatttgcttagttcacttctctacctcctcctcacctttttagtaatacctaccccgagcagccaattaggaactgcagctaaccccatactccccactcactgaaatcccctaaccctgctcccccttcccatggcactaatcatccttgatatataatgtggttttgcttatatgttatatttatggtttattgtctatcttcccttgctagaatggaatttccatagggtaggggtctttatttcagttgctgatttatcccaaatacctagaacaatgcctgtacaaaatggacaatgaatatttgttgcatgagtgaatcatccttatcaatatatgtccatgttttctcttgttctctttttctctcattcattctctcctccccttcataatagttgacagagaatacaacctcaaagcatttacttattttctaacttgtatttaacgtcactcttcaatttcagctgcactgcagcaaaatcctgcacacatgacctgctgttcccagaaagggtctttttgtgcatattatattgccatttttgcctgagaaggcctggactgatgtccaaagaacattccagaacactgcagagctacaggtcagcctggctcaaatttgttgaaaagctcttctacatattaattgttttatctgggtattagttattctctctctaaggaaataatcggacaatggctttttttttttttttttggagacggagtctcgctctgtcgccaggctggagtgcgatggcgcaatcttggctcactgaaacctccaactccctggttcaagtgattcccctgcctcagcctcccaagtagctgggattacaggcatgcaccaccacacacagctaatttttgtatttttagtagagagggggtttcaccatgttggccaggatggcctcaatctcctgacctcatgatccgcttgacttggcctcccaaagtgctggggttacaggcgtgagacaccacgcccggtcagacaatggctttttaaggcaatttcatgccatcacaaatccctctggagaactaatttgccatgctagggtagaattcaaggctaatgctattatttggcttgtactctgcccttgttgttgctttgtttaaatgatgagtaggcccagcaatagtattagttcatcaaaaagtctataagttatattcagatagtttgaggtcagcaaaacccagagtgtggtttacacaagtgctttctcccctaatccttaaatccatagatatttcaaagtaaacttaattcatatgttttccattcatttgcccttaggtctttatgtttaggggagggggtggtggaaggcaggaaggtactgttctaggaactggcttccttcttcactgccacagacagatcattcattagccacagacctggtttcttggcagaagtccatacctgtatcctttccagttccctgttaattgaagctccaacctcagcacacatcattgttgctgccaaagaaagtaaagtggaaagaggctgcattttctatcatagaaccacagaatcctagaatcctaaacttgtgattctaaagatcatctggttcatctaccatgtgaaccttaaatcacctcgacagtatcctggctaattacctttcaccctctgattaagcatctccagtgatggagcttcaatagccaatagctttaggaaagactctcagaaggaactgagtcttgttttctgcagcccaaatttctccagtcccttcatccattcagcaagatttaaaaccagtcccctgtgttcccctcatgttctctttccacgaagatttcactctctcccatgatttcaggttctgcactacgtgtgtccttccctggtctgtgcttcctgatccagctaccccgtgggcatcacattctgcctctgatacaaggaccttgagataaaccaaactgactgcttaagctaacccctcctttaaatcttgttatttgtcttgtgttgccatttcaaaaatggcaagatgcatctcaaagctcctcttcctatcacatcccccacagttaggtgacagatcctatcagctgcacctccaaaataggtcccggatcggccccagcttcctcatgtccaccatgtctgctttagtttaagatttggtcgtctctcagctgaactgaggcagcagcctcgtctctcatctcctggcctctgccctctttcttcaccagtcccttttccatgttgcttccaagtttacctttctccagatcatggagatagcaagaatgtgtttatggcctcccatcctcatcttatctttatgcttctttatccgggtcttgtggaaagatggtcagctaaagagaagctaggacaagagtgtggcaacccccaatagaaaatattcaatctcggctgagtgcaatggctcacgcctgtagtcccagtactttgggaggccgaggtgggcggatcacaaggtcaagagatggagaccattctggccgacatggtgaaacccggtctctactaaaaatacaaaaattcgctgggtgtggtggtgcacgcctgtagtcccacctacttgggaggctgaggcaggatgctaacttgaatctgggaggtggaggttgcagtgagctgagattgtgccactgcactccagcctggcgacagagcgagactccatctcaaaaaaaaaaaaaaaattcaatctcatatatttttcatgaccctttgattctgaatctgatctactgaatttgtccccaaactacctggtccttgagggatactgaggtgctggctgacttccctgagcccatttatgcctcttcttaaggtgcagcttgtccaggaggtcctcagcatcctccctgccccctttaagctgtggctaacacagcactccagccacactgtacagcccctgcacactgcgctcctgagctgagtggttgcagagcccttgtctcccattcagaactctgcttatcaactccgagtgtgctcatgcatgcatcacctctccaatgacatcacttgctcatgcatgcattgcttctcccctgcctatcccttatttatgagcctctttatccagcaggtacctctcctgtagcatctgttgtgctgtatttgtagtttgttgctacattttttggaagtggttgtcctttgtgggcaggcacatggtcttagcatcctctgcatattccattatctggctcggtggcacataataggtctcaaaaatgttctttgaaagaatgcatgaatgaatggttgagggaatgaacttctatcacatttccttattctccaagtctagtaacactttctggaaaggaaatacaattattttctctaagtgaacctaagccggtacctatgatcatttaattttctacatccttcagtgagccattctagtctttcagtgattcatcatagaaccttatagaacccttgtcaagctgattgatttataattttcaggatccatattcttctttcaaacaaacagcacagctatatctgatggcctccaagtgcccagcctaataacttgcccaagcgctcacagcccatgagagccaggctgggagtggaccattcaggggctgccctatctgtacctgtgtgccgtggtacctgccctctctgtacctgtctccatggagccttgtaaacatctagttagagatgctgctaaatttaaattgtcattatatttcaccaaacatatttcattaagtcactgataaacattcctggcatttttgattattttccttttcattcaagcaaggatgtttttctcctattgtttttaccatctctatatctgtatccaggaactgagcttacagctaatgatctaattcagatatgtgtaaacctgggtataataattagcccagattggtggaaacgtttcccctttacgcaacccatttcatccttatcaagtacattaattcattggctctggtaatatagctaattaccctgtatattcaggtgctgctgctgatattgctgctatctccatgtgctgggataaacagactgttgttagtaaacattccttctgatacctaccttccgccatcactacgcacgtactaatatgtcttttttgctctgttctttttcccacaacagtttaacctaaaaagggccacttcatttccttaggctgcacttctaatgaatgcagacatttgaaagggtcctgaaccggataacctttcgagttttctccagttttattattctgtgaagacagtttggtgtaaatgatttaagaggttagtcagaatggagttctctgttcaaatgatcttcttaaatttctgtactgagctctactcataggaaacgtggagcttgttgtgggattcacaaggttgcccttgcaagtacagaataccgtgcctgccacacagtaggtccaataaataaaacaaaattaaacaaagttaatttaaacaaaattaaagcctccctagagctaatgattttaacttattaccatataataactagcaagttagtgtcaatctcaatctaaattttcaaggaaaactgccccggtagaaatattgtatttttattagcactgaatttgtactcctaacaaaaaattaatgaaattccttaaaagctgatataaaatgtaaattacttatccttggacaaagaattcagatcttccttatttattgttaagaattcccccttcatcatacctatttgaaagatcttggcttaaactgagaatttgactgctaatattcacacatatggcaaatatgaactaatcagaccacagatattttgctgcattccatggtgtctcatttatttgtttaatttgcagctatagcaactagattccaccactttgggcttttacacagaactacagtatgatcagcttggttgaagtttggcactcgacactctgctcaattgaagacatatgcacaaaatcacttaccacattttttaacctgtttttcacactgggtaggcctgtaatatttgcataaaaatatgaaaagcaaccttctgcagggagagaaggcaattaaaagatgttgcgacctttctttctgcagcatttcaaagcttaaagttttcttggcacgcttttcaaacgcccatctgactttgaagcaggctgcctctccacagaaagcttgctccagcaatgactaaaggattgacctggtgccatgcatgctgctctgcacaagaaggacatttggaaatgaccttgaagcgaagttttgccaagttgatgaaatacgggccttcaagaagtgccatttctcaagcgatgtacagaagggtatccgcagcattgtcaaaaattaccccttaatttggtgttggatgaacatgaatttttaacctccataaggaatgatacttgctcttgattttattagttgcattttgtaacaggttggaaaaattaggtaatggagaactttggcataccacttttgtttcttttaggtgatttttaaaaaacatttgctgaaggagaggttgatgctcaaagggtacagtgataaatggagagacgggagtttaaaatgaaggataagccgcaaatgaggatgaagttaatggatagagaaaagatgggaggaagaggtatctctctttactcgtaagctgcccatcgatatgatttagactctaggagaggggcgtttctttcctcagtaggcacactcatagagtaaactgttgccgctgtttaaacatgttaattgatgttgacaccagttgttgctatacagttttccattttactgagcgatgtatttatgttgctgcataatgtcgcctgattgcacttctcatgctggtgaagttggctgacatttcaggctctggataacatgaagctgtgctttaaccttatttggaagtcagggttagagtggcactggaaggtctccttcagcttcccttcctgtgacctgcctactataaccctggcaaggctgagacagtccaagtttggggcagtcaaggtgggacagcagaagatttcagggtacaagtcatctattctcttatgccagctctcagatttgtatataaaatctgattctacacttcttttaacaaataataaataaataaataggaccatccaacccctctagagctctctaaggagactgtagaagacttgtggccactctcattttaaagattctaataatctccacaaagtaatcctgggaaacatacatctgtaagaccagggaaacatactggcaatagcaacttcccagaacattcctttttacactgcctgggatttttcaataagaaatttggcatttctgtaaatttaaagtgtattcagtaaaattaatgcgtttttttcttaaaagctcaagccttccagactcatcattttgtagttaaaaaagtaagccatgcaactgagataaaagtcaaagttatagattataactgtttgcacaactgttcacatttttaactttttttattttttggagactttttaagagtctcactgtgtcatccaggctggaatacacagtggcactatcatggctcaccacacccttaaactgcagggctcaagcaatcctcctgcctcagccccccaagtagctgggaccacagatgtggaccaccacccctggctacttttttaaaaatttttttgtagagacaatgggctcactatgtttcccaagctagagacaatggcctcattatgtttcccaggctggtctcgaactcctggcctcaagcgatcctcctgcctcagccttcctgaagtcctaggattacatgcatgagctaccacacccagcccctgctcacattttatatagtaacttattttaagaatagtaaagtatttgcaaaatagttttttaatacagtaatttattatatattgaaatcaagcttgatgatatttcattaggttttgctgagtgtcatatgctaagttatttgcttatgaatttttctccaattgcctgtatttggtaagtttgcatggaaagttctgacaggaaactcagaaatatttcattgttttaccctactatcttttttgatgtgtcttaaagttgatttgctttaaattgcagtatcatcctttttttctgtacctaaatgtttttaactgaagaacacaatttccctcaaaaccctcatccctaatttagagccctcttatattaatatgagtcattttaaatgtatttcctgaaacacttctcaacttcgtaaataaaaaagagatatatcttagtccattcaggctactataacaaaatagcacaattgggtggcttataaacaacataaatttatttatcatagttctagagcctgggaagtccaagagctgggtgccagcatggttgggttctgatgaggatcctcttccagattacagacttccagcttcttgctgtgtcctcacatggtggaaggaacaagtaatctctctggagcctcttttaaaagcccaccaatcccattcattgaggattccaccccagtgacctaatcacttcccaaagggccatctcctaatgctataaccttagaggttagggtttcaacatatgaattttgaggggacagaaacattcagcccatagcaggatgagaaaaagaaaggaaagtacaacaaagaacatcaaccataaggaacaccatgacttctgatatttaatatcatggatcacagattgtaggagtcgagaaacagaataaaaagacaaggcccaggcccagtgagcttttgatgcttgaggctcctcatgcccttgctctcccactgacctcagtgctcagcactggctttcttctcctggtgatattttccatttatcttttggtgtaaacattttagagatgagagaagtagggagcttatcattatttagtctgatcagacaatatcttcacttttaagttatgttcagaatttcattgtcctgttctttttaagaatcatatgagattatttttgtgtatgtgaataaactatgaagcattttcttacaaaaaacttcattcagtgtcctggcacagatcctccagttgaacaggggccttctttccaaagccccaggtaaggactttctcaacctgtattctaacatgatgggatgttgtcttctttgctttcctatcttatcattgcaaactctcaaacattttctacattatcatcatttatatttatactagcacacatgtttgaaagcgatatgatccccattgaaaactcttttcctttaaaagtcaatcccatttctagaggtcttgacaatgctttcttctttccatgccattgaagttgcattaatgttggtcaaccctggatggctcgggtctcatactcagaggttctgatggattcagtctgggataagactgagacactatctatttttttttaatgctcccttacatagctcccttacacgtttgaagatctttgaatttgttggtctcacaagcatccctggggttcaaaaaatgtgggtattggaagaacacaaagtgagggaagctgtcctggtgatatctagatgtgagctgaatggagcttatggcaaagagacaaacctgagttaatctgcataatcacgcacacttaactctaatgggttagttatagggtggtatctctgcctcagtttctattgcaataaaatactggcatcatctcaagattctcagaaaatttaattaatattaatatttaatataagattaaaagcatactacaagtttcaattagcattaatcctttaaaatatggagttaaatgatctgtaactaattaaagactgcagttaacaggggacatgagttttttctgggttatatgaaacaaaatataaatcttttatataactcaatttcctacagaaaaaaaacttacttgtcagtgggattttaaagttttattttattttcttggatctcattacttttccatgaatcctataagcagaattacaatgaggtgagtcatagacttaacacttttttggagtttcttctgccaaagcagcttgaaatatagaggattttcaaaaactgtgtttggggaacatgggaaggtatgggaaagaaaggaagggtgggagtctaggaggaaaggaggaagaagggaaagaaagggaaagggagaggaaggaaggacacaaaacattttactttagattacatttaaaaaattttaatgacatttataaaggtaaaactttcctggtatctcatttgcatgtttcagacaaccctgaggtgcaaatgaatttgggtttcaaaagttcattcatgagccagttatttggaactggaaacatgtttccccacgaaagttttgttatataagtggtagttcatttttgaggctagttcccaaactctcctcattctgttttgaagctgaattatcatgcatttacaatgataaacagtagattatacagttgaaaacttgtagatgtaaaaaacataaaagtgataaaatcaattgtttaattgctttaaacttttaacttcagtgctggtgctggagggaaaacagatttaatttgaggagtctgaggatgttcaagacatctaaggttgatatttgagagcatctgtcagagaagcagcagccattctctcgggagggcctctgccgccatgcatgtgcttcaatctggtcactaaaaagccacatccttagactgaaggaataagtcctcaacaaaaatgccttcttttcttcctaggccaggcatggtggctcacgcctgcaatcccagcactttgggaggccaagacaggtgcatcacttaaggtcaggagttcaagcccagcctggccaacatggtgaaaccccatctctactaagaatacaaaaattagccgggtgtggtggcacatgcctgtagtcccagcttctcgggaggctgatgcaggggaatcgcttaaacccaggaggtggaggttgcaatgagccaagatcgtactacttgcactccagcctgggcaacagagcgagactccatctcaagaaaaaaaaaaaaaagccttatttttttcctgtaaccagtatcaatggagcacatattatggctagtgctcctcactatttatgctagcaggcaaaacagaaagaactcctgtccttgtgagtttataatctagtgaaggagacaaatatccaaataactgcacaagtagatgacctatgatccatccatttttataaaaagttgttgtatgaacattcaagtccaaacaaatttacaaggaataatgatgacacacagagggtggatctggagagtggagtacataaatctttaagtaactgctaggggccagccacttccatatgctgtcacatttgttccctaagtagccctgagggggaggaatcatcaccaccattccacaggtgaggagctgagactcaaaggagttgaggaatctgtccatgatggtgcaaccaagagcctgagttcaaatcaagtgtgtccagctccaggcactttctgcccatctaaactgcctgctctgcaaaaccactctgaagagattttctattattttactcaatatgagtgtatccatgcaataatctctttctaaaatttagtgatagaagccatattgcctcacctgatactgatatgttcctttctgttaataagagctgtttccacttctcctctgacacggttagtgcctttaagccgtagccagcctatctgtggcttccaatacagttttctgtctttcattcctaccatatattttgtctgattcttcattttgtcttgactttcaccaccctgagccttttattgcaagctaccttgaccttttgagaagtagtgagaatatatagaaaagaaatagacttctgtggtgtaaattccacaaagctctctttttatatcctccacatgacctagaacagggccttgcacttagaagtgaacaataactattggttgttaaatgatcatagcaatagcaattctgaaggacagttctgcttattttaaggacaaccaagaagttgatggctctggctttatatgtgaacttcatcataaaatgtacttactgctttcctattccttaatagagatttgtctcttgtattttcttctgtttaccactcataaatggaatgtgaaggacaatgatcacagctcacttgcgtcacattcctccctcttgctgtgctaagcccttttagatagtatttattgaatcctcacaacctgattattatcccatttcatggaagggcatactgaaggttagagaatttcaggggtttaggaggaaagtgaggaaataagctttctcctgatgattcagcaagaaataggaaaaaaataggggaagaaaaaggatatatatttcagtatagatgagagatacaaattgctttaagtataatcagtaaaatgtaggagaggctggagaaagtcacaaatgatttatgagggcatgattcttcctgcttatcccctgtatattagtccactctcacactgctataaaaatactactggagactagataatttataaaggaaagagatttaattgacttacagttctgtatggctgggtaggtctcaggaaacttacaatcatggcagaaaaggaagcaggcgtgtcttacatggcggcaggtgagaaagagcaagcatgtgaaggaagaactgtcaaacactcacaaaaccattagatctcatgagaactcactcactatcacgagaatagcatggggcaaactgcccccatgatcccatcaccacccacgagttccctccctcgacacgtaggggttatggggattacaattccagatgagatttgggtggggacacagagccaaaccaaatcgccctattatgttgatgagcacggaaaagtcctctgcaaactgctgtttttaaatatgagacattctcttgtcaggtgatcataacttgggttgacttatacatttctcgaatccatctatttatttggataatttcaagttgagtagtttatgtgtggataaaaacctaaaggtcttctctatggtttctctggcctggcttgtgtttttgggagtcccccaagatgctgtaaccccagtacccctggagaacctgaacgtgtgcttgatgtctccacgtcacggcaggtggcccccagcatgctgcctgtcatcactgtccccgatgctgtcccgcagcagcaccccaaggctctctgggcacatctgcagctctctagaccagaaccataaagaaacaaggttctctctgtctagtcccactggaaagagggagaagccccattgtgagcagtactacgggggagtccctagaaagtgggcctcacccaaagaatgaagaggagtcatagtaagagatttacccattcatggagattggcccaacacatatttatttaaccccttgtttgtgggattgttctggatactgactgtgttcctcttgagaaagaacagccaataaaagaggggaaattaaagctccttggaagggtggagaagtgaagaactctgggaccactctaaaggctgacggtgggagtttagggtggctatggtgatttagggagcaatttctgtttcatgctgagtctagggaacttggaatatttacatatagctggaagaggaggtaaaggtggagtatagctggaggtgtggttagagaaataagcaggagttcagatcctggagactcctccataccaaaaactagtttaggttttaccctctaggaaataagaagcaaggctaagttgtgtgagtacaatgattagtttacacactggagaaatgggaaacaaaggaaacgtgactcagtgttatcctgatagctttggggagttgttgaagagttttaaacaaggggaagatggggtcagatgaacattttagaaggcttccttctccagggctgcggggaaacgttgacaagcacaggctggatttaggaaggaatagaagaaggctgagagtggaaccttggcgactggccaccctgagggagcacgggggaggacacaacacagggaagctgggagggagccctcgccagggagggagaatatcttagggaggaggagtgcagggtagctgaggagagcacttccagaaggaggcagggctggcaacgtcctgggcacacggaggtctgaccagacaaggacagtggctggcacaggtgctcccgagtgccaaagtgaccacaagaaaagccgccagaagaaaagaggagccttgcctggaaaacaaaaagcaattaaacatcttgtcatgtggcatgtttttaggggaaagatgatggatggcttcatcttttacttgatcccgaagcaagggcagattgagaagcagagtctgagggacagatgattttcccctctggccttggctccttctgaccttctattttctcccagtgaaagaggtgctgtttctggcctgtggccttatttagcaggctcagaactttttcccagcttcatgataatggcctttggtgctctttctactgcttaatgtactgtcatccagaataatccttttctatattgatctgaatggtaatctgtaaataaaaaggagaaatcataggagaacttgcagaaaaatgggaaaaagtagttacttgttttgcacatttctggaggggaggagagagaatctttaaaataatctcccatttgtgccttctcatttgtcagcacatcaaaagcaacaaaagcaacacacacacacacacacacacacacacacacacacacacacacaccccaatttgataagttggaaaactggctgcacgacttagagtatatgtctttctttaaaattttctgaaatctgatgtggatatttaagagctttcagaaatttccataggcatgccattagagataagccatttgattctgaggggattcaaaaagggaaatgtactttatctaaagagatgaaattggactcaacttggagaaatggttctctgaccagatgtcatttaaaggcattggactttgggctccaggcgttgactgtttctcaagataaatatgcatctaggaaccaagaagggcattttcaaggattgctgtgagttggtattataatgtgctaagcacacccctgacgtctttggaggtctgagcatacaaatcagacataaatgcttctcagttccttctcataatttctctgatcttactggcaataaaaaaaagaaaaaaaaactcttcaggagcataaaatgttattgaatttgcagcagtcgtcatggttacctgcatagtttcattgctttattaatgtgtaattcctcttatttctggaaatatcattatagtgaaacataatagtctgcagcctcttagcaagtttctctgtgtatctcagagatcctgacaatggctgtgatgaatgtgtgtgtggtttccgggtcacttgcatgctgatgatccagcaactgggacatcattgtttaggaaaagacaacttgaagctaatgactcttgagaatcccttgaaagttcaaatgtttctcgacacaaaagtgctttttttttttttcctgtaggacagtaatccaaggctttactctttttctaactaaaataatttatgtttttgtacatcaaaactttttaaagcaattatttttacttactaaagtcactttgaagtgctcaggaaactttttctgatcaattctttttaaaatgatctttattaaatttgtttcttgtatcatagaagggcttttgggagacactgttagtagaggttttgagcaagtttttctaagtgtattctcccactactcaagaagaagctaaataaaatagttcattaacttatctctcaggccaactgcttagggcatactgatccttatactcatttctctttttcttgggcactcaaccagaatatatttttcagcatcccctgcagttggttctggccatgaaaatcatgagacaatggaatgtgagtggacattatgtaataatttgcagatctgtcccataaacacctcccacagatcctctagtcccttatttccaggttggttggtaagtctgccagcctagatccttgaataattgggtagaacagagcctcactgtaggtcaggaacatctgttgttagagaaaggagacaaaccctctgagatgtgagggttgtgtattacatcagctggtattgccctaactgttgcattgcttgtcaagcatttcttctaagtgggccatatgatctttgggagatagatcatatttttcatccacgagtatctcccataacttctttcatagcctttaaaaaagaagttggtgttgtataccccaggactttcctatcaatgtcctgtgataatgttgctgttttggaagagtcctggagacttgaatggctacagcaatagtggatattttgaaaattatcagaccctgtgacctatgtgcaaagagagccaaaggaaaggaaattaatcttttctggatacttctgtgtaccaagtactatgttcagtcctctatttactctctataattgatcttctatgaacagctatcattccattttacagatttttaaggtgtcatatactttaaataacttcttcatagctaggaggtggcgagggaaaatgcaaacaaaagtttgcctagaaccaaacccagccagcctttctactttgctgttttccatggcgtatgctcagttaatgtctgctgatcaccatctccaggacagaatctgacagctagtaataattggaaacatatgcagacaacgtttgattatctgtggtgttgggaatagatgctctcattagttgttagaaaaattataaaactgacattgttgagttttacattctatcttaagatatcagaacagctgttttaacagataccaaaataacagtcgtttaaaatcgatggtctggaggttggcaggccagttcttcctcatgaggtcatctagggcctgaggctctttcatctggtggcttgtggatcttctgaggttgttcctcatctgcatagtggcagatggcctaccacaccacgtctgcatttaagccattaggaaagaggggatgagagggaagggcacatttctttccagttgagggcatgacccaaaaattgcacacatcacttttgctcccaaaagttgcagggttgcacggacatctaactgcaagtgagtctaagaaacgtcgtctgtaagtgccagtatgtctattcttgtggaaaaaggagaaaagagagattgtgggacaaatagcagcctttgccataccttctttcctgtcccaatctttgataaacctacaaataagaaagatccaaaactgcagtagcagaaaagggaaggaaatgaatcatggaaactaggtaattcagaaattgaaggtctcctttctccttaacctcttccagtgcatatgctaaaagaatcaacagttcgtttcttgcattaaattgctttaaaataagctataactattaaatcagtattcgttgaataaaatgattgcaatgaattgagaatatttgaacaaagactagatgttaaatcatattaaatgattagaattaattttgttaggtttgacatgtgattaaattacaaagcaaaacctcatctggtagagacatttactaagatatacataagtgaaatgatatgatgtctgaatttgctttaaaatactcaagcaaaagatgggggggtgatgaatagttgaaattaaatcgggaaaaatgttagttgttgaagctggatgatgggttcatgggggtttattatgctattctttctacttttatgtgtatttgaaatattccataataaaaagttaaataaatacttgttccaagaaacaaaaataatttttggctgtgccctgattttcatatgagctcatttctgtactccagttaagtgctttcttaagtttccagtgtattatttattctgcatgcatatacccagaaaacttattttcatctaaataattcattaacaatttgcttttgagtcaactaagcaagattttggtgagtggccgcttcatccagtgatagaagggatgtaaaaagcaagtaagataaggcccctctcaacaagtttaaagtcgactcaggcaaataagacagtgccttagataaatctaatttaagagaagtatacaagaaggcttaaatgttaggagatcacatcaaattagaaggatcaggaagagtttcctggattagatattataagctttaaaggaagggtaggcttttgacagatggaagtggtggggagagtaggaccaccaggagaaaggctccaagccaaagaacatgtgatagtttcctggtgacaggaaagaatgatatggttttgagtgtgggtatctggatgtctcattagagtaaatcaggaagtaaagaggatctgactgagaaaattgatactttttataaggatgtatagttttgagacactggtgcatctcaagatgagatgttcatctcaaaatacagtattggagcacagagaaaggttagcgtggatagtcagctgctgaatttgaaagttgaagctgtaggtagagtatgagtttactactgaagagaatagagaaaatatttttaagccagttttattggagtagaaaatggaaattatgacaacatcattgtgaaaatgacataatgatttcagttcacattaaagatactatgagtcactggtgtaacaacagctgtattccctgcccacccccactactgaattctcagtacttccttatccacacagtgcccccatatctctactttatttctcctttctccctcactctaagcttctccagagttgtcaacccagaatgtttccactgcttgacttccattcatctttcaaccgactctgaatcagaattcctttaccacgccactgtaactgttagttatcagtgaccgccgtgttgaccaattccatgaacactttttactcctcagttcccttgactctctgagtaatgcttgacctatcaggcaagtcccactttcttggaactctctcttcctggcctctggttttgcttttccgtttctttgtaggctcctcctctcctggacatttacgtattgtgttgcctcaggaccattgctggactctgcctctcttcctacaatctcttctggagggatttcttcctactccacagtttcatcccacaaaagtcaacaaagcacccacatttatatctcatttgagttctaaacctaccgagtatctcgtggatttcccatagacatttcctatgtaatacatccatactgaaatttggactcccacatccctcccaaacctatttcccgtctcagtaaatatcagtcatcgccatctaccttgctgctcaagacagtaaagtaaatcatttagtttgcagagagtccatgggacaattctatcaggaagcccaagcagatactactttattatgaaatattctttgaaccccagactgttcccaaagtggctgaagtttgtagtccttaaaaagaaaagttcccaaactgagtacagtggcttgtgcctgtagtcccagctatttgggaggctgaggtgggaggattgcttgagccctggagttcgagactgtagtgagctatgatcataccactgcactccagcctaggtgacaaagtgagactgtttcaaaaaaaaaaaaatcttaaaaattaaaaaggtaaatctttctgatgtaacttcattgcttcatagctgtttgatttaggcaccagtgctagctttaaatttaaatctgtggttgcctttgcgctatatatttttaaaggatattgtgggctacttatactaagaagttaagctctttgagtctgaccacacttggttacagacaggactatcctccgtgggtcccacaagtagaagggaccctacgaataatctgagagatgcagatgttgctcttctatccatcagattagaaatccaccagtgtggacatctccaaaacctttactatgcccaacctttattaacgcttaattctcctctttgttacggacctggggatcctttccttcctatcctactaggtcttgagaaaatgaaattaaagtaggcttgcattttattcaatctggaaaggcacaatgatttggtggaaagatagcctgcttctagttccacctcaggaactagcaagttagttgtaaacctgatgagtagagccatccttacgttttttctgtaccttcttccacatcaaacacatcagaacaacgaactctgcttgagtatttgctttgtgccagacactgccctaaataacagatgagggaactgaggcttagaaagttagtaaatggcacaaagatacccagttaatgcaaacccacaatttaaatccaggctattcaagtctactcttaccaactctcttatatcgtgttgccgagaaacgacttctggatttcttcttcctctcattcctactgtgccattgatgtaagaggtaccatcaatttaatttaataacagttttcaggaaataaagtaagcactaccaaatcaagtgtagttatagtgggcctgccttttaaaattctaaccaagtttttttccttcttggtaattccttttttacttcatgtccctgaagctaaaatcctcagggacagctaatcacaaaaaaacaggcagattcttggctattgacttctaaaattgggtcatgcaactcataaaagatagccaggagccagggttggtttttgatttggtttggtttgaattataagacagaatttgttaaagataaacttaaaaaaattctttaatgtttcctttgcatatcaaggactaaagcctgacaattctcacatcaacagtagagtttggggagaattaaggatgatgtcagagaagcttcttgtcccaaaagagattatgttttagctgctggcgggaggagaatctgcagtttaggtgctgaaggaccctgagaaggttctgcattccctcgtgcccctggaatgggagatcactgaaaccccagaagtgttttgagaaatcccagcatatggggaacctggatttgatttctagagcttcacttcccgggagaggaagcaagcagcatcacagaggagtggaaggccgcaatcactagcggaggtgtcccagcaacatggaaaatattttaagattcatgtcccaagaggctgccctgagagagtcagaagggccttgataacctgatgagggaacatcattagtaaatttgatgtgcattctctgtgctggaggctgtggaaacagaaacaatgtctgcagcaaaagcagtgtgggtagaagtctccatcaaagatgagaaggtaatgaaccagatacctcccctatgatgccatgatacatatgggccttcttagaattactatcccaggaaaagataaggaaagttagaactctaatttgatcatgtttaaattctgaatatgactgcaaaataactgaacaagatttaatctcttggaaatggctgtagtttcagcagctgaattactgaaggtcacatagctagacagtcctgtggccaggattctagtccaggcagtctgacttcacagtccattctctaaacctccacactgttttgtactgttctatactctactatctccatgtttcccacagccagatggaatagtggctcgagaccttaagttaaattacattcaagaaagataaagggtgattacaaaattcaccttttgactttccacattaatttcaagatgcatgtaaatttcagtaaaatgttttagactggaagaagttgaagatatattcacctctctccatctctactaccagtgcctaatctatgtcttacctagactgtgccctctaaactggggagattaggcttctctatgtacttaggagcaagaaaactaggaccaatggatggaagctttaaaaacagaattctgtatagaatcagagagagtttctcacagtctcagatatccagagataaaatgaatatccttggttggatccatgagccatatcccttgagatgctgtatcatggatgagacacctacaacaaagaagggaccttatgaagaagaattcgacagaagacatggctggatgattttagccttttacgtctcttccaattttgaaattctgccactttagaatggaggttgtgaaaaccaaattgccttgtgtttgcagagtgggaagtgagaaaataaaaacagtaggtataaagtactcttttagagatggctaccactgagggaagcagagttttattgtataacatggtgggactgagggaaaattttaacactgggaaaaattgagcagatttgtagatagaagaaggaagggaattagtttaaaaatgcaaaactaaaggttagagagggccctgttccagtatccactgttgtataatgtacttcctcaaaacttactggctttaaacaataatcactttgttatagcttaggattgtgttggtctggaattgaggcaatgctcagcaggatgattcttctgttccacatgtggatgacagaggtgactctgtggtctttggctgacattgtcttgtgcccttggtgggaatggctggaagtctgtgctcagctagaactgttgaccagagtgcctacatgtggcctccacagcctcttagggtactctgactttttttggcagcttgtagttcccagagcagtactccaggaggtgaattccaccagcctcttagggtagtctgactttttattggcagcttatagttcccagagcagtattccaggtgaaactaccaggcttcataagccctagcctcagaaggccagagcatcacttctgctgcttcttattggtcatcagtcaagtccctaaggccagctcagattcaagcataagaactagatgcacctctcagtggaaggagtagcaaagaatgtatagccatctttcatcacccatacagacaattgatagaacgaggtcctgaacaatgtgcggagtccaaattgagagcaaaggtagagtgattatctttagaatgggggagggacatgtccacctcagagataaggacaaagaaaaggagttccagaaggtggaaacagaaattttgagatgaagatgagggaaaggagaaggagtcatttctacagttaagtaatccaagcctatctagtagaagaggagtttcgcaaaataaaaattatgctacccaccatccatgtcttttacctcggggttgtttcctcattctgataattttgttgtcactgattttaccagacatgtcttccacagacttctgtctgaagacactgtctgcaagatttttggctgacttgttcaatgctctttgtgtaccaaacacatgtagcacaccaaactctggtgtagtccagggcagtggggcaggtaaattggcttccctggaaaatatgtccatctatgtgccttattcccagttcgtgcttttaagggatggagcacaccagccatgaactaaggctggagtagcaaaacatgaaatctgctttctacaaattatccagataatctcttccaatccccttctggaggaaaaacagagctgtatgagggtgacagtctggcaggtattcaaagctgcagtgaccatggcttggctcctgttgtatccacagagctgtttgattgggttaatttatacagtttttcctgtatgaatccttttgataagtatctttagaagcttctaattcattttaaaggaatgtttctctttggcttcatgtctcattcttttcacattatatattctggtgataaatgatggatccataaatacattacctttgctcagtcagtgttttctgttgttgatgtaaagtacacaaattggatttgtttcaggatagctgaatttggaatatgacattttgccaagtcagcatcacacttgcccatacaacacagatgtggattttgcagttgttttgtttttaaaattgtatatgtctgtggtgctattgattaatgtaatattgcattaatgtgctattacaacactctagggcattcatgaggtctttcagccagcagcaaagaattccccaaacaaaagcttttaataaaatacagattgcagggcaaagaaaagtatcaaccgtgagaatttatggatagcagaagtgcttgaggaatcaacttttgatggccttgccaatggaaataccgtgtaattgttatattatttcatttccctccaaatcattaaagatcatctatatatctattcatttgttgaatctgtgtttttaaatgaccaaggtattatgactgtgttgatccatgacttctctttttcttattaagtttccacttgctccagtgcttgtatagacacactgtcagatccaaaaggtcagcgaaggctgacacaaccacatgtgtgacatggcataaactgcagaaattaaaattgaatccgtcactgtccattgtaatagctggcaggcaactttccacaatgcagtgttgatgtaattctggcatggagtcattctggatctattttaagtaacaactacttttttccttctcaaggtagttcttaatctttaaccattacattttctctatcacaaaaatctggaataatatttttctaaatcaattaactgatgtaaaatttaagtgaataaaaatatcattggtataatatactcacctttgtaaatataggtgccactgccagcctgctaacagaaagacaaatccaactccactcattttcagatttcagaggttggtggtagtattttcaaatatccatttgataagagaagcagaggcagatctttgcttttttggcatatgtctaccatagccttacagtggatttaaagtacagaaagtaatagttcttttaaccctctacaacttgtgagatcagaaagaaagtaaaaagatacaaaaacaaaacaaaaaagcatagaggtctttaatttaaagaaagtttttctgtaaccaaattttatgagtcagcatttttatatcaataatttacggcaataattatgagatcattaagttcaagcatgcagaaacccatttcatggtctttggtaatagggctgatggaggccaacttaaatgagctaggccagtgattataataatatgccttcagaagtccaactagtgttgatgtttagagtggagataaaatagaaggcatttctcttatatttcagtgcctttagatctggacattttttaatgggccctgcaaagtaaatgccaattaagatgtcataagtaatataaattcaagagatattaaggtgctgtccctgtatctataagagtggtacatggagcatgttgaggaacaagtgaggggagttgtatcacaccctccagatatcttctttttgtgaatgcagttcttttcccctcctttgccccagttgcaatgacttaagacttagattccattccatgagtgtcttgctaaaaccaccagatagaataccttccatgtcccaactatacagtcctcttgtgtttttctggtgtttgtattcccatagttgcaaataaaaagtatatttttagttttagaattttcctttccattaaaaaaaaatccctgaagatttgtggcaccactgttatttctgttaatgtcattgcttccatagcagcaagctaagactttgtaagaaactgtgtttacagaaagcaattatctaagtgaacattatagctacatgcagcaaactttcaatttagatttcccgtaaccattacaatacacacacacacacacacacacacacccctactccttcccatttgtgtcataaatacagtgtcatcagctatatcctcatatccaggagcaaggtggaactagttctttgggcttccatagcagaatgaaaactcaggcaactcacattcttggtcatagaaggtgagttcttccctgatctcagaatccaaatggtagtagaatataaaatcaatgagtttgtgctggtccttagggtagatttcaggaaaaattagaaaggaaatgaagaaaataaattgttgggtttttttcacagtacattttgccaagcataaaacataacattgacagacataattcattttgcctaaaaggtttgttgccctcagaatttcagtcagtagagtcatgtctttaatttaggatatttcagagttgctttaccatcttctaggtgagagattttagtggccattctatgaagagatgaaaagagataaagggtaatttctaattggctgtaactcagtatgaaatgagaccagaatgccatctaaagcgtgctaaggaatgcactgtagaggcttttgcttcatgtgagtaagactggcctccttgaatgttccagtgtgccttggtgttactaattttctctgacaaaaatgaattctgaaatctttctgatgaacactgcccatgtcctattgcacgggtaaaaggtaaataggaaataaaattatctttctatagtattttcaagcaacactctttattaaataatctaacttagcaacttgtggccacagaactctgtagccattgggtagaagtacaagcaaaataagagccatgggccactttctcccttcctgctgagagcttacatttgcatggagaacacagccatgaattcagaataaaataaatacatacaaataaaagaaggaaagtgacacatatgcagccaactctgttatataatcaggggcaggaagggtcagtgatgctaggtcttgttagactgtcaaggctcaattcttatgagacattttaaggaatggaaggctgtaatttagtgaggaggaagaatagcatttgtcagatacatccagcaaaatagtggcatcataaaatcaagcaacgctgcagaaattaaaaattaaacttaccatattcatactgcataaaagcaaccccataaaactgtctaatctcacacttcatccatcaaaagcctttctaaaccattttagatattttccccccagctattctaaaattcactttccttatctggaaaatgatctcctaggatccttaaaaaaaatctccatttataattcaggaaaattgccacagccgacagaaatgaaggtggtggagtgctcagggaagctgcagagagaagcgattgctgagaggagatgaagaaagatcaccaccctgggtcctgcagtagccaaatggcagcatctagacatagaggacaagcaggagaaaggctgaggggttttgcctctggagcctgatgtattactagcagggacccctgagtgtctctctgcactgggaaaactgttagttaacctagaaggttggctgaagccacctcacccctgcagttcctgcaataaagaaaacacagcccttgctctgatcctttaacaagaagcaaatgtatatcgttgtgatccatttaccacgtactgaatttaccaaacatctattctatataggtattgaacaggatactaaaatcatggtcacccattatatcattgtggtaggcagactcatgtcccccaaaggagtcctaatccccggaacttgtgaatacgttatgttacatggcaaaggggaattaaggttgtagatgagatgcaaattgctaatgagctaactttaagataaggagattatcctggattatctcagggggcctattgtaatcacgagggtcctttaaatgtgtaaaagggaggcagaagagtcaatgtcagagtaatatgatgtaaaaaaaacttcactggccattgctggttctgaagatggaggagggggcaatgaaccaaggaatgtggacccactctagatctgggaagtgcaagaaaatggattctcccttagagcttccagaaggagcagagccctgacggctcccttgttttagcccagtgagacccatgtcagactcctgaccttggaattgtgagataataaatatgtattgttgtaggcccccaagttcatggtaattggtaatagcagccatagaaaactagtacaatcatactgttgatttcttttgtaagaatgtcagaaattgccttgttcattagcttgcttatttcttaccatctcccttcacactcaagaacgtctcttctaggagggcaaggccttccttgcctgtcgtgttcactgctgtatcccacaagccaggagcagagcgtcaaatacactagttgatacagtttggctgtgtccccacccaaatctcaccttgaattgtagttcccataatccccacgtgtcatgggagggacctggtgggaggtaatttaatcatgggggcagttaccctcatgctgttcttgtgatagtgagtgagttcttttgagatctgacgagtttataaggggcttttcccccttctgctcattcttctcctcctgccaccatgtgaagaaggacatgtttgcttccacttctgccatgattgtaagtttatttaggccaacccagccatgctgaattatgagtcaaacctttttcctttataagttacccagtcttgagtatgtctttattagcagcatgagaatggactaatacactggtcttagtaaatgcttcttgagtgtcaagtgaataattgtatacctaagggaatgaccagaaatcatgattctctccccagagcttccacaaggtagaaacataggaaatagcaaaggaaagatgaaaagtagcaagaggtcaggaacctgaaggagtagtagatgtacagaacacagtaaagtttcagaaaatttgaattagaaaacaaagtgtaaaccctctgtgtacttgaaagagccctgtgatgctgaagaaggtaacattgtagaaaggctgcttgtatacaggaaggagactagtggggtcaaccacagaatactcagttcctttcttaggtagacttactaaagtgccgtaaatcagtttttgtcaggagacaataaaaaatgaaattaacctagagaaaatacgtagagagaaaccaacatggcagagaaactgggtggaacatttattaagtcaaatcaatatggcaaaattgtgtcttctgctatgactttcaaggccttttgactaaaaatattaacatacagccttccacatagatcacaaagaagaaaagtcttaaattttttgaacaccaaaaaggtagaagccaatgtgttttatgaagttttttcctcctaattttttagggggcagacagatttttaaccctatctttgcttgcttttggatgcttccctcatcaacaaaatttagtaagcattttgcacatattaacttatttagttttatctgtgaggtaggcaccagatatccctctctatattgatggggaaactgagcctttgttaaagctaagtgacttacctaaggtgacagagtgagtgagtggtgaagtatggattgaaacccaggcagtttgactcaagagtttactctcttagctgctcttccaccaccagacactggtgggctctgagataaaccagaagcacaccagatccagtcgtttgctgtgggagatttatattctagtagaggaggcatataataaataagaattgcattgatgtgtattgcggctggtgctatgaaggagacatggaccacaggatcctgagagtgaattctagtgtgggctaacccatttgcaggaaccacagagccccaccacattgcaaatttcctagtttatactctgtaccaagagcaaatgaatatttaatgtgaaaatatcccataagtccttcatatgtgaacattaggttaagtggagattgatgagaaggagtctaaacaatttttaaaagttccaacaattggccaggtgtggtggctcatgcctgtaatcccagcactttgggaggctgagacggatggatcactcgaggtcaggagttcgagaccagtctggccaagatggtgaaatcctgtctctactaaaaatgcaaaaattagctggatgtggtggcacacgcttgtaagcccagttattcgggaggctgaggcaggggaattgcttgaacccaggatgtggaggttgcagtgcgctgagatcacaccactgcactcctgtgtgggcaacagagcgagaccctgtctcaaaaaaaaaaaaaaattccaacgtaagtttatttctaaatttttcctttcctgtggtatcctacttgttctgaatgtcctttgtgtaacccagggtttctcagcctcagcattattgactatttgggaccggataattcttgttgggtggggcctgggggctgttctgtgcattgtagaatgtttagcaacatccctggcctcttcttaccagtaacaacccctctttctacaatttgtgacaggcaaaaatgtctcaagacattgctgaatgtcccccagagagcaaaattgccctaggttgaaaaatgcttgcaacccaccaacaattcaaattccacctattcttgaagaccagttttaattgcctcatgcttcgagcccattcttctctccaccttctcaaaaacccacaactacactatatagacagtctttaaagctcagcagatagcattttctgaaatcagccaacccttctttaccccagcctccctgcaggatgggaaggagcacacaatgtgaggaaattaatcaggacttcaagctccctctgcatcacctgtggtagtacaagatttgtttggggttttctacctcactcttagaacagggtctaaggcaatgacttccagacacgttttaagcaagtgactgaccagaccatgaattcctgaataggaattcctgttggtgaaaatgtctcattaatttatagtagcacttcattcaggccttcaaactgaatcataaaatgaaaactcggtgcctcagggtgccacactcttcaggagagaggtaaaacgtatgagtgtagaagagcttcgagtgtgtgtgtctgtgggcagtgagtcccttgaatttggctcctattcagaccaaaacataggagccttttcctcctatcaagtagcagcatggtgggctgacaaacagaaagcagagtgaatttgaaaggcatatatgcccagcataacatctcgtcttctaagacagcaacataagatttctgattttaaaccaaggcagagttaatctgcaaagcctgtgcttattgtgagagatatgacagagggagaaaaaaatggaaccacaatgcagacatctctggatcaacttctgaaaaagcattgtgatcctcaatcttaacaaatatcaaaatggacccctaaatagccccttgaatactctgaagttgttcttagcgcttgtgttttctttttggcagtaaaattacagagaaagtggaaatcgttttaatgtgctaaggattttgatgcagtatcatttaaaatataattgtatgtgtttagttacattgttgcttcattttattaatctacaaataattattgttagctattaaatggcaatcactgtgccagatgctggatatataaagataaataaatatcctgttgctgacttcaaggatcttaccatcgttgaagtgagaaacaggcaaggaagctgacaatcatgaagcaggtttctaagtgctttgactgcacattggatagtataataaatgaggggcagcatctaactcaaacatgaaggttgggagaggagcacaagtgcacaagtgtctggaaagttctttctttttctttcttcttttttttttttttttttttttttttgagatggagtcttgctctgtcacccaggctggagtgcagtggcacaatctcagctcactgcaacctctgcctcctgggttcaagcgatcgtcctccctcagcctcccaagtagctgagattacaggcacccaccaccacgcctgactaatttttacatttttagtagagacagggtttcaccttgttgtccaggctggtcccaaactcctgacctcaggtgacccacctgcctcaggctcccaaagtgctgggattacaggggtgagccactatgcctggcctgggaagttctttctgagaagacaacaatctatgagaacaagttaaaaaattaaaatttattaaatatagttcacttgagactttaatatgtctattttgataattcttatggctctccatataaataatgcaagatggactataatcaaatagaaagctggaatgctagagaaacagatctttcatgagtttctgaataattgccacaacactgaacaaaagtataataaaacatatgcttgatttttcctattaagagactttgccaaagcctagtaaaatactcttgataacttgcctcataaagtaacagaagggaaatgcctccgtgttttcctacatttaatgccatcaagatatgttactgccaaaacatgcagatagtcctgcctggactgaatttagggtgaccagtcgagtctggaatgctcattgctctcaacgtgcagcagaaagagaactggacttgagatcagaaaaccttaatgcaagtcccactctgtcattcactcactgtgacattttacacaagtcatttaacctttctgaacctcagttacctcttctgtaagatggagcttcccaggatggctatgaggattaaatgaaatctaggttattattattaggcctctttgctaattagctgttgggtgagtggatcttcttgtgcaacaatacaaggtcatactttaacctaagcaccattgcagaatatgtgatggggtaaatagaggttttctcccttgtcttcctgccttcccatgccatccaaatcctcctcattgtggccagaatttgatccttatgaaacacagattagtcctatcacttctcagggaactcttcagtgcctactcatcactgtctggatgaaacccaacatcttggtgccatggtcccttctgttctgggtgtgatttttactcaccttcctccccctgcacacctatgcttcaccagcctctccatgcctgttctctccctttcccctccatgtcttggcacctgctgctccctcatattggaatagctgtgctcctgtttctccctacaaactcatcccaactggttcttcagcatgcacctcaaattgtaagcctttcctatgtgctttccatggtgtacaaatataccgtggtgtgggaaatttcccaccctcaatggccattgtccatttacttgtctttctccttcattgacctgggacttcttgggggcagagattgggttcattgcacttcatatccctttgcttcactctcagcctggaacattgtaggtgctccgtaggtcttgttgaattaatgaattgatcaatcactgactgattcataattggctaatatgcacaccaactgattaaacataagataaaataaatagtatttatgatgtcagaatgcaaattcttcattctttaaacatttccaccccaaaagtggaaaaaggtatggatgagctgtgaatcctgatactcatgaggtcactaaataatagtgttttttggcaaagactggtgctagcctaactcagcatccactttctcctttctccagaacaatagactcttatttttatctgggtatgtggccaccaacaataaaacacacaaacaaaaaacagtattttccagtgcaccttgcagatagatattgcaaaccactaagttctggcaaataaaatagaagtggaagtgttttgtggaactatcaagaggactgtttaacgagagctgactcatcaaggaggagccctccttcaccagtgtctactttttctctttcttcgggcctggatttgagatatttagatatggctgctgagtcccagcagcactttggaccatgagatgacctagaagatcctagcacccatgtgctaggatatcaaagcaaaaagatgcaatgggttggttctctgatggcactattaatcctgtagtcccagcctctagacttctttacataagagagtaatgaatgaacactctaaggcagtggttagtaaacctttttttgtaaaaggccagaaaataaacattttaggctttttagtccatacagtctcagacacaactcctcagctctgctgtcataattcaaaagcagccacagacaatacataaacgaatgagtgactatgttagaataaaattttaattacaaaaacaggtggctggctggatttgattcatagactgtagcctactgatccctgctctgaggcactgtgattttgagtccttgtgatatatatagctaaatctcaccctaatgaacacatcttattggtgagatgaaacttttgatttgaaggagagaaactgtcaagactcttgtttcattttaaaaagggtttccttcagtagaccctttctcccttaattgatccttattttattatacaaagttctgacatttctgtttccagactcttgattattaagaccggatgatcgagggcttttctaagtttctcagttccattatgttcagtttggaggattccagcagaatataaatgggacagtcatcaggtatatggacagggaggatggaggacaaaaggcaaggcctgtaggaactgaatgaagaacaccatgctgagaactcctaaaatgtgtttgaattatatgacaaaactttcaggctgcctggatgatagcttactgtactctgttaccagggagattgtacaagctgaattgatgtttagcagcaggacaagagctactcttggagattcttttcagcagagactttacttgttgctgctaggatgtcttggcttttctggtttaacttatcctgtgaatgcagaacaacatagtacagatcaggaatggcaaattgatttctccttccatgcaaactccaactgatggttagtacatagctggaactttgtattgagagagattatgtggctgcgtccaggttttaactgaagtggtctacgcttccctacagtgtcttccccagctgcgtgaggacagtgaggggagaggaggaatctcaaacaggttgcctctcttgatatagactcaagtgacaaggaagctattagggcaccatcatttaaataatctctaatctggttcttcattttacacatggctgtaatattaaggctgggaaatgtaaaataagtcacacagggttctatgactagttagcagcaaaaccactgttagaaagtcaacagtagtattcttcattacacaatacttgacatattcaattgagaagtttttatacttttcattaatttttcataatttatttctaacatagaatagaaccagcttgttggtgttccaacaaccaaacttctagagctcttgttgctggcattttaccagcctgatccttcagactccatttaattttgtgagccccagtcaccttccaatcactgtgtttttttgttgttgtgttaatgatgttcagggtcagtttctatagcctacaatcaaaaacttggattgatatgatggttgcataatattccaaagagtacagtcattaaattgtgattataaattattgagggatggaagtctgccttagtacaccccactcatggtaagatattcaattatcatttgttgaattgaattgaaatttctcacctattctaaatatgtattcttttaaacattatttaacaaacgtctttatggttatatctttccacatttttttttgagacagagtctcgctctgtcgcccaggctggagtggagtggtgtgatctctgctccctgcagcctccacctcccaggtccaatcaattctcttcccttagcctcccaggtagctgggattacaggcacctgccaccacacctggctaagttttgtatttttagtagagacagggtctcaccatgttggccaggctcatctggaacttctcatctcaagtgatctgcccaccttggcctcccaaagtgcggggattacaggcgtaagccaccacacccgaccactttccacatagttttgattacttaggataaattctcaagggtgggattactgatcacgtggtaggataatgtttatggctcaatatgtattaccaacctactttccagaagggctatattgatttacaatgccccatgccatgcttgagatcaccagtttccctataaccctgtcagcactcatgcaatagaaggaagtacaacagctcattgttattttagcgtgaatgttttctcatttgcgtgttgctaattgcatcgtctcatttgcgaattcacttacttgtcttttgcaacctaaatgaactccataaagaatgaagatattaacttatactgactgttaatattgtcctcacttggggtttgttcttttatttagttgtgggatatttggggaacatctttactctcgtttgaagagaatcctgtttaacttcttccaaaaccttgaactctgaaaatttccaacgttgtgaaaatgcttgggtcacctgccctagctgccagcattaattaaccaaaggaaggcatcttacccactactgtcagctaatctgggaaacactttagatacctttccctacatgccaggatcgctttccatggtcaaaaatagaataaaatatcatatgtttcccatcgttactgttcttttccaaataggaaattcgttgctatttaagccaaatctccagcccaacttgctgtccctgaagcaagggtttgacatatccctttacaaatctttagatttcttgcttccactaaaccagcttctaatggtttaaagtatccgggtggtatcctccaccacaaaaacttgagtgtagatagaacataaaccattcttatgatacaagatggcgattcttaaaaatgggcgtcacagcacaaaggaagcccttggcaaaaaggtaaaaatgaaggacgcttcattcattctcaacattttgaaaattgtgtcttttattatcttcctgaacctctgctactttctgacccctgattccatagttttctctttaaccaattttcagctttagttttccctcaggtaacgcagagcaattcaacatttttataatcctttcagaaattgttgctttaatcctcttctctcaaacctcactcctagaccctggctgaaacatcttttggttctgaggaaacctctgtgaactgaaaatatactgaaaactggtcctgtattcgttgttcaaaattaattaaatagaagagttactttccaaaatagcagaactcattagagcatcagaactcagatacacacttatatgaaagggaacacatactggttgacatagagctgaagagtagcaaatgccatatctgtaaagatcagaataagtgttctaatgtaataaagcagatgggaaacattaaatcagaagtcaagagatggaccctagccccaggttgctgctaattagctaatgaccttcaggctcagtttgaggctcaggttccttatctataaaactgcagtcaggccaggtgtggtggtgcatgcctgtggtcccagctacttgggaggctgaggtgggaggatcacttgagcctaagaggtcgaggctgccgtgatctatgattgtgccactgcactcttgcccgggtgacagattgagctcctatctctaaaaacaaaacaaaacaaaacaaaacaaaactggagtcaattggtgattttcaagccttggagttgtttttagcaacgcaactcagttttcaaatgaaaaatataacaaaagaacagatgcctgtagaactcctctgattggaataagggccagtggcctagaatcccaccctcttaactctctcttccactactcagggcttcaagaaagcctcagattattcattatcatgattgttgatacatgaacaggcccagtttttttcctgttctaaaattctctactctcccatggttaaaatatagattatgcttttagattgagtaggttagattagcagagtagcatggaaaacttgtccctgtgcccaggcctgggcattttggggtgtcaccagacagggaagccatgacctctgtctgccttcactacacaacggcattgctatgtcatggcgttttcagaatgtgaataatgacccaactgttctttttgccagatgcttcctttgtcctgtgaactgtgctgcagatcctcccaccttacctcgaattctcaccaccaacctcatcttgagctgctcatgccaacccacttgagacacaccaatctagcttagggggcagggggcagggggcaggtcacaggacctttgctgcttcctctgctggagcttgtcaaagctggccccttctcttatttcaggttccagcttgtatgtcaccttctgagagaagtcttctttgaccatcctaactaaagataccctggacgtcctgttttattgaattcataacatttattactatgtacatatgtatttagtcagtttgttatatttatgtttacttgaatccctctacacgcactgaaatgtgaacccatagagaagagagatcttatctgtcttgtccctcccccagcatccagaaaagtgcctggtccagagtagatgctttgtgagtaacttgtgaatgaaagaatgaacacgagacgttgatattataatctctatcatacagatgcagaaaccgagactcagagtggtttaattgccaactctgaagcttcatcacgggtaagcaactgattctagattcaaactcaagtttgacctaagagcaaatcttgactctgctatttggcctctctaagtggaaccattttcaactgtcatcaatgtttacatctacctgagaggatgctaataagataatgattacaatgacaatgaaaattgtgataccaataactgcttacacttcgagtgtttattgggcctctccttgatcacatgcagagcacacaccacctcagctggcagcacatttattactggttacctctaattttttaaaagttctttcttatcttgagctaaaatctaccactatgcatctttcacccactgatctcagtgtatccctctataacaaacacagtgaatctcttctagctgccaagtagagaaagtacgtggcctaagaatggacttggggtctggatatcactagtttttattgttgttgttgttgttgttgttgtttaaccgatttgcaaatacctagtaagtcaagcattcccaggtgggtaatttacaagacaatttacctgccacgggtgctttaatgagtattattattgtagtttcatcttaattaatagtgatattctttttcttagctagtagataagcacactcttattaaggaaattgggttgtcaccactggctttgagtaattcgttttgtctatgcaagctgtcttcatacgaaaaaggttttcatactatatccagtcccccctccaacttgaatgtgataaggattgatcaggaggaaccaggtaaaacctctgagctccttaaaaccaaggcccaatacaaacctgttcaattttgtggtctctggcttcaacttttggcttttgagagcattttagtccaaactacactgtggtctctgtggtctttgctggtggcaactggggatcttgtatggctcataacttttatctaggtccaaattttctgttctgttccacacaaagaaatagagaaaaatatgatacagcagctaatatttagtatgtactgtgagccaagaattgttctaaatcttttacttggattattgcatttaatagctatattatattctgggaaaatagcataggccctcttttcttgtaatacatttcatgcattttcttcatttcatccttaatttcaatttcctactttatgatattctatcttcctcagtgatatgactgattcaatgcaataattcatgtaacgtgcttacagcagtgcctcggagagacttaacactcaagaaatcctagctgttgtgattactgtatttctttcttgatgctgaacagatcagtatttttggatctagattcacagtggagcatgcagttttctggcttaaatcaacacactgtactacagtcgacaggatgataaggtagaaatagcaacatgctgcagggcaagagatctggggtcaggctttagctctgcactttaataggctgcgaacaccccagcagttcctcgactcctgagagctttgattcctcatttatacatgagatatatgaacctggtgatctctgagatcccttacctcatgtgaaccttccttgacagaatgtgaatttcaccataatgaggattatgtttctgtagtctcagctcacgtagtacgttaaagagaccccaaagcaccatagtggaagattcttcaggaaatgcttggttagtaaggaacatcaggaaaggaccctccaggactcccttctgtctgttcccccatagcactcactagtaggtgaagccatcagtaactaatggggttaggaattatcgggaacggcagtgtgaaatgcaccattggtagtatctggttttttttttgttgttgttgttgttttatgtcaattcgttctgattcttattgcaagggaagtagtgtggcgtgataagaaaagtgctggccccagagtccagagcctgtgaatttcatttcagctctgccactgtctggttttctagcaaatgacattgaccttccctgggccttagttttcgcagttgacaaactagaggattgctaaaaatttctggcagtttaaaaactctctgctaccaatttctttatagaaggacaatactcatatgaaatcctattgacagaaaagcattttgtctcccctttctctttttttttgccaagtgtaaagagagttggtgtggaaaaatatattctcctgtgaaaaggttcattcagccttttcttaatagatcaagtggttggtatttcggctggcttctgaaatacattacaaatcacaatctggaaaaagttccaaagcagctccaagccttcctgctgaatttggatacatctttaagtcttactctgcagctcatccttaacaactgacaaaatatttactttgctcagtacagaaaagggtaacattttccaaaatattaaactaggttggattcagaacacagacaatgaggcaaaaagctggacctctgttcgaagcagtatcattgaatcattttccagagtgccatgagaaacagccttggtggatgtttgtgctccacagtaattctgaaaaaggcagaagccagccagcctctgtctagcagacccactggtgtgctgagcagtgattctcaaagtgtagtccctgtgccagcagcatcagcatctactggcaactggttagagatgcagattctcacaatccatcccagacctacaaaatcagaacgttccaaaatgtggcctcccaatctgtgctgtaacgagtcctccaggtaaacaaggaaagtttgtttccttgtttcctggtactgaggaaagtttgcaaaccattggtttaggcctgtgaaggctacaggtgtttattaccttgcaattggaagtttgaaaaaaggacaagactagtaactcaagtttttgttaatgaattaattttttttcaaatgtaaataatttgaaatttggaggtgttgctttttgaaatgctgtcccctctaagtctttgtccctctcttcccatctccctccccagccccacttcatgcttacggcaacagggtctgaattatatttgtctgtttttaagacagtgaaaatgcactgcaatttggtttaatgtacttgaatgtagctagtaattttgataaaaatttaattgcatttttttaaacagactctcacttgaagttcctctatgatgaaaaggtggacaaaaattgaataactacaatttataatgttctgttctatcaatgagccttctttttaacagaataactattttttataaataaattgtgatttattttaaattaaattactggaaatcagtctagtcaccagctttaattaagaaatagactaccatcataagggctgtagtgttgattttaaaattgcaaataatttttaggggaaattatgatagccctcataagacctcctcctcctcccgaacgtctcctgcctgccctgcctcttctgtgttacgtgcctggccactgcaggaatctgagctgtgacctttgtcctgcagtctcgtgcttggtgatgtcatccggtcccagggtttcaactcctgcatctgttgatttggaaggcacacaaatctgtaactagagggtgatttcgctcctgagttgtagccaatgtcaccaactgcttcaatgtctttccagcgccttaagaccacacatccaaaccggaactcctcatcttttaccctccctttcctcttcccaacatccctatttcctttaatgggcatttcccacccatgacctgccattaagttgagggcaggaaaccaggaatagtaggaggttctggggtttggaactatgtgggtctggattcaaatccaggttggccacctcttggtcaagtgccattaggcaactcacttctcagatcttcagcttcttcatttgtaaacagagaattgtttggagaaataagagaagaaaagtatattaaaatttggttgtgtaatgtattatccaaaccagagcatattgacagtgaatgtggctattgttaataattattccatgaccctccaaaaaagacaaaatcttaagctgcaccaagcaaaacaggatgtgtgttcattctacgtgtttagtgctatgagtaatgtagtaggtcctcaataaatacatgttccctttcccttccttcctgttataacaatgtttgtcttcagtattttctgaatctgcctgtggtttccatccctcctacccctacagctgtcctcagtccctgacattaagaccattgtaatgttctcccaaccaggttccttgccttccatttttcccgtctaatagattccatgtacgtttgccagattaatcttctgaaaccacatctcttaaaccattctctgcctcaagaccccttaatgagtgcccattgcccgcttaataaagttaaaactctacagcatggtatttaaaagtcttcctgcttggagtccagtagctttcctccgacttaattccaagcactgtcctttgtctataccaggttcttggcaaactctaccatttcccaacagccttgccttccctgactgctggagtcttccctcctgtctctgcctgttcaaatccactgtcctttctgctgaagtgtggcctcttccagaaaggcttcccttgtctgcccagtgagaagctctcccccaccctaaattatcttaacaatgttttattcatatccctctcttttttatattgtagttgatcaggttcatgtcttagacatcccacaaggaaggggaatgggaggcagttcaagcctctttgcctcagataattcacacatgagaggaattcagaaaatgcttgttgaacaatgaataaatgactgactgaaagtcatttttgccttcaataattaaatactgccattgctttatctttaagtaagcaaaacttcgtaaaacataaggcaggtattcttatttattttgcttcgtttaagaactaggagattgaagtctttactattattgacagtaaagattctaaaactacaaatgactttttcctgcatcttcatgttgatgttattagctttatttgcctaaaagaggcagcttatttaataattagaaaaaaaaccctgtagctccaagaagcgaattttacatatcataaagtaaaagtcagaacctgcttacaactcaggtattggaaaacacagtttgtctcattgactgcctgtccccaaactccaaactgtatggggcaactttgtcttgcttttcccttgtttctgtttcaattttagaggcgaatttgtatatattttaatgtaagatggctctactctctcttttggcatatttgtttttataattgttttatagtcaataacacatatactttttttaaatagcacatctgtgactaagggaataggttttagcaaatttaaaaaacaaaaaaaattgctccagatctctttaagagaaagctgctcatttgcaaagagatcatttgtaattgccggtgaatcttgtgtaatgatgatagagaaaaccagtcatcattgttctctgacttctgtttcaacatttatccacttgtttgtcttacaaaagtgctcaggtataatgacaagagtcacatctgttcaggcttgccttaaaatggcagttacacattccattcttcttaactatatatatatatttttttttttttgagatggagtctcactctgtcaccaggctggagtgcagtgggatgatctcggctcactgcaacttctgcctccagggttcaagcaattgtcctgcgtcagcctccaagtagctgcgactacaggcgtgccccaccgtgcccagctaatttttgtatttttttttttagtagagatggggtttcaccgtgttggccaggatggtcttgatctcttgacctcgtgatccacccgccttggcctcccaaagtgctgggattacagacctgagccaccacacccgtcctcttcttaactttttaattcaagagatctttttctttgcattacataattccccaaataattctgttagctgctgcaaatatttttaccagactttcatctcagtgtgtgtttttggaagtgaaaatatagacagttaatttttattgaatttaaaataggtaggcctcagaattagcataattttgtgaaaattgtgtagaatctacttaggtggccattaaaaatgaatggagttagcaaggggtagctaattcccatcctctctcagggaactctgggatgtcaaggcaggccaccaaggatcttatttttatgaagaacctagtgccctaaagcaagcttgtccaacctgtggcccgcagccgacatgcagcccaggacagctttgaatgctacccaacacaaatttataaactttcttaaaacattgagtttttgtctttttttttttttttttttttagttcatcagctatcgttagtgtttagtatagtttatgtgtgacccaaggcaattcttcttcttccaatgtggcccagagaagccaaaagattggacacccatgtcctaaagaagataattcactgtctgaacttctatcatcaaattaagtctcttgaacaaaggtaaaagacttcttggaagtcagaaggttgtcccagaaagcaagaattttacctgtagccagtcagtcaccctgtcaacaaatgcttagttatgtcctgggccctggacaaagtgttgagaatgggattggaaacagcccagcagggtcctgtgtggagtatgctgtctggtggagaggagccattacagctgccccgtgcccctgccccgtgcccctccttcatccccatttggccctattggcatcagaggaagacttcggaaagcactaaggagagataatcttaaagtgtcctccagcctggggcctggaaaattctaaattcttggatctaagagattgtaaaattgaaaaaacaaaagcacaaaaacaggcttttagggcctaaaatattccaataaccttgcagagtcttatcctccaaatataggccaaaagagcttgatctctttggagtaattttttttttcaacatggaaagccctgactgatattttagggttctttcaacagggttcttttgatgcaaaaacgaagatttagtggccataggggttgggtcttggaggacctaggggtgggctggcagcatctactatcagggtgcacatgcacagggacccaggacaggccaggaggagctggggccatcgaaggaccgagctgcaggaagaatggaagagcatgggttgtcacctcatggtccttaatgtgactcagcaattcccccagagcttgctgcattcctctttatctgttaggtatctattatctacctcccttaacctcctctctttctattttatctttctctgtagtgagttcaaacactttaaagcctgaaactctttcttcaagtaacatcttatatttaaagctgataaaaactgaactgcaaagtggcagtaggctcagcccctcccactcggacctcccctcatccctgcaccagtccctgtgttacctccaaaagaaccccaaaagcagcttggaatatgctttgaaaaatctctgccctgccctcttagatttggttctctcatagtttactgttctccgtgacctacaatgaccactttaggcccccaaggggctgtattttgtttttttcgcatcaggcctctttacatacagactggactattcttgaatgaagcgcccacctctgaccagtcagttgtggccaaggcgaagatggagttaagttgtacaaaatgtggctaggtaaggctacctctacagcggggactgagaaagacggtggccctctgcaggactgtgtgtgggacaggcaccatgactgccatgtgtgggtggagcaagtgtcccaacaccaaaactaggagagtctacaggcaggcaacagcatcaaacagccacagacccacataagggagagaacagctgaggagcaggaaagaggatttgagtcgccattagagggtgggaccacatttacttggacaaacgagagggactcagagggcttcgactctgggactattgaaagctcaaaaccaaatgaagaaaagattgtcacaaaagtgatgaattggccccaagatgggtgtggtctggggaacagggaaaataaaagtaaccttcatctgctcctttgtgtaggtgtggagctcgcttttaaaaaatgtgttcttttcatttccaagatgtcaagtataaaacgccaactcactttaaatttaagagttcaattcttattctcttaaaaggcaaaggttgcttttgtggccacatgagacactgctttgaaggatgcctggctaagatctttttggcagtgccggatcatgccattgccatgatagaaacccagatttggggccagtaggaggaactgtgactctccaagccaaaggaggcagaatatggccctaagtgggccctgtgcttcagtaggggcaaggcctgactccaggagtacccttggacttggccttaaggcagtgtgaagacagcagctctgtttcttgcaatttgaacaaagcacatgaaacaatttgtacttactactcatatatgaagacttttgcctccaaaatggaattggtttggagacttaagttgtaattctggctttgacactaccttagtgtgtaattgtattccacttttttaaccttttagtttcttttttggtgaaagacatattcacttctaatatatcccaaattgggaatcccagcaaagcattcctacaacctgttgtccattcccttctagcctctctggagttctatcacaaacagataggtgcagcttgttgggaaaagtgtattattttatcatgtaatggacattttcacatttgcaatttaatgctttccaactcaccagaacatgtagaccatcattaatgctaccacaccctcatttaccaggagactgctatgatgtcattgcttgtgtctcaaatgagttaaaccaccatgacagtgacaactcatcattcttctttcagcagataataccatccccacagaccacactccacagaaaaagatgatcaaggcaatgccctttagttgtttttttcttaatccttttgtaataatttcatttttaatgcctctcgtttctggactctcagaacaaaaaaaaaaaaaaaaaaaaggatctttgaccagagtcaaggaggaaatctgtgggtttctgtggtactatttcatatgcaacctgtcccatttacaaggcttcatcattcagtgagagaaaatgacattacatcagattcgatgggacatttcatggtcttattgtcttattttaaaagtaattaaaaatgtgatcctgagctcatagaactttcctaacttataattgactagcgctaatatctcatcttctttccatttaccctcaaacgtggagattggcttctataagtctaaaatagcaacccgattaggtttaaaatctaattaaattctaacctgtgaaagtttaagatcctttaatggtttgctaatgtccctagcagtttcccaatggaaggtatgatattgctattgatacatgaaatgattttaggggcatagtggggaatgattttactacttatacaaacttatgcttattttactatgtgttagtaaaaatttaaatacatattaaagtaaaactataacatgtaagatagttaagttataacatactatcttatatgttatagtttatattatagcttacatattatcatattagtataatatattataatttaaaaatactgattacctgttaaatgataatatttagtgtttgttgaattaaataagatatactattaaagttaacttcacacttttcttttttacactcttttttcttttataataatcatattagtataatcatattacaactataatatgattaatattagtataatattaactgttataaattaagaatatcctatgcattaataagacaaatatatcattatatttttgcattttaataataatatatatgtatcaaaccatggatattattacttagatggtcagtaaaattagtgagtcaacctagaattcattttcaaaatactataatagcataagttgttcttagatataggaaagctcacgaagacagtaagagaataactaaaatttgagaactattaatcaacagaggaaagtctgactcctcaacttgtctccagttttacaccttgcccctctttatttcagcctttcagaaccatttgttgctccttaaatgtacaattaactttcacacctcccattcttgaattaaaatgttggcttaatcacatcacatgtggatgaccttgggaaagtcagttacactctttggctttagtttcctcatctaacaaataggcataaaaataaatgaaccgccacccagcaaaactttcttaaagttactggatatcatatagtattgtgtaaactgtagtaaattatacagatataagagattataatactttatcttaacatctctcacagtgcatagcaagtgttcattacataggtgttagagaataaatgaatgcataccactgatgttcaggtttgaaatggcatttatttcattaagcaagcattcacagaatggcagtacctaatgccgaaatagtggaggaaggattttttccttcaagatagtgaaggagactaacacctaaagaggtaattacaaataaggtattatgctaatttttaaaatagacataagatgaggcgcattgacttagctgggaaagcttcccagaagaggtgatactgaagctgcatcttacaagatggggaggaactatctcgtgaacagagtgaaaaagggctctcttggctgagggagcatgggcatagctatagaccagtaacgtccagcagaaatataatgcaagccacaaatgcaatgcaaaccagattaaacagaagttcaaagaaagtgtgaagttagctgtaatagtatatcttatttaattcaacaaatactaaatgttaccatctaacagatagccagtattttaaaattataaagatattttacatgctttattttgtgctcaaataaatcttcaaaatctggcatttacacttacagcacatgtcagtttaggctaatcatatttcaagggcttaatagctacatgcatgttgtagctactgtgtttgatagcatacgtatagatgatggaggaaaagcccagaatactaaataaaccatgagttctttgatatgcctctggcacagattctaggtggagactggtggaagatgaaagggaaatgtagtcagatatcagagcatgaaggcctcagataccaagtcaggggatctctccatttaatcataaaggcattgtggagcctttgccacctttgaaagattttatatagatcagatttgaggttttgaaagattcctctggcaaatgtgtgaaggatcaattgtgggggccacagtgcaaagaaagttggaggtatttctcaatctgttctgtttctctgtgtttaatggaattttcatataaaccccagcaattagtagacaggcagcccttctgaattagcagtgtttcctgagtttttaattctactccagaacttcatgagaattaagggtatggtggaagcagagctaagaatatcaggtgttaagacagaaagtctggcatgtggacaccctgaggctcaggcggagcagcccatgaagtgcggttcttagtcaaatagactctgtcctccaccaaaccatggtgcacaggcagtacaccatcaccaaatgcatgtgtgcaggccagctgtccctgattgtaaggtatacatcaaagggaactatccaccatcccccaaacaccttctttgccaagatgcttcttacccctaaactctagataataatccttcctttgaggtaaaaattgatttttctagcccatcttttctaaagaggcaaatgtcttgagtaggttacatgtttttatcaccataacctgctaataactgagttatttgcttccctttccctttatggcagaatacaagcttcccaaattcatttttctccccaaaattgcctacttcacagggtcctttcttcttccttttattttgcctttctgccaattttgctccatggcaccatattagctccattggcctataatccaaaattctgcctatcagtacatgtttatgtgtggaaggtggtgcaaatggacatagacacttaaagcgatgtcctttcagagtcacactggccatgcctcctgtttcttctgttctgggagctcccaggcctatgctagtccccctgagccaaataatgacaactggcatgtgcatgaagcagtcagcaagcttggaggccaccaccagagggaggtattgccctctctggtggagttgatatccatgagtctcacttctggacccctgggatctgcccccactccaggcaccacccaaccctcttgtcccggatgtccagaaaggggttgaagcatgaggggattcttatggccatcaccttgggggcacggaccatcagggtggctctgcctcgcactgcagacattttttaaatctgaaatttaaaacccaaattttttaatctaaaattttttacattttaaaaccaagtcctgagattatatgaccttgggtgattattttgctcaaattagaacccaggaaatttggaaatatttggtggtttgacgagataaagaagaagggggaaaatgaaccctgcttatgtattgttaaaaggcaaaccatagacaagttaaatttaacagactttgattgagtaaagaatgatttgttaaccagagagcccccaaaccagagtaggttcagagagactctggccctgccacgtggtcaaagaagatttatggaccaaaaaaaaaaaagaaaagaaaagaaaagaaaaagaaagctgatgtgtagaaaacagaagtgaggtatagaaatagccagattggttacactttagcattcatcttatttgaatgtggtttgaatagttggccacgtttgattggcctaaactcagtgattggtagaaaagtaggttacaatctgtttacacattcagataggttacagttcactatgtgcagaaaactctttaggctgaatttcaagtatgtaagcagtagctttaggctaaacttaatttaacagtatgaatggggaattgccttcactttgctgtgccacatgtaaataattgttatttttttctctagcatgcacatagtttgccaagttagtaaattattagaaagtcttttcttctttcttttaaaaaaagaacctgtactttgggtgagatgccgctgggaagccagctccgttgcctctctggcatctgtccatggtgcttgaacggcaggcaatgatactctgaaaactacaaagacccccctaaacacacctctgcccatctaggtcgggggttggtggtcggcggggggactatgttgctgtgaggagaggaagacttggactttgacagtttttcccactgttaagtaaaaccttaggcaattagccttttcaaaggtaaaagatttctttttataatctcttgttacacaaacacacacacacttataaaagaagaaaaagtaatgttgctcaggaaaattgcaacaatgagattgactcctgttgcttttgtcaattgccttctttcagaaatagattagagtgatgagtgagaatgccataaatatcctaagggagttccccaaagaaaagagaaaatccttcagagttcccccacctggttgggagcatcagatgtctttcaggagctttgcttcaaaagagaagaaaacattgattgagagctgactaggaattgtctttctttgggaaaaagaaatagttcagttattggagaaataagtaggaaggggaaaaaagtacccatccatccagtgttgtctcgctggggcttccctttttttaactgagattttcaagtgttctttctggaatcgggtgagtgaggattcctcacacagatgctgattaggatatttctgtcagaaaagaatggatcagaattagactcaggaacctaaaccaacaccattgataataagatggaacaaaaatgcttggacctttaatttagaaagtggcctttcatgactcatggtggatatcccatgatacataacatgagcaaacgctacttgggagatgaggatgaaatgaactccaatcagattgtcttggaatgtggcaaagggattattccctctgagttaaatgcacttcccttcctggggcgggggtggagaggcctaatcattactacatagccctgcatgcatgcatgtatttattcattcattcatctgtcattcattgaaggcccactgaaagttagatgatgtggtaggaggtagggatttaaagatgaacaacagatgacaagctgaaattctagtggcagagtggaaaatggtgacatacaacctaaggtggtaggctatgccccgggtgctgtggaaactcagaagacaggatttttcatcaaatgagatgctttgaggactttattccatgcaagttttttttttcctaaatagaatttagtatttcctttcatcattgctggtctctgtgaggacatacgtgtttctgtaacactggaagaaggaaaaacatctgaaatttgtatagataccttttcgctttgtggcatgtggtcatattttatagaataatggcagggaaggtatgtgggaaatgtacatatctacaggacttttctgacctgaagctaaacctgtgcatgagaaggggagtacatcaaagaagcttctggaatggaaaatggtggcctttttctgctaaatgcctccctggcatgccatgttcccaggctccccatctcactctcttctcccctgattcatttgtaggggaagaagaaaagtctaggttcctggctgaggcccctataacaaagataaataaacaacagaaaaggataccgttgtatttaggttttacgtgacatggatgccttcctaaggtaaaggaagacctgaagaaacagggaaaccatgtattttttatgctaggtttaacacagaagtggatagttatgaagtataattggactaaaaagtgtgatctactgataataaactggaggaaatcctgttttttccaattcttctcttcaaagataaagatgcttctttcctctggatctagggagggcacctctccaatgagggtctcccaagctttgcttcaaagaaggtagggcagggaagggaggagatgagaagaccttcctacttctgccattttcccaaattccttcagcttaaaatattttcgggtatatatactgaaccccatcacatttttattttcttgtatttaataagccccaaaaatgtgaggttttatttgaccaggatatctggtttctgtttcctttaatcctgggaagccttcttgggccttacgagttgtgccagttctcatgagttgagcgcatacggctggtgtccctcctggtgaccttcgcagccatctgggctggggcctgtgtctgtccggctcagcccagcggggcagggcctctgccgtgagtttgcagatgcctcattcggactccgagtctgtgactcacgccatctgttggtaatttgtcgttgttctggagtcaggagttttcaaaggattcagtctttggtgtcccttcacaggtgcactgcctgtgattttctgacaccctcttgccatccggcctatggccagagcccagcactgagtcaagctactgtggatataatgatgttgttctttgcactttagagagcttcacaccaagttcctgcccccttctgagcgagtcacactctttatgggacttgtttgaagtccagccaagctggcaaccgtggggttccacttttacaacctctagcaacagtaggctccagtcctttgtgtcaccgtgccatctgcttagcttttttcctcttcaaactgtaagcaaaatgagctacctaaaccaaaaaacgccaccccccaactaaaacacatttgcatcaagtcaacctaaatgacactgctttgtttgctctaaaccacatgtataaaagaatttccatacttccttaagaaatttttttcaccaaaaaaatagacaaccatagtagcaattatattttttctacacaccaggcactgtgctacatgttttatgttcatgattccattttattctcacagaaacccagtgaaggaggtattatcactatcttggtttttttgcatgtaaggaaattggggctcagacaagttaaataacttacaatgagtatgctaccggtaagcaaggcatctaaatctaaaccccactgcctggctctacagcacaagagtttaactgttttgtatactgcacccactccttgatattaataatctaatgcattgaagttcaatgcctttaattaatttttcagtccttaaacatagtgtcacacatccattagcaatccccatctatctatccaacagatatttttgagcatctactgtgtgccatgtaccatgctggacccttgtctcttgaagcttataatgtagttgaggctacaatttattctataatgtctcatgaagaagtcttgtctcatgaagcttataatgtagttgaggctacaatttattcatttaataaacctttataaggaacatacggtatgcaggcattatgctagggactggggctatgaagtcaagaaagataccatctctctcaactaatatatgataaactcacgattaaacttgaaatcagaaaagcaggatatttagtatgtattaccaatatttagtatgcatgtcctggccaaatcattgaacttctctctcccctagtttcttcacctattcagtagataacatgtaaggttaccaccaactttggaaaaacaatttctactctaaccgaacctagctttgaagtaacttttctattagaaatgtaggagaagagaaaagagctgagtctgggttcatgagagaagcaggaaaaagaaattatgaagtatatcagccaggaagcttttggctacaagtgagagaaaacatgaccaaaagcttgaaaacgtagaagtctgttttctcccataaaaagaagtcaaagggtaagtgtttctggtgttacttccattgctcaacagtgtcaccaaagacccattttatttatttatttattttttatttttttgagatggaatctcactctgtcacctaggctggagtgcagtggcacgatctcagctcactgcaacctttgcctcctggtttcaagccattctcctgcatcagcctcccgagtaactgggactacaggcgcctaccaccatgcctggctaatttttgtatttttagtagagacggggtttcaccatgttggccaggctggtctcgaactcctgacctcaggtggtctgcccacctcgggctcccaaagtcctgggattacaggcgtgagccaccgcacccggccccattttgttttcaggcttcctatcaccacccttagtgttggccttttgtgctcaaagttatggtctcctgtccacaaaatggctcctgttgtgcccagaattattttctcataacaacaacccaggcagaaaggaatccattatagagaaagactttcttcatactatggcatttgtttttgttttagttttcactctagaaagggagccctcccccagccaacttttccttttatctcattggctacaactgggtcatatgttgagcctaagccaatcataacttgtcctttgggtctgggggaggggttctgcattctctgaggtcatgggatctctaccagcttaaaaaaaaattatgtttcatttgaaaggaagaaagtgaatagacaattaacagtgtctgtcatagagttggttggaagcagacacgctagcaatggccatttggccctagaaaagctggaatgtttgaaggaactgtaatgagtgggaatgcctaacaagtaaatgctagaaaagatagatcctggagcaaaacctttattatctaaaaagattttgtccctaaaagggaaaagtaggggataagattgccactaagagactcctataaaatctgtatgactagcttgtatttgaaatggaagagaaccagttacaacttccctttcatcttgaatccagacactgtagacataattaccaggatagattgacactggggcagcctaaaagaacctcagtcatccaaaagtctttattgaactggccaccatgaaacaaagatgactaagacacagtccactcatggcagaatttttaggtattgatgaatttccagctgtaattgcagcataatacgtgctttgccaagggtgtgcacagagtacagttggagcactggggagagactggcaacactgcttggagtggggcaggtggtgatgaggggaggatgtatagcggaaatgacatttggtgtggcccctgaaggaataaaagaggcattcagaattgaaatgtaagaaaagggcaatcaagtccagtggaatctcgtaacagaagtgaaagtcctctgaatatttctgagcagatattaatgggaaaaccttcacgacccacagaacccatgctaacactgccactcagaaatcttgtgctcacttcctttgttgggtgagactgtggctgtggcttcagaacgaggagatggtggatgcttgtatctggctgcttgttgatgagctgaggcgccaccactggctggaacagcagcccctgaagaatgtaggaaggaccatgtgttctatctcccacctctttcaccacacgatcttgtttccctctcatcttcctgcttccacatccatgtttataagtctaccttactcagtaaacttctcccccttcacattaagacatgtgttattgcatcttggtctttcctgtgccgtatcacaagacctgacccatggcccgtgttcaaaatgtggattttggacaattggatgatcaaataaatgaagtgagaagttgggcagagggtggcctatgtgttggccacatggacaattagaactcatctcatattctcctggcttcattatattaaccgtatctggctcaggatgtttacctgactggaacttgtgaaatgtggcaacaggcagaaaagcagaggccaaatagctccctgtaattagatgtatttaacactagaggttccaggtagaatttcactattacctaaagcccatctaaaatggacaaagagaataaatgaaccaagagcaaacatttattgaaaccaattatgaaagagagtatgacataggcgatgaaggaacagactcttcagccagacctcctgggtttaaatctcagctgcattgcttcctggctgttttactttgggcaagtcacttaacccctctatgcctcagtttcctcatctacagaataggaatgaaaatagtgaatgcctctaaggattgttgtaagggtgaaatgagtataggtggtgtagtttcatattacaataggccctggcgaatacagaatactgtacaagtgctgactacttgagtttcagaacaaccctagaaattaagtataacttttatatgttacatatgatgaaagtttagcttggagaagttacatgtggcaagtctattgatcttaacatggcaagataatagctgggattttctataaggattttctcaatttctacataaaacatataaaccacagccaccctgttctgcctaggataatgaagttatgacatcatagaccgagcacatcatccaatctttgctccttccctctggaccaatggctagtggaattttcccaacaattaaagctatcactggtaagggagcatttgtttgggtttggggtttttgatttttaaaaaatttccaatctgtcatgaaccaaaatctgtaccaaatataataaaaaattactagaaaaataaattttttaaaaaaccagacaatattcagggccaacattttttattggattcaatgggaaagtggctttaaaaatccttcaagtgcttactctcaattcccgtacttatctttctgtgaatttataccaatggccggccaccagtctgcagaccatactctatgagtatctgacttaaaggacttccatgaagagttagttactcctcagatggaaatgatacacattcccgtttgctcttagcttgtggagaagttctcagatttctatagattttcctttacaaacattgacctgatgtttgtgaggctacctggagaatctctatccatcagcagagggtattagaaaagtggtctgaaaaaaaaaaatcaacaacaacaaataaaaccataaaacacagcctttacagttaatcctgtgctgggctcaaggtaaatgttagtcacttttaacaaaggctcaagacagccctggaagtccttgacaaggaaagaaacaagccctgggagtccttgagaaacgctgtttcagcgaacaactattccaaacccctatgtgaaaaccctgaccctggtgagcaagactgaaccattttagacttgcgtggagcccttttgccccttggcctgtatccctgactcaaaccagactttcctgacaacttttccctcaggtccaaactcagacttggctgtcatcatcttgccacttctgggatgaagcattaagagacagaaagaaagtagctagggaaagagttcatttccatgccgctctactgttaaacttcctatcaaaagcttcactttgtacttcattttatttaacaaatacttccactgtgctcactgtgtgtcaggcactgttctaaggaatttgcaaacatcaactcattataatactcaggaaaaccctgtgggtgggttctgtttttctccctattttataggtgagggaactgaagcacagagcatttaagcaatgcaagtcgagcatccctaatctgaaaacctaaaatctgaaatgctcgctcccaaacccaaaactttttgagaactgataagacaccccaagtggaaaacttcacatggagatacctaacacaaactttgttttatgcacaaaattgtttaaaatatcatgtaaagttaccttcaggctgtgtgtataaggcatatgtaaaaaataaatgaatttcatgtttagatttgggtcccatcgccaagatattaggtgtatgtaaatattccaaaattcaaactgcttatggtcccaagcattttggataagggatactcaacctgtgtatccctaagtcacacagctgtgttttgatctctgtcgacacgtctccccctccaggataaagaggaaaagcagtagggagaagggcttagaatgagcacgagcaatagcaatgtaaggagaagttatcctcaggccaggagaagcaagaacgcagccaaatttcagaaacaacaagggattctagtcactggcaagagaaaacaaactgaagactgagtggcagggttgctgtgtaatatgaggaaaatagaacccaagccactatatttcatgaccaagctcaaattagcggacgtgataacccttctataataacaaccataataataaaatagctatgctttttgaaactctactgtatggcagtttttatatgtaactttgtttaatccccacaactatatggggaagggggcattatccccatttttcagatgaaaaagttaatcaaagtacaaagaggtaaaatcacatgaccataatctcacagctagttattggcagagccagtatcgacatccatttctgtctaactctaaaccatgggttgttttgatgcagccacgttgttagagttagtgacccagtgccattataggggtgcttaggagaatcctaaatccatatgctgagtcaccacatgcccaagaagtctcagaaagatggcacctacagataaacctaaattagtttttttaagcttggaaaatccaagaaagataaacttagcacccattagcctgacacaaaacacttccattttttacaaatagtaatgtttcatgcatctctgcaggaagtgcatgcgacatcatggctgcggatatgcccccatggagagcccttgctggtcctggggtatttgtctctcttatcccaggttgcgtgtggttgtagaaggtgaagtgctgttactgagactagcgcctatctgatggcctatatgaatgacccactagagttattgggttctgccaacattatttccatcctagatctacaaaatgtttgtgggcagatagagctggttcctgagatcaggctagacggtgtttttcatactccacaaggcttatataaattcactatcttccttttagaaaaaaatccttggtccaacttcttttcagtacttgataaataatcagttgatgatgtgggaacatttgcagctgggtatgtaggtgctaaagccttattacatgcagagttggaattataataagacattcaccacttatctaaaacaattcaagaggacaataaaagataaataattctagaatgcatcatcaggagtgatattctttctatgccaaatgagattatgaaaataacactaatagaagtttcaaaaaaaggaagcctgtacattcttggaattagcaaggtgcttcccataattatacacttgcttggaaccctagccttttatttttttcattgaatagcctcccagttaaaaataacccaataaagtatcatagactacaaaatgcccggaatctttttaccaggtgacatctcatctttcaagatatctgatcttaagtcaccccaaattaacttgtacattttatttggcagtagacagtggtaacataggtattgttaaagtattgatataggacagtggaggaaggagactttcgatgaattgatcaagaagaaaaagaactctgtgttgccacctggttatggttcagaagtattgccctgaactgccatactaccactgagggtgaaataggaaaacatatcccaacattatcaagcacacacctctatgggaagactgcatatgtggcactcatacctcatctcccctcctgctgccaatacagacatagctaatccatcacaacactctttcctgccaggcctagatttgccatcaaaatccttctcacctcagtgcttcaggcaggtcctttcaagccatgacagctgggtcatgagttgaaacctgtttactttctatgatcagcactagtaacgcaaagatgagtacacatgacacctgccctcaaatagctggcagattattgagggaatcatacccagcagcagttataatattgtgagataaaatgatagaatgtatatgttaaatggtactggaagacagaaggaggaataactattcctgaaggaggtaaggagtgtttcccggaggaaatgaacacagacgagattggcaggatgtgggagttcccttatcaatcaaggtagacaaggggtggaggtaaatggcatggactttgcaggtgcttccccagcctaggggctgagtggaggaatagcaagaggttggggggcagcctcaggtcaagaccttgacctctttgattgctaggtaagatgttaagggtttttcttgcagaaaaaatcccagtctaaggtatgtaaaccccttgggggccatgagattattccaagggctgcatgaattcacagcacactgagtaggctctgataacgtactaaatggatcacatgggtatgggctttaataatgtcactgctgagaatgcactatatacttgtagcagatgatatagcaaagagaaggctttcaccttcaatggtttgctctgaagtttcataaacaaaacactgtgagcatcaaggtatagtctggagagctgatttaactgcaaagaggtgctgtctgtgcaggctctttagagaaatcttgggatctcagtgtcttatcaggtgttttgtgatatgttacaatatcaagttaattcctctttttttgaaaaatgtataaattcagcttggggttcacaagctccaagctatgttaccactaaagcctttctcacaacccaaagcacttgaacttaccttcactctctgagaggtcattatatttaaatagctactctaagaaggaaatatgctcagtccttcatttgaacaacagtttaaccttcaaagtagaaaaacaaaacaaatctgtaatatccctgtcactaaatcagcatcattaaggatcagcagccattgtctcttttagttggagaacggtgggtcacccatctcgaagcccagttaatgaacaagggtttattcagtaaaacattgaacattacccaagttaatattataataatctcttatattagtagagtatagttggcaaaacactttctctcacatacattatatcatttgatgcttacaataaccattcaaggtagatggaaggtattattcagtttatttcagtggaaagtcctaccactatccaaagtctgaatttcttttttaacaaatacagaagtatacaaaaagaaaaagcaacacagcttccagagaagattttgagtgtgtagagtttcatggtgatttgattttttcccctgaggctctgcactaaatttactgcttctttcattttattgataccataatggaatttgatacactctaattcagaaactgaaatgtttattcatttcatatgtcagtacaaaaatccaatcaagaataaatattgcccctcccaaagctacagtcatacagaatgataattgctttgaaaagaaataaacaagtttgggatgagggtgctgaagcagtcccaaaagtggggctcttcatccagctttttcctacagaatcatttcagtgtttctatcctgtaaggaaaaacactggaaacttgatgttttttgctctcatttattgaacactttccttgggagcctgcaaacatcatctgtaatccttacagcaacgcatagttggtgaattccttcagcagaggtattttatgaggcggtatagcttatcagctaaaagcagaggctttcaagacatatgggtgtgtgttcaggtcacaaagatcggggtttagggcacggttgtcccatcttttggcttccctgggccacattggaagaagaattgtcttgggccgcacataaaatacactaacactaacaatagctgttgagcttaaaaaaaagttgcaaaacaaatctcctcacgttttaagaaagtttagaaattcgctttgggtcacattcaaagccatcctgggctgcaggtgggacaagcttggtttagggcctcacttctgctcctaattgactcaacttaggtaaactaccgaagccctctaagtttcattcagtttcctcttacagttaattaggaattgtattcatttgttttcacactgctgataaagacatacctgagactgggcaatttacaaaaaaaaaaaagaggtttaatggacttacagttccacgtggctaggaaggcctcacaatcatcgtggaaggcaaggaggagcaagtcacatcttacatgggtggcagcaggcaaaaagagagcctgtgcagggaaactcccccttataaacccatcagatctcatgagacccattcactatcacaagaacagcacaggaaagacctgcccccatgattcaatcacctcccactgggtccctcccacaacacatggcaatttaagatgagatttaggtggagacacagccaaaccacatcaggaattaaatgagacaatctgcttgagccattcaccacagaaatttgcattgaatgataagtaaatgtttgtgtgtggagttcataaaataatagccaacatttactgagcacttacataccgtgtaatgttctgtgtgttttacatataaaaactcatgtaatcctcttgacagccagtgagagaatgcaaaaggtttagccaactatgaacaaaagaactaactgtgaaattagaaggaataatgtcctcatttcacaccaattgctagttcaggggttcccaaaacactctcggcttcaaaaatagaacagaaaaaaaggactcacagaacccactggaagctgttatattcatggctatggtttatgacaggaaaaggatacagaataatgtcagccaagggaagaggctcatacagcagagcctggaaggggctcagatgtgcttccagttgttctgtccccatggagttatagggcattaactcctctctgtgatgctgtgtgataatatggatgaaatattgtcaaccagggaagctcacctgggctttggtgtccaagattttttttttttagacagcatctcactctgtcgccaggctggagtgcaatggcacaatcttggctcaccacaacctccgcctcctgggttcaggcgattcccctgcttcagcctcccaagtaactgggactacaagtgcacgccaccatgcccagctaattttttgtattttagtagagacggggcttccccatgttagccaggatggtcttgatctcctaacctcataatccacccgcctcagcctcccaaagtgtatccaagatttttagggggacttgatcacatacttcccatattgctgacttttagtttccagttatttctggaggcagaactaatacctcttggtttaaagaccccgtcataaatcactgttagactgtctggtggctaaagccctaataaacaaagacacttctaccagccaggactttctaagggcctagtgggtaccttccagtagccaagggaaatggccagacatctctttgggtaagtttattcttcactgttaatattattcccatttgatagaggaagaaactgaagcacagaaaggttaagaaacttgcctaagaactccttgctggtacgtgagagagccaggattctaaaccaggcagccttcctctgggatctctaaacatttctccttgctgcctaaaaataggttcattgactctgctgaaatcagactgactgctggtaaatgttaggacctggtttgaatctgggtggatctgattcaggaggtcttcatctttccattttcctctggtttttccttacaaaaacatgagagcctcactgaacaccgtctaaaaggctcttgcgtctcatggatgaagtactaataacccatattgggttctgcctctggcaaactgagccatgctgagcatcagtatctatctcaaaagtacttgtttgtggtctcctgggagtgtcttatgactattgagagtcaatggagtttttatgagcctcgaaaataatattatccatggggctaataattctgcattatttctgcagggaaaaaaacagaaaactcctaccagtacataccaatatctgcaagtaaagttaaaaacaagggaggatattgatagtcatgtgccctaagtatggaaatagagctagggtttgccgctgtttgcatagagtacgtcacaatggaacacataagggccttccttcctcccatatttttgaaggcacagttttatgtttcaggaggctgtctccagtaccctcaaatatagggtgtaattagagacaccaagctatagcttgttgctttaaagactatgtctcagttgctcatcagggctcgctggttttgccagtagtgggaggagatcaacaccttcatcaccagcaccctcagagaacagcttttctgggtaaccactgcaaacagagagggatcactgatgaaacccaaaggggcgggcatctcccacccacagatcagctttgctgatgtaaaaggccagctcatcctgagccacgagtcaagctctatgagttccgttacctgaatacttgttgaatcaaggcaaaaaataggtgtgcttcatcctccacttcctatccaacctcatcagttaggtgaatttctccttcatcagaatctcagagtaaggcatgagcaaccatatttttaaaagtcccacaggagatcctgaagcacagcaaatgtcaagaatataatagatcagaaattatgccattttaaacatttttcaaaaaaattgaaacaaaacaaccctgtcacctaatactagttttcagcatcgtgggcaggttcattctttagagggaaatgaaatgaccaacccccacttatatttaattttggtttgtaagaggggctgtttgtgttaattaaaagtaaagtatataattatataggatgaatatgttaaaaattagggtaagtttaccacaaagtaatttgattgtcacttgtaaatacattgcagtttttacagtgttttcacctgagatgttaatgaccacagcagaagaaaatcctaaagctacatccaggtatagagttgtcctttgacttgtacaccttctgtggggacaaaaggttggtttgaagctctttcctcaatacactgtcagtaacatagtgacggaatgatcagttattaagtattcctcgacgacgacgatattggatatccaggctgggttttaagtcctttcatgttgtaggaaagaaacaagcttgggttactgaagttattatgaacctagtagggggatgcatggacataaaaccagccaggcacctcacagccaggcctcgtggaggggtgaacattgttcattgtcgcagccaggacaggacagtagctcctttcatctgacagtagttctggaaagccaataacaacttagatagcctcccaagttcaacacttagctctccaatctctgctcctttttcttccagaatggacttcctactgcactaccagtacatggtttctccactgttacagacgacccctctcctgatagtttgcgttactcagagcctctactgtcttctggcttctgcctacttccttcttgtgtcttttgcttcaaccccccctatgtttgctgatgccctatgtgtgtttcatatgtaaagcctctaaaagaaagaatgtgattggggtcaccagtcataattccgtattatgcacctccattgggcatgtagtgaatcaaggaggtcaccctaggggccactacctgcctgcagaaggctgtctttggatcaagccctggctccttgtccagctggctttgaccaggaaagtggaatactgagatgtacagccgtggcaagcaatgcacaagaaatctagaaaaaggaaactgcatgtgtggcaggcaccatggggcctctaagcatggtggcctgcccggagcaaggcagaccactttggcatccctgctggttgagcccaggcgtggtcccctgtcttggcctagcaggtgcatgggccctagggctcagtcactcttctccatgattgtgatcacttgtgtcttctttccttctcaaggctggccctggaataggaagcagctctttatgttattccacacctttcttctgtggaatctcctggaagaattacatgatttttacgttttaaatgttttcatgccacttactctgatctgagcatgggataactaaaatgccaatgggcaagttataaatttcaaagatttcctatgagtagtttatattgaaatctaaacatttttaataaaaaatatatccacatgtaaatctccagaacctatgaaaataacctattatggcaaaagagtgattattaacatatgtggcataaaggcacaattaagttcaggatcttgagaggagtttattctggattacctgggtgggccccaaatgccatcacaggtgtccttgtataagaaaggcagagagaagttagacacacattgagcaggggcagaggcaggatgaccacagagacagagattggagtgacgccgctacaagccaaggacttccagcagcctctagatcaagcttgtccaacccacagcccatgggccacttgcggcccaggacagctttgaatgcaccccaacacaaatttgtatgctttcttaaaatattatgacgggttgtttttttgcgatttattttttatcatcagcaatcattagtgtattttatgtgtggcctaagacaatcatttttccaatgtggcccaaggaagccaaaagattagacacctctgctctagatgctggaagaggcaatcaagaattctccccctggagacttcggagggactgcagccctgccaccaccttaatttcatgtttttatcttccagaactgtgacagaatacattgattgttgttgttgtttttgagatggagtcttgctctgtcacccaggctggagtgcagtggcgcaatctcggctcactgagacctgtgcctcctgggtgtaagcaattcttttgcctcagcctcctgagaagctgggattacaggcgtgcgccaccacgcccggctaattttgtatttttagtagagatggggtttctccatgttggccaggctggtctcgaactcccggcctcaggtggtccgcctgcctcagcctcccaaagtgctgggattacaggagtgagccaccgtgcccggccgattgttgttttaaatgacccaagctgtagttatctttagaacagccctaagaaatcaattcacatactttcttaactgacccatggaagtctccagagctcttatcttgaaaacaaacacacctgacactgtttgcaaactagattggactcttcaaattttggcctggggtagagggtaacaccttgaccaagccttctgaggtcactgggctgtaagctctgggagaacagcactgtgctgcctattatgggtgcataatacctatttgctgaatgaataaataaattcactggcctgctgtttttttcaggttctgtttacctagattcctctggccccagatggtactgcactttcaagctgcaacttttctggccattttggagtcccatcctggtccttggccttttaccattctttccactgttcttcctcccaccatctacatctacacgctggataagaaagacaatctgccctcccttttgtttgctttaaatgaagcaaactattgtttcccagataaattccattacatcttctctccattgatatgctccatttcttcatctccaaagcttaatcaaactccatcccccagatagtaagtcttcttttggaattttcatgccgctttgtccctttcgcgtatcacttatttgtctcttggaaagcagatatttatgtgagtaccatccattctgccagacttgagggtggtcttaccattgggtccatttttctcttgctttttcatcttgttttgttttgtttttattttgaggcagtgtttcactcttgttgcccaggctggagtgcaatggcacgatctcagctcactgcaacctccacctcccatgttcaagcgattctcccgcctcagtctcccgagtagctgggattacagatgtgtgccaccacacccagctaatttttttaatttttagtagatatggggtttcaccatgttggccaggctggtctcaaactcctgacctcaggtgatccacccaccttggcctcccaaagtgctgggattacagacgtgagggtccatatttctcttaacgcacagtacagaaacaggcagcagtataggaatccaaaatactgggtaattgaataaatggaaaatgaggatggggggaggccaagagtggggaaatttttcataaattccttaatatactatgaagttaagaaggtacataaaattcctctgaaacaacattaggggccctgttgaactggttgtgggctaacccgaacatgtatgagtaaggtcagaatggttagatgtctacgtttggttagatcgttttctgttttgccccataacaaatcaccacaaatttagcagcttaaaacaacgcacatttatcatttcacgatttctgtagatcaggatttcagacaggcctagctaggtcttctgttttagaggttctcaaagtacaatcaaaataccagccaggattggcatcttatctgagggattgaccggggaaagatctgcttccaagtgcacatggctgttggcaggtttcagctcttcaaaggctgttggattgagggcctcagtttctagctggcttttggccagaggatgccccttcagttcttgctatgtcggcctccccacatggctgtttgcttcatcaaagccaagggaggacactcgctagcaaaacagaagccacaatcatttctagcctaaatgtagaagcgacatcctatcactttcacaatgttctgtaggttagaagcaagtcactaggccagccgcactcgagggcatgaataccgagcacttggaatcattgaaaaacatcttacaatctggtctgtcacacctggtaacaaccataggcatttcctaagtattgaatgggtcatgttctaaaaatttcttgctcagttggaactaagaactcagtatgattttctttatacaaacaatgaagttaggtttctgaccttaccacctaaataagacccattttacctaaaatatatcaaatatcatgctaaccaaatccctctaaccaacatttatttattccattgttattctgtgaaaaatggtttccaaatttcaagttggagtcctggcacaaatgtttcagttaatttgtcttcagcatagccatgcagggaagttaggagctttatacctccgccatcagtaactcattaactgtttcccacagtgcatataaatagattattcctaaacaaaatatgtatcatgagctgatggtcaccaaggatgcatttactgtgtagttattctatgaagtcctcggtttttgcactgaaaatctaaatgtttaaacaaggagagtaaatcattttcagtttttcagaatgtgtaattcaaggaagcatttcaaaccgtcttcaaattcttaaaactaaacagaaacttccactccaacaacacttaatcccctatcacgaagttactggtcttggtttgtttacattgaatctcatgggttagtaaaaacgccacctcctttccctacagcacaatatgaaagaatctccctattaggctggcagtagaaattcttttgaatttttagattcatcaaagactgaccctttctctttttgaagtcttctctcgcttcctagctatcagggagtgctttgaactcagctcccacggaccgtttcctcttcaaaggcttgctcccttctgtgcagggagaaagcgccttttcaaagtggtgggttcctgccttttgtgggtctgttggagtacacagcaataaacaaaaataataataagcagcagtagcagttcttggtaattacagagagatctggggaaaatgtggaaagcaaagaaagccactttgcaacatgacttagaggaaagggtgttaaacatgcttgattctcagttgtactgaagctttctgtaacctgcaagaagcagggaggggcatctaaagtggtccctcctcaggtggacattttggcccaggtgggcatcctggaggcatcatgacaaatttaaaacaacttaagttatttaaatgagactcttccctggacacttgaacagttagatcccaccgcgaggcaaagtcctagacatcctgggggtgtctctgctttgttttatctgcaaacacaacccgaagcatgaacttctttttcttcttttccatcttttgttttgttttgtttttagatattgactcatggactattgagttgattctgttcccccctacccccgcaagtcactgacttagataatatacaattgtagctctaatgaagtgtttattattttgtttcctaaggaagatattactagagttgtgatgctttgtgaggcacttaaaaatagcctcttcttggccaggcacagtggttcacgcttgtattcctagcaagcgtggtggccaagacaggcagattgcttcagcccaggagtttgagaccagcctgggcaacatggcaaaaccccgtctctacaaataataatagtagtaataattagccaggcatggtggtgtgtggtagtgggactactacagctgtagtcccagctgtcgggaggctgaggtgggaggatcacctgagccccaggaggttaaggctgcagtgagcccatgatcattctgctgcactccagcctgagtgacagtgagaacctgtctcaaaagattctcctcattctagaagtttctgattctgtaatcttaggtaaactctcacataagaacatcatccagcatgactgcatagaagagccccttactttgcttcgtaatacacaacagttcaggtatggaacagcaggggcctgcagttagcaacaataattgagccaccctcttctctgtaactgaaaatggttctttcagttatgaggtatattgttctgctaaggctgccataacaaaagaccacagactaggtggcttaaacaacagaaatttgttttcccacgtatctggaggctggaagcccaagatcaaggtgttggcaggtttggtttctcctgaggcctcgattcttggctggcggatggtgttttctcctcctgtcctcatgtggcctcttctttgtgtaagcatgcccctggtgtctctgtcttgtcctataaagttaccagccctattgcattagggccccactcttatgaccttgcctaagcttaattgcttttttaaaggttctagctccaaatatagtcactgtgggggttaatgcttcaccatatgaattttggggaacacaattcagttcataatatggggtcacccacattatccatgggtggattggaggtcataaatattttctgaaaatgtgtatatgagagtatatgcctatatggatttttctggagagagggatcacactctatggaaatttgaggggattctaaaagataggaaatataaatttatattaacttaattatttttctaggtgtgatgttatatgctaatcctttcacaaagagtctgtcatcctataaccctgttgctcttttctctctcaattttgagatactctgttttgcagaatatctgttttacaaatcattaatctttcaaaagattaaggagtggttgaagaacatgttttcctatcctgagttgtctaaaattatgacatagttattttcattattgtacagttttggagtcttcctttacaaatggtggcttaggtgcttgagcaaatatataaaactttataaatcaaatttctgagctagataaacagaatccaaattcaaaagtaactgagataaattttagggcaaaaataaattagaataaacagaagtaaacttcccaacataggcagtgttgtttaagtctatgtaatgtgtagaggaaagcagtgaaaacaactggctgggaaatggacactatgattaaaatctaaggaaaattaggatttcttaagtggaaaaagaaaatcaatgatactttaaaagttcctccaacctcttgttttctctccttcccttctaagtctacagttttatttatgtcatatcataggctggtttctggggctacaacttttactgtacattatgctactgacttcttaaactcgaacgttggctgttcatttgccatcagtaaattttattttgtcaggtttagacatttttcttgcacagtgattttcaaatgtttctttagttattgaaccctaaatccaaacaaaatcttccatggacatcgagcagataaaaatggaaccgttacagctgaaatagggtgggaaaggatcttactgaaataaacatatactatcaatatggcatttgcctaatccagtgtatactttatatatatgattccccacttcattggcagtttgtagcaaattcttattttctttgtttggcactctctagattttgacacattagaagaaaaaataaagttatattattttaaaaacagtccaaattagctggaagatacttattttctctgactcttgtaaaaatgtcagtagggtaaaaatgtcaataggggatgcaaaaattaagacaacatacatgtccttttcttcattttatgacaatggtgaggaggaggctagaaatcttaaatgatataattggctttggaagcatttttaagctttagtctcatttgtccataaagcatgcagctagagtcacagaatctacacatttaagatatcttatggctttccagtgaatggctatttctgaaggaatcacgtcaaagctcccatgtcatttttgctgaagtcactgtgtcaattgcaaaggcagctggcgctcccactgcctccgtccatgcccgatggctttcatggagcactccaagatcctgtggtctcatccattcctggagtcaagaacacctgaatcactaaaataaaatgaggtttgaaatgtggtgtttactatttagagtgatcttaaatatttacaagtagcataactttgtaaaaaaaacaaaaacaaaacaaaaacaaaaaaaaattgttattcagggaccttctcgaacaaatgaggaaatctttaaaaatcaaattaaacttctgaaattagtacaaataaacgcttgtgaatctttaggattttcagtggaaatacacagtgaatttttgtatgtgtatatgtgtttgaacggttatagttaagcatttatatttttacagaaggctttatgcctgctttttttggtttcttgtttgtttggtttggttttggttctttgttttgttttattttagttctcacaacatttccaaccctaaatggctcagcaaataaagttgccgtgttttatgttatttgcctcaggtcatgcagaggtttttagccagggtgtttttaatctgctgttttaacctgtcagcgcatcattgttgggtcttgggtcatctgtgaagttctaggtgctgtgctaagggccttggagacagaaatataagtcatgagttctaattctcacttttttcaatactatatgtggaggatggagacagttctaaaagtatgcacttgagtgagaggctgagacccccctaaagtttgtcacttcctgccaccctcaggctcagcatatccctgcacagtggctagttctttttctaactgggatttcaaaagttaaagaggaggaagggaaaggaacagaaactaataactactgaatgcctgttataagccaacctgatgcccagagtcctccaattgaatccatggtatcaacagtatttgaatctaggtatccctactgacaaaggccggacatttctcactagaattaaccatttctataaaatgctaaagaagggcagtccccagtttcctcacctgtaaaatgaagacaaaagccttccaccctgtctcatctgtcactaaatgggagactattgattgtggctgaacaaattcaaatgagctcatgttcattcagcctcttcatgaattttgtgaacaatcaccagcatattataattcaaatcatcagtagaattgtttgtactgattcagcaatgctgattgtatgtgattccaatgcaaaaatttcttcttagccactgctaacactaaagagagcaatatcttccattcttacccatatccttttgcaaaactcacaaaatttttgtttaaagatttttcttcttgcaaatgcttctgactgcagcctctgccagctaatggaggtattttatgggctttattggcagagagagaatcaaggaggggcatgaagtagaatagagaaagaaaccaaggaaggaactagcacagttgaggcaaagagacattttgaagagtataaatgaaagcttaacttgaaaataatttgaggaacaattgtgaaaaaagtcttatattctagacccaccccctgtcaaaactgaggttgaaatttggtcccctctgtgttggtgttggaagatgtggtctaatgggaggtgtttgggttatggggatggaccctcatgaatagatggatgtcctcgtgcaggaatggattagttaccatgagagcagtcagactctttttaacaatctgctctcatgggaaccacatccaaaccatagcagaggtcaacagagaccttggcaaaaccatttccagcagatgatgggggcagaagacaaaagggcagtggatcctcttagcccatatatccaatctaaactcttgggtctagaatttgacttcctctctcttcatgtgatctctttgcacacatccacttccacttctgctttctgccatgagtgaaggcagcatgaggtccttatcagatgcagctacccaattttggactttccagccaccagaattgtgagccaaataaacctcttttctttataaaatactcagccttgggtattatgttatagcaacacaaaacagactaagacaacctgcatttgccagaacatcaatagacattttttagtcctaattttgccttttcagcagcattacatgccatagaccactctctccttttattttcttccccttgtcttccctgatactacactttctggttttcctttcatctctttggctactttctctactatgcattgcgggctcatctcttctgccatctagccattaaacatggagtccttcaaggttttttcttgggccctgttttggtcttaatatatatgtatgcctttcttttaaatgagcgtattcacaattatagctgcatttatcacctagctaagaattcttttacaagctccagactctcattaagttgaacatcaaaaagttttctcattccttgcgtgctcataaccaaaattgggaacgtacccccaaacttagttcactgctagtgttccctgttcagttttaccagccagaaacccaaagggaagtcaggaatgactctcaatgtttcatatgagcaattagttgggcagtggatagggagcactaggagagcagtagcggggcacaatagctgatcataaatttagttttggacttactgcatttgagttgcctaaaagttttagtatcataagatttgaatgtagtgacctggaagccaagggaaaaattctgtagcgtatgtggccaaagctgcattggagaagggagtaatgaagacagtgagggtcttgtgcttcttgtgcttcttttttttttttttttttttttttgagacggagtctcactctgtcacccaggctgaagtgcagtggtgcgatctcggctcactgcaagctccgcctcctggattcacagcattctcctccttcagcctcccaagtagctgggactacaggtgcccaccaccacgcctggttaattttttgtatttttagtagagatggagtttcaccatggtcttgatctcttgacctcgtgatccgcccgcgtcggcctcctgccgactgtaaagggctgggattacaggcatgagccaccgcatctggcgggtcttctgcttcttaaagacacctccccctatcccatccaacttcttcagttcagtatatattgttgtgtttggtgtttattaaataattggaatttgaatctattctctgctttcctttggaaaccagtaaattttattcattcagtttttcatttatccatgataatagattccctgttgggtccacttagttccaagataactcaaaaacctgtggggtgctgtggtcgcaagaaagaatcaggaaaagaccatagctcaagcaataaaatgataacacaaacattgactgagcacttaccttgtgccaggtactgtagtgactgttttacatacattgcctggtttacttcagcaccacaccattaggtatttattcctttttaagcccattttatagctgtgagaattgaggcttaaataagttaaatgtcttccccaaggtcacaaagctagtgagtgcaaagctagaattccaacccaggtgtaacttcagtaaccactgggcttcccatcccacaactgcaaaagcctgcaattcattgaacagtatattttgcttaaagaagccctaattccccttcacccccccgccatccctttgctcattaaaattaacaaacaaaaagaatgtctttctctttggtttcagctctttagctggtgggaagaggaggagaaattaaaagtaaggagactcccagagtttcaaacccacaagcaaacagcctggagatgacttgagtcatcttccacaaacatctgatgttgcagaggaatggggaaggaagaaggaaagcatgagtagctctttttttttctcttttgagacagagtctccctctgtcactcaggctggagtgcagcggcgcgatctcagctcactgcaatctccgcctcccgggttgaagcgattctcctgtctcagcctcccaactagctgggattccaggcacacaccaccatgcacgggttatttttctatttttaatagagacgaggtttctccatgttgaccaagctggtctcgaactcctgacctcaggtgatccacccgcctcggcctctcaaagtgctgggattacagatgtgagccaatgcgcctggccactggtagctgttaggtgttggcattttccagcccctgcaaggctgaatttgggggaggtgtgtgaatactggtggccttggcctaagcaggcaaaagcttcaccctgaaaagtagctttggttaaatgtcagaatttatgtggcaaaaaaatctattaaaaagcatatataaagtatagcccttacctttcctctatgcaattttttttaatgtttgagtctaaagcttttcaaacacacctggagaaactgaatcaacaccagcctatcctccaccaatgggttaagttcacaaagatggaaagttagaggaaacctcataaacttaaagagttaccattgcttcacaagataaaaagaactctagttaaagatactctaaacaaacaactctagctttgcagtgatttagggaacgtcttgatgtctttttcctcattgattttggtgcattaaatttaagttggctgataatccttgcactcttgaaaaagctaatggttagtttacagcaatttctcttaatgattatctttcagaaagcatttgagttatgagagagagtatctaacttatcctgctgttgataaatagaattggaagacatattcaaggtgctgctgcaaagacgctttcagcaattgctgcagctcagcccatggatgttcagtgaaataaataacagaaagcagtctaagaatttgcaagaggaagtgtttttatattgcttagcaaaatcatctctatattaaaaccacttgtaaatttaaactgtgccaggggagggaaggtaaatgggcttacataatccaagtagcataggaaatattaaatacttcatgttgttaaaacagggtgacatcatttccaaggtacttttttctccagaaaattgaaggctccatccgcaagtaagtagtaggaagaattatttgctgtgggagaaactctaacatacagctctgccttacactgattctgcagctggaaaacgagaactcccctgtattatttcattttttcaagctgcaaagcaaataggggaacagaggtaaagaaactaagaaaattctgagaagccatgctcttcaaatgatggaaggtgctgccaagaatcacattaacttactacttgataaatacaaatttaagaaatagggattcttacagattcctacaatgacgaaagggattttacgcaggatcagaaaaaggtagaaggaggcaatatgcatcaaaacagaactaaaaattgaagactcattagaaaaaaataaaggtttatagtctagcaagggaagatcttaaaaagacttatgttatctagtagagtttcccaaagggccaatccagggatagaaaatcattagggggaccacagatgaatcatgcattttacacttttctgccaaaatggtggtcagtttttcaaaagttctcaaatgcgttgttattgcaatgctttctaattttctcccctttacattcctcctcaaataaatctgcatagccatcctgaaatattattcataaaattaacaccacagatgagcagattgacagaagagagccacaagtagtatttgttagggcactgatgtcccagaggactgacttgaaagcttgaaatgactcttttggtcatgattatgtataaggaagatccgattagtacatcacctttactccccccagttgtctttggcctttccccagtattgcttatggtgaccaagcatttttaaatggttccctagcaaagcaaaagtcatcactattcagcaataccacttttatttgatagcttcccctctttgttttctatatcctagtcctttatttgtttttttttttctttctttcttataacttacttaagcttctacttccttctcactctcttatttctgatgtcaggaacatgccgatttgccctttctcctgctcatctgctcagcttattataagccctgccctggttcttcatatttctgtgttttcttggaaacactttattcaaatattttcctgtacatacaccacattttctttaatgtatgctttaaaaaaattttatgaatgtaactttaataacaaggtaatacccacaaattaaagaacattctaaaaaatataaaaatgtagaaacaagaaagatcactcatggttcttcagacaaaggaatcggtgttaacattatgatgtgctccttttagatttttccatgtaatatttatgaaactaaatatgataatataaatatgttttgatgttctttgatgtctaaatgtgatgtataagtattttagatgtttttaatggttgtataatattccaccgagtggatatatcttacttgaaaaaccattccccaatggtagattattaagattattttaaattattttgctactgtaagtagggctagggaaaatatatttgtttaccaagctgaaggagaatgtgttttatcttgtgtttatttcttttatttaggctggttattatttctttagcatagattcctaggaatcgaactatagtccttgttagtagggacagtttgcttccaaaacagtggttgagttgtattttctgtccagtattcatgagaggtgcttttcactttattcttgcaacatgacagattcttataagaaaagtttgctaatttaatatgtgtaaatggtttttaacttgattataactgtttattttattcgtatgagcgcgtatatgcttgggtatttattagcctttattcattaattttttcgcccctttcatctttcctttatcttgtgcccacactgcggatttccagtgcttatccttattcgctcctgctcacttttcctccctcaaagttatttttgcattttcttttgtctggtgtccagtaacttgtggggcagtgggaaccaaattgcattttaagatcttttttatgagatgttctcagcaggcatcttcaaggccccaaattctctttttgtcccccactgtgaaaaactgattggcatctggtgatgggcagggcacgggtgcctggcgcttgcaggaagccccacaggaggtgcacagagccatggtggatgaagtgtggccaagccagcacaaggtgggggaccagatgtcgcccgattatgttccattgaaatccaaacaaagccccagattcaggatcatttccttgagactccccagttggaaattggcactgagccagaatctcacaacagctggtctccccatgctaggatttatgtgccttaccaaaaactttacctgcgtgttattgattggtttctgtaaagcaatgaaacaatattttgaagacccaaagcatactgctctctgctgaaaataaaaagaccatatatcactgaacacaccagcaagtcttattataggcttgagaactctgagaaggatgcgttttcctttttatttatgccacccatgttaaccttgaggctgtgtactgacatttgcagcttcgcaatgacaacactccactcttgttaggagaccaagtccaccctttggaaataaattatattataaaataagctttcaagggataccagcagatgagaaatcatgcttatgtttctcatcatctagtttgtgttgagaaatcggagagtcttcccaaaatctcattacttgttatcatccaggtcatttgcatttatgtccttctcctttcctcctgcaaaggaagatgaactacaagcctggcagtttcattgttgtggataacgaggaggaaaaacctacaaacaaaagccactccattctgccccaccctcaaagatactgaagttggttgtgctgagccacaggggaagattgtaatttaaaaacaaaaactagcatttctttgttaaataatcgtcatgaaagcatttatattcatattatacttggctaaatatgtattcctgatgtgaatccaggaactctgttttatgcattgccttgatccctggctgctgctgctatctcagtcacctgataatgtctcagtctttctctcattctcttccctcttcccctctctctgcccctctagctgcctggcggtcctcaactcagattctcagacctcacagtgagattttggagctaacccactccattagaaacaaacaaaataaattgtttccattccccaaaggaatgtgctaaagcctttttcctctttaacatggatgcaatttaagtttggcaagagctgaacacaatatacctcactaggaggagaaagatttctgagaccctgatagaaagaactaaacaccccctcatccttcctgtgaacttaaagtgacaaaaagtaacctggtaatgccttcggtattcacagtgtttctgcaaaatcctcactcattccctcattccataaacatgcattaagcacctactaactgaaaacgctgtgtgcacattccttcccagctgttccttcaaggtgcatttcatttcctcaatctctagcccctaccatgccacaggcattcaaatgtcattcagtggcatttctcttcattactctgatttagaatcctgcttatctgtagtgtttcacaggcgatgatttgaagggcaataagaataatatggcccataagctgggcgccatggctcacgcctgtaatcccagcactgtgggaggccgaggcaggtggatcacgaggtcaggagttcaagaccagcctggccaacatggtgaaaccccatctctactaaaatacaaaaattagccgagcatggtggcgagcgcctgtaatcccagctactcgggaggctgaggtaagagaatcgcttgaacccaggaggcagaggttgcagtgagtcgagatcgtgccattgcactctggcctggacaatagagtaagagtccgtctcaaaaaaaaaaaaaaaaaaagaataataatatggcccattcattgcaggtgttaaatggaaatcgcctgagatcagctgtcaagaattaatcagggatacttactgtattatgtacttgaaactaagagggtagaccctaagtgttaacacacacacacacaactatgtggggtgttggatatattaattagcttgattgtggtaatcatttaacaatgtatccatatatcagaaccccaagttgtacactttaaatatatacaatttctgtttgtcaattataccccagtactgaaaaaaaaaatggtcaagaagggctgggcatggtggctaacacctacaatcccagtgctttgggaggccaaggcaagaggatcacttgagggcaggagtttgagatcagcttgggcaacatgatgagacctcatctctacaaaaaataaattagctgggcatggtggaacacacctgtagtttagccctacgcaggaggctgaagtggaaggattgcttgagaccaggatttcaaggctgctgtgaactatgatcacaccatggcactccagcctgggtaagaattcattaaggacaataatatgatctagaaccaatttaagcagagccaaaagaaggacctgacctcaaagaatatgcacatgaatcagaaaagcgacccagtccttgtcaacgtcctgcttctctctctttcttttccctttcctaatgctcatctctttgtaaaacatctcctcctcatggacttaaaagattcaaacatctttgttcaaattctggaagtcatggtgcttcccccagactgaggtgattgccactgaggatcagatcccaggtgagttgagggcagaggaaagggtcctctgaagccacgttggagaagggcttgttagacttccctttactacaagaacgcctgctattcttcatgcatcctagcttttcctagtcattctttattccttgatcatattcacccacttaccaaaacacttactggattgatttttacttttagtgtgttctactttcataatccataagctgcctatcctcgtatagcacagcacacagctatttttataatcctctactcatttgattcctagccccagtaatccaggaactggccattatatctagttcatgcaacccataaagttgcacattctgtaccttttgaatagtctttctctcatctttttccccttcatcctttctgattcttgaagctgaaaagattctcaaggctccaagttagccctgccctcatcttggttccttcttcagtggctaccagatatcatagacttatgactatcaaagcaagaggaatatggagtcagggagatacattggctggagcaaggggtgggcctgaagacaaaagttgatgagcagtttttgaaggtccagtctctgttcatgagggaggctcctggtgaagagatagaaatgccactcatcactgtgtacactggggacttttccgtttacctgagatagtcacagaatggagacctgcctcctaggggtcaaccaaagtaggtacgaggaaggatctgcagctggtttaagctttaaaaatgtgcctctacccaggattaggctgcagaggctgatgaaaatgtcaggtttctttgatttggctgaactctgtgagcacaatgttgtaatactgttgatctcatgctgatctgaagctggccaaaatatatatccatgatgaattataataaaaatagggaggattatgacttgatatataaagtttgggaaataaagccatttaaaatattggtctgtgggtgaaaatgacaaaacatagggccataaggaggaataaaaccaaaggttggttgtgtgatctacatgtggagctcagagcatgtttcttcctccagcccccttccccgttgctctgcctcatgagggaattagcacttggtattgtctgtacgactggcattgttccctgagcctcgagtctacggggaccacaactagatggtctaacgtgtgccttattcagctgaataaggtgttgaatagctacaaattgataacaagttttaaagagcatgaagtgccaactatgccctggctagtaagaaagccagttatatgtcaaggaggcttattagctgtgcatgaccatatataaaattacaggggctgactatagcaccaaaattaggtggtggtaaggaatttaatcatgtactgaccaatttcttgtttcataagaacactaagtccctgtaagtgccaatgtcagcagattcataaccctgcagcgcaattttggattgtcagaatctgttaactgtaggtatgccatctatggattttaaaatcagaggttcagactagctgtattacttggtgtagtgttaaccatgtttggtggatgccaggatgtgccacacaggtcccctttggggattggacttacttccccagcaggtgggagtgccgtcagtttcagccctctgctctaagccctctccagaactgcccttatgtgaagacagcagccttactaagttcagacccccttcctgtggcagccctcatcccataactggtccatgctggggtataaagacctgacccacttcctctattaggggcaactctgaagggcagggccttcacagctttgcagctcctagtagggtgggctcaggcccttgttcagactgcattgcaaggccataccttccttacctagatcacactttcttactttccctggacaggtgttggtcctagaacacttccctaataaacttctgcatgctgatttccatctcagaatctgccacacagggaacctgaccagcaacagtaggacaatctggatggcttgagtcagaaggtgataagttagaaataaagcactgaaatttaaagggcaagcatgagaatgactcaaatgaaaaagacagtatcaagtgctggcaaggattcagaataagtggaactctcatacactgctgacgggagggtctattggtacaatcatttggaaaactctttgactctgtctgttaaagttgaatatctgtgatcatgtcctatgagctagcagtttctctcctcagtatatatgcctaagaaaaatgcacgcatgcccaccaaaagaagaatacacacaaatgggcatagcagcactcttgccaaatgcaccaaactggagagaaccacagtgtcatcaataacagaatgaataaatacatcatattatagtcacacaatggagtactatgcagcaatgagaaggaaaactacagctccacaaggcaatacagatgaatatcacaaatataatattgaacaaaagcagccagacacaaaagaagacataacatatgattccatttatacaaatgtaaacatcggcaaaactgatgtatggtgtttgaagtcagagtggtggttgcctttatggagattcactgtgacaagaagaagtctgaaggggatattctggaaggctttcgaagctgtttttgatccaattgctggttactggagtgagttcactttaggaacatttgttgatttttctggacactcactatttgtgcacttttctgtgatatggtatagtatttaaactcagagtttatatagtgaaggaagaagaaggaagggcagatgtaaacactggatacaaaaaatgtgacatcacggatgtagacaaaaattcccaagattcaaacaggacccctactgtccagtactgcagactcctatagatgacaagtctgaggtccagaagggctccagttggctcaaagttacatagccagctaatggtgaaagacttcctggccccatcctttccccctcttcccacacttagcagagccaatgtggtcactagagtctccattcatctgagctcagcattgaccacagaatcatccaggcagcctaagcaagatatgcaatgtacagggaaataaaacatgagcaaagacctgaaaaaggcataggaatttgatgtaacagaaatgttatccatttcttagaggcctttctccacctattacctactgtcttcccacccacgcttctataactacccacaatgctttgtgttgaaagtgtgtcattttctttttgcaaagccaaagactacggagaaaaggttttgagctgtgagctaaattgcctttttctcccttggctttttcctataatctttgggagaactctagactatactgggctctaaaggccccttttgagagcattgccttatgtcatggaatcattgtgaaaaacagctaagttataactactttatatgtctttaaataagttagtatttctctaagagctttaatttcatttaataggtgatagagatgaccttgaagattaaagctgaaatattcttcattctttaagtatgttaatatgtgtgtgtgcacatttgtgtgtgtgcacatgggtatgtgtgcttgtgtgtgtgtgcatggatgagtgtgtgtgtttgcatgtgtgcaaatgcatgaatctgtactagtatataggcttgcatgtcgtgtgcttgcgtatgtttgcatgtgtgtgtgcatatgcacaggcacattctctgttaatataatgccatttgcagggtgcttgccagtctcttgagactcatggttctctgctttcgattacactcagactagtccaaaacccctctgaactaattctaatcaacttggaagccaccacactcaggcatgaggccgtcaaatgtgagtgtttgcagatgtcagtgcagagatggcagtaatccaggaggacagatcaaggcttagtcactgaaaaatacatgccagtgcatcccagctccagagcaccatctcagcccataagaaaaacatgtcatgacagtaaatcaataaccccttggagatgattcgtttctgaaatatccctgattaattatgccagtccatgcttggcaagagtactttgctccagcattaacctaatgctttttgcatgaagcaggattataacgggttctcataagtcaaatttgacattttaaatcaggctttaaaggtttgggttatagattttataatgtctccatgtcaaacataattgctcttattgctgctagtagacgtttgccaatcaatcaaaataacatttattttcatcataaacaagggtaaattaaaaccatttgaaatcattgtatttgaaaacttagtgaagaagcatctttagtaccattgaaatttgcttcctcactgtgatacatgggagcgtgatgaaattataaaagtcgatggaaatgtgttactattttcaccttgaaaaattaatgcttctacatattttgtgaatacgcggcttaaatttggtggcttattcccatatgattatgatttggggcaaaatagctccctttctttacataataggaaattatcatttttgtcccttaaagatgaatatatctttcagtttgcttataaattgcattcagaacttatttcttattcctcttaaattgcaagtgtttttttctctaagaaaagttaatggaaaaagaagatttgcttaaggggaagtcatactaataggttccttcaacaaaagcttagcatacaatggtcaactggtttgtacattctccctaaagtacttccaatgcatcagggtcaccttcccttacggtaattatagcattatgtggtatattactactctatttctatactgtatgtgtatactatttctatttgattatactgagatagatctcagtatagtcattgagtgccatcatgtaggtatgcagtgggaacacgaaaaagagggattaactccgcccgagacagagctgaccttatggaatagtgtattagtcagaataggctaacttacccgaagatagtaacttcattctgaattctctgtagattaaccccacaaagtttctcattcacacaaagtatgttgttatccagttgaccctccagagcagctttcttccaggtggtaatgcagggatccagaacccttccatctatgatcttaacatgtggctctcaggtcactatggtagagaagagagagagtgaacacacaccagcttttaaatgcactggcctaagagtgtccacatcgcttctgttaataataggcccattggccaggactagagcttactgtggccccgcctaactgaggaagcatagaaatgtgaggctgattctttgatgggaggaaaatgactctgcaatatgtatataccaaggataagatcccaaatattaagggattgcagtcagaaagaagatgaacaaagacgtgaaagtttgaggtcttttaatggaacaataacagttgccagtccagagtggtataagattaatctagaaaagtaggttgaatcacatagtaagggcctttgaaggcaatgccaagaaacttggacttcacctgaaaatagtgggaagattttggccaggcgcggtggctcatgcctgtgatcccagcactttgggaggccgaggtgggcgaatcacaaggtcaggagttcaagaccagcctggccaacatggtgaaaccccatttctactaaaaatacaaaaattagctgggcatcgtgatcggcacctgttatcccagctacttgggaggctgaggcaggagaattgcttgaacccgggaggcggaggttgaagtgagctgagatcatgccattgcactccagtctgggcgacagagtgagacttcgtctcaaaaaaaaatattgtgggaatattttaaagaagagaaccacatagtcagaattatgtttttaaagccatactctgacattgcaggatgctgatatctacgaataagtggattctactgagaaaatatctgaaaagcaggtgaataacattaaaatcctaggttattgtttttcaagcttccttttgttaaatttcagagtgctgtgaatgatgtttcatttttctatagttgctccccaaacttgtcacttttccgtgctctttaagaaaatacttcaatgctttaaattttactgagtgcaggaacacctacttgagtttcacttttcccttgccattcacctctgctgtgtcccccattgctctctcttcttgcattcttcacctcactccccagaatgtttctttattagtccattttcacgctgctgataaagacatacctgagactgggtaatttataaagaatgagaggtttaatggactcatagttccacgtgactgcggaggcctcacaatcatggtggaaggcgaaaggcatgtcttacatggtggcaggcaagagagcatgagagccaagcaaaaggggaaaccccttataaaaccatcagatcttgtgagacttattcactaccatgagaacagtatgggggaaactgcccccatgattcaattttctcccaccaggaccctcccaaacacatgggaattatgggagctacaatttaagatgagaattgggtgaggacacagccaaaccatatcagtttccaaaatactattaaggagagtgggccaccaaaaacacaagaaaggtagcacaaatctcagaaagagaatgcctctccatgacaacagcttggagttactctcccttcttcccctctacctccatgaggctcttgctacctgtgggatttaccctctgacatgggcataaagactgacctgttgtccctcagaccctggaatcttaagaagctgaatggtggggcgatgagagacgatttcaggttccttctcccaggcacagccatgacacagtcagctccccttccctcataggagatctacccctggccattcttttatccttcggttgtcctggtgctccataggcagcagagcactgggagtcaaactgcccaagtctgagcacaaactcaccaccttccagttggataaacttgtgcaactttcttaacttcttgtgcctcagtctctgtaaaatggaattgatgatgataataacatataccttgaggcattatcttgagaattaaatgagttttattccatgtaaagcgatcagtacagttcctggcatgcaataaatagatctcatagaataacttcaattatttgcatgtgttgtgtgagccacttctactccaagatcctatacatgcaaccccagtgaatgagatcttttccaaggtgagagactttaaatttttattcacctaattgagacatgtttcccagaacagcagtccgttggaggcaaggatgactggtgtatagtaggaatatagtatttattggatgaatgaatgaatgaatgaacaaacgagcatgggaagcagtgtgtgtcagtaaaagagcatgttttagagtcaggtagatctggaatcaaatgttggctacaccatttatgagttctacactacctttgacaagtgaacccctctgttccttcatttcgtcatgtataaaatgaagaagataactactacattaggattgctgtgagaattaaatatgataacagtgggaaatgtctagtataaactcagcatatattaggagctcagtaaatggtagctattattattgttattccatatttctgcacatccagttaatgatagaggaagcagcataaacacagagggatgaaataaatattttctttgtttacctgtcaaattgacatttacaaagttagactagctttctttttgttctttatcttatgttgttgtctgtattgtggagcttattaaagtaaaggagaaaaagaagagtagaaagggggaaattgtaggtgacaaggctgcagagaggtgaggaagaggtgtgaggctgaggaagtggcctagaagaaagtcatggaaagtcccttccttgaaaagccagcaggataggaaccaggcaggagaggggagcgacttgacagataaatctctcctctcttcactcccttctccactctttctccagcttaatctttctactattaatatccaaatttgtttctcctacttctctagatcttaaactccatggaagatgtctgaacctatagaggaacgtctgcttcctgcagggcagactccagctcaaagccctctagggtttggcagacacctccctcaccctcacccgtgcaaacccagctcttcatcctctttcatgtcttgcagtggtaacagtgcccttagtggactgtgctgtacctttactttttcttctccttggccatgtgaatgaatgctgtcctttacccttctacttatcaacccctagtcacatttaaaaacccagttctaatgtccaccatgatatgagatctttccttgacataaccaagcagagcaaatcactctggcctttgtgccattgttggtctgcaagtctgcatacagctcatcatagtatagtggtttgcctgtctgagggcattcattagaggtgctattctgtgagaactacacatactaattgggaaatcttcgtggaagaaagcaaacactaagtcacttaaaaatggatgttatattttatggtacaacatgggtcatctctagcatcccagtcacaaaaagaattccttaattggtggcccacaggctgctgagctgaaaaggaaagagaaaatacacaccgcactgcagcctcctggtaatgccatggccccttagcacctcctgggtgtcctcattaggattcagcaagagatagttactgcctcaagtcatatttaaaatctttaaatgcaaaagtaatagcccagtaaaacgtgtcactgtcctagtgtaatggttcctatgacatatagttgctcttaattgcaacgatatgcatgtcttaattaagtgtgcaacactattttatttggcgtaattattaaaaccatatcctaagagttgttggggctaatgttagaagtgagtaaattccaaatttagtccttagcctataaagagttttggaagtgcccagaacatactggcactcagtaagtattgttctgtctgaacctgagtttttcaccttgggtcactgtttctaacctcattttgaacatgaggttgttctggtgtaagagcatctcagcctggtttgacagccggcaggaacaggtatccaacatatgccaaaaaggcacagttaaaaaatgccctggcagtttctggagagagattctatgccatgctgataggtagcaccaaactaaagccagcactgggcgctggggagagggagacccatgacaagaggaagttctgtttgacttctggagaaacagaaactatagtggctgagactggcagttcctcatcattcaaaacactacaatgtctctactaggaagggagggagggagggtagcagattttgagctgaccaattagcgaaattaataatgatagtttcaagataaaacattttgtcagatttcccgaggtaaaaattcaggggatttttttggagcctgcatcagttttctttccaagctacttcggatgtcatttctatctcccttgaagaggagaaacatctcatccagctaacactgttcagtggccccaagggcagatccacgttgattctcttcatgccctcactaatgctgcgttttcctgtattcttcgaacatttgacttatttgggaagcctagaagctttgccaaagattaggatcagccagagattggtgatttttctcagtttttctcatgtcccctttctattgttttagatcatgttttgctaatgcaatgggctttatttccaaacctggaaatttcttcttgctttatttcaagataaaaatgttctcatttttaatacccttttgttctatgggggggtgagaggaaacaggaaaaagtaaacaaaatattcgagttacaatctagagtgcacaatttttgtatcttaggatagcttttcatactattcttatttacaatatagctataaacttattggacctcctaggaacccttccgtatcccatcttcgtaggcaagtccagtcacatcgctggccctgcctgcagtccaggtgcttataagaatacaggtgcacagtaacacaaagatatgcacgttgcaaagatatgcatgtctttattaagtgtgcaacacacacgcacatgcacactgccatctttttatttatgatccaaagttgtcattgggttattagaaaacatgaaggcaagaacaagctcctctagtgatttgatgcacacataactgtgcaaacacttccagaggcctgcctgtatcctacaggtgccagtagcggacaggggattgccaggtctcttatgacccaatgaggttggccacacctcacatacaaaagctggttttacttctgaggaaaaaacgattcttgcctggtgttcatatgatatgggagtagtaccctcctattaaaaaatattttggagagaaggagaaagaccagagaaatagcagttgaacatagtcttcaaatattgcctattaatttttgtgttgtacactctgattataactctcaattctagagatctaaaatagtcttgagagctcccctaattcatccgtctgacttgcctggatttataccatcatgcagcataatttttgtccttctattaatccacagcgaagattattccaaaacttctctgtagtttataggtcattcattgccatcacaaatagtccaaaattttccccaggagccagtccagacccttcttgtgtagtgtgaacatttttcctttaataccattacattcgtctgtcagaatctaaacctccaactcatccatctttccagtttcctggtgaaagaacatccattcataaatcaaataatctagtagttagaaggtacaactacaacttatgaataatctattccagtataccccagtatgtaggctgtatagctcttgtgttttgcaagataatttatgtagcacggggacgtgacattaaataatattaaattgcatagtgaaaagtttattccctctgaattatctttcagtccttctcattctgtttaggagagtctctctttcatgccagtatatcttttttcttttcttttttttttttttttctttttgagactgagtctcgctctgtcacccaggctgcagtgcggtggcgtgatctcggctcactgcaacctctgcctcccaggttcaagtgattctcctgcctcagcctcccaactagctaggattacaggcgcctgccaccaagcctggctaatttttgttttttcagtagagacggggtttcgccaagttgaccaggctggtctcgaactcctgacctcaggtgatccgcccgcctcagcctcccaaagtgctgggattacaggcatgagccattgtgtccagcttcatgccagtatatctttagtgcccctctatacttactaatgtccttatttaacacagataggggaggcctcaaaataatctaataagattaattcatttttattgtattttgtttttgtgattatcttctatttatgacaaatgatattccatttatgagagtttacatacagttttcctttaagtacatttatttaagaaaaatgtgagtgaattgggtgagaactttaaaaaaaaaatcaagtagcatgaacggggccacagtatggcttttgtagattttaagcactttgtgttagtgagtcccttcttacattagtgtgtacgtgtgtatacgtatatgatgttttatgacagcattggtatacagatgaatataatcttcaactctgaaagttcatttttttcttctgattctaaaagaaactaagacattttcatgggccctggcactgtggctactgtccctaaagcataggtgggtcagccctggcatgtgttatagcaaaactcattagctcttcaggagaagcactaatttaatccaactgcctcattttacaaagaataatactaagcttcacacatgtgtgagaacctgcgggtctgagagtgaggaaggacaaaatcagaactagatctcagatgccagcctcctaatctttccacttcattacactgctgtcttcctttgagcctcttctgcaaaagccctttttcttgtcccatctgcttccgagtcttcacatcagaattaatcatgggtccttccgtgaatccagccccacctcaggtgtgaggactgctctgtgtggaggtgacacccccttgtggatctcttctgcaaatagacctttgtcacgggaggctggtcagttcacagcctccatggcagtggagtcagttcactccgctccatcacgggggacccaccaagaccccattaagaaaagcacaaatgatgcaataaatcaggatagatttaggcttcgttttttggacacaatcttccaaatgatagctcctcattaaaactagctaaaatggatgatagagcttgggataggttcaccacttatatcctagaccagtactttctaggatggactttatatggaagaccaaaggtttactccttgggctgtcaaccttcattttacttagctcttcaaacaagtcaagccttgtttttagctcagctcctggggaattgttctgttgacaatgtactgcagaaaacagtccaaacaattcttaagagctaagagccacctttggtgactagactttgtaaccatctcatttatccaaggtggatctacatctacctgaaaatactgtaagttgtaaatggtatttgtgtttggggaaacagcaacagatcattcttcagctcgcttccagccatctgtaactgtcatcataccactagaaagctctgactttcaaaaagtaacagatgctggtgaggttgcgaagaaaagggaacacttatacactgttggtgggagtgtaattcaacccattgttgaaggcaatatgacgattcctcaaagagctaaaagtagaactaccattagacccagcaatcccatcactgggtacgtgcccagaagaatagaaatcattctaccataaagatatatgtgcacaaatgttcattgcagcaccactcacaatagcgaaaacatggaatcaacctaaatgcctatcagtgacagattggataaggaaaatgtggtacctgtacaccacagaatactatgcagccgtaaaaaagagtgagatcacgtcttttgcaggagcatggatggagatggaggctgtaatccttagcaaactaatgcaggaacagaaaaccaaacaccgcatgttctcacttataagtgggagctaaatgataagaacttatgaacacaaagaaggaaataacagacactggggtctacttgagggggaggttgggaggagggagagtagcagaaaagataactattgggtactgggcttaatacctgggtgatgagataatacgtacaatgaaaccccatgacgtgtgtttacctatgtaacaaaccttcacgtgtatccccaaatctaaaataaaagttaaaaaaaagttctgactttatgctagctaatgttattgtttattattattgattggataatatatcacaggaaagacatatttagcaaaaatcattttttacagtgaagacctttttatttgttttgaggcccaaccaaaaaataattccaatctgttgggagataatgtaagtgatctgcaattatgcacttctacaggtttattgattcaaacattattcaactgtgatatcttttaaaaatataatactaatgcagaaaaaagagcatgagatttggaggcatacagaactagttttgtatcctacctccagacctactagctctgtgatcttaggcaagataattaacctttctgagccttttttgccccatctgcagaatggagttaataatatccatataagatgttgttttgaagattaaattatctggaaaaatattgactgagtacctctcttgtgccaggttcttttctaagtgctgcagataccacagtgagcaaaacactaagagtgctgttcttatgcagtgatgattttaactggagttaaatatttccctcctggttcttaagtcattgaagcagagtattgcctgagaatgggttggaactggatttcatgtagctgtagttctaaaataattatctctcttgctgctatagattttaagttataactcaactgctaaaggttacttattcatcaggaccattcatagttttttaccattcttttagttcacaaaactttagttatctgtaaggcaacatttatatttgcagtaggtattttctgctaatttatgtttgttaatacgtactatgtataaataaacataatttgcattataaatttctagagagggagatacacagtctttagtgcatgaaaattccaaatgataagctgttatgacatagaaaaaccttctactaagatttgccactggacaaacctgcacatgcacagctagccacaaaaagatcttttgtctgtggttatgtcactgatgggacaagttgctcctgtttagtggtgatgacaccaatgatgaagtgatctagaaagatattcctttttcaaattgattttcttcctggaatggtttaaagtacatcctgattctcccagatacatctgatcatcagcaagtatcagatgtcctatctggaagatatgcatacattttatcactttccttgataaaataatgacaactgaataagcatattctgattggttatttatacaaccaatatatatttatttaaaaatggaggattttctacttcatttggagcaatgaatgaagggtagaacttaagaaatttattaatatcagtgatccaaaagtaatgtcattgtcatttatgatccacacaggccctcagggtcagcattatcatcagtgtaaaggtttgatctgcaggtatttttcttttatgtaagatttgataagacatagccttattgctagctgtatatttgaattttgcgtgaatgcaccattgtaaaactattgttgccatctcaaactgttggcgacattccaggccgatgtcatctgaggtaactagattataatgaaaaaccaatagatctttaaaatgcatactgtctctgtactagcacacatgtacattggcttgcatgactttcttcagagctaattatactgttttaaaaaaatagtaataaagaagataaaagataaagaaatataaagctacccaactgtggaatcactcacctgattttctcagaatgccacactctaattactaatgtattggcagtcagcacagttatctagaggagaatgtttaaggcaaagatcatccactgtcttaatatttcttacaaaatcatgtctttctatttttttctaggaatataaacaataggttgctcctaagatgttcatttagatatccccaacatgccttttgcctgccaaggcctacttgccacctggttctattttgctagaatgcttattagactttgaaaatcataatattcaatttcctgccttttccttgaatacacaaataatacaggaagagcaaggcaacgattctttcacggctgtttaggaagtactaaatagaatttaaacctgctgatgggtcagttttcagttctgccatctttatactcttgagaaagtctccagtattggaaggtaaatatatatcctggcccagttttatcttagaaactctttgttccttttatctgtccactaaatttcaaaaccaagggcatttgaatatctgaaaggtttaagaattttagtttcctttcttcttacctatagatgggataaatttcatctccatcctgttccaataaacttagtgtctagagtaatcactgaatcagaaaaacaaaaagatgttctactcagcttcttgggattctgccttcagacatcatgtctaaattcatgcactactggtccaaactggcacaccatttctggaagctgatttggcgttgtttgctaacctgctgctcgtgcacacataatttggcattatttatcaacagccttaaaatcatatagcctttgacaataaaaacataatttaacatttggacaaagagttctacgaaagatgttcatcatgatgtttttaataaatgaaaggttgaaaatcttttgcatcttgatatccaagaacaagaattggttaaataaatcttagtatatccatataatggagttctccaaagctatggtcaagaccgatgttctggaagaatttctaaactaccatatcaaaaattctcatgctgcaatattatgataaaaatccaaaacagaattgcacacacagtatgatattaactgtgtttaagtaatatgaacagggagggaaaaaatgggacgtacaccaaaatgttaacagtggtgattgttattcctctctttggttccagttttttcttagacatttttctaggttatcaaaattctctgtaatgggcataaaatacaataaaatttcaaaaattaagatacagaagaaaaatattaatggagcaatcaacgcactatgtggttttacgtccattctacttctttggcgagccatagacttctttctgcctgacactttcctaggaatttatagtgtgcattctcctactggtgaaaaaacaactatagagagacaatgatagcaatctgtgtcacctagtctctgttattttccagcacacgacggttctgccctttatattaatcgagatgaggacatcgcaccatcagtatcccagcaggagcagcggacttaccgccatatgtaccttctctgttggctatatattatggtaaggaccatgcctgctgggctttcttattgtattagattttgcactgctaaatttgggcacatatttcattatggatataatcactaacagattcacgctgtgtgccgcatttggtccaagacctgggctttgtctcgtttccccagatgcttatatttttagaaagtatatgccaaacctcacacaacaggaatttgttgaacaatcccatgtaagcagtggttcttccaaggctacatttttcaactctttttcaaactaaatgtttttgttggacaccggttttattgcttaagggcttttttgcttgggattttgttgttgttgcttttgttggggggcaggggagttgcagcaaacacaaatgagaacagaagtgacctcttagagcaatgacttaaaacttactaggaaacaagtgaaaatgtatgttttccctggtccatttaaaacctactccagaattaactgttacatggagaatgcattaaactgttctgtttttaaatattgggataaataaaccacaagaaatcttcatttgatctattgtgcacaattcagatccaagtgtgaggtgccaaatttatctgataaaagaatttttgcctggcgagtctacttcacattaatttcagttcttatcaggtttttaacacttcaaaaattatttatcttaacatagagaatttcttatttctctttataattccaagtcctctttgacatattaacacgcacagaggaggtccctcctgccagcatttctgcctcttgggactcttttgtcctgagttctggttcaccatcccctcctttaagcccaaaggactggatagtgttcttccaaaaacccctcaattgtacttaatccccccaaatcctagagctctttgggaggccctatctccatggagcatcttgctccagctggagttgaaaaataaaataaaggtcactacagtacctgacacactttgcataaacaatcacatgatgccccaaatctgagcagaaaggagatttgcttcaggaagtcacaccctgtggctggatataaggggacatccagaggatgtccatgtggacaagcatgagccaccgcgtccagctgggaggagctttacgaccatgtggtaaagctcctccccagctgggtgctgtggctcacgcttgtaatcccagcactttgggacgcccaggcaggcagatcacttgagaccgggagttcgagaccagtcttgtcaacatggtgaaaccccatctctactaaaaatacaaaaaattagccaggtgtggtggtgggcgcctgtaatcccacctactcgggaggctgaggtgttaagaatctcttgaacccgggagacagaagttgcagcgagccgagatcacgcaactgcactccaccctgtctcaaaaataaacaaataaataaataagcttctcccattggcccctccatcaactagtaaagaccacttgcaaggactagggaagtatttgttttcctaattactttctaagttttttgcctcatccaaaaccttaagtgttgactttctctgataaaaaatgtccaaatgatcagaactcacacctgcaatatgactaaagttgtgtcttaaaaatagatttatgtcctttatacatatgaacttatattcaaatgagtgttatctttcagaatagtcaagtagggaggctgcacaattattccagggatgccacagatgtttaaaacatacctggaacttcctatagccatagtttaaaaatcagtctcgcatcccacccccaccccaaatacggtcttgttactttgcactcatatttgcttacctgtggaaaaggcaagttctttactctgggaactctaggtatatttctgcaaattcatttatatgctattaaattatctgcatcttgtagagccccagagatttcaggaactatgtactttctgatggcctgtcttccattgtgggtagaatcagtccacgttccaaagagacacatgggaaataccacatagtcctcattatagacccccaagatccctcattaaaatgaagcattactcattctctgcatgccaagtgaggcttgccagctctgcgtactccctaagcaaaccagtacttgtttggacatgtatttacattaaccagtgaattctctcagatttgttctgagaaagcattcaaagtagactttttcctttggtgttctgccctgggcattcataactgtgccaaatgctaaacaatggccctcacgtcatgtcccattatgtaaatccaagattttaattgttatcaaaaaggtactggcttttgcttcctttcagactatgttagggccgacatacccgtgacacaacagccaaaggttcgggatatgaaatcttttgatagcataccagggttgtaactggacattccagagccccatgccaagatgaaagaaagcattcctctcatcacatgtaaattataaaagaaatagatggcctgtgcaatactgagtaaggttgagctaaatctatacctcaggggctgaccaggctgctggctgttttgctgggactctaacttgctatccagtggccctccgcatctgaatctattctcttcccaggtttgggtagtgagagtagagaaagtaagggatacctggactttccccactgactggttcccattgagctcccattctcggtggttctgtttcccagccccgttgcagtcctccccaagcttagcatctaaaggccatcccggtctccttccgtgatgacttctgcctccctgccatgtttctctttcccccagcccaaacatcacctgtccatttgtgggaagctcttaactcctttcctggacacccccctccatcatcaaccctcccacacacacatttctctgcaccccgtttgtgagattttccctaatcaatgagaggacccttagcattccggatacatacagaggtctccttggtgtctgatataagagtttaagtatcaggaatcataatgggtaccattcctttgagccagacactgtgccaagttcagttcaaatattatcttatttagttccccaaacagtccttagagataggcatgatcttgcccattttacagggaagtatgctgaagtttagaaagagtacatgacttgcccagggtgagccactggactcttgccagaactacggtgcaagccccattgtgtggctgcagattgtagtctgttaaccggaccctccactgcccttgctgtgtgaagagtaactctatgaatgaacatagtgagttttttattttgtttagaagaaatacataagaaccagccaagcctggtagctgaggccactttctgggttggaaacatttctaggctttagcttaatcagaagtaaaacagagaggaggacagaatgtaccccatagttggaaagacactgttattgtatataaagcccatagaacaatgcctgactacagtaaaaaaaaaaaaaaaaaaaaaaaaaaatctatatttgctatttatcagtcctgagatgcttctcaacaaatagtagtataaacagtaatgtttccttttcaaggcttgagaattttagttaccataagtgttttctcttctttttactcattctggatcacttgcacaaaatcaaaaacaattttaatagtcataaacaactctaagggatatgaaaatatcttttttttaattataaaagaatgattaggaaatcttacaggggtgctgggtaacacagggagctttaagatcatgggctcctgtctcttgtcaccttctagttgacatgtataaaagagaagacatctttgctccacctggtgcagccgtctggggctgaatcttttcccgggctggctccaccctcacttccaagcacctggaatccttgtctctgcagttctgcttctcattgctctgcctttcagtctgcaagatacagaaagaggaaaccaactcagaccctaggaaatgtacaccctcaaagcttcaagaatggtctctctcctaaggagtcttcttccagcccctggctattctccctccttcaggggtttctcattcaatcagagcccatgtgagatctcagaagccatgtataatacgtgctgatctctcaacccaggacacatcaagagcaagtaggccttagtgaaggggacaaaatggatcctgggtgtttccacttatggataaatattccttgtcaactgctgtgagtgtatttaaagcaaaatagagatgtctgttgtctctgcaccctagtggttttaaacaaattccatattccaaatctcatttccccaaatgtgttcactgaataactttccaacacagaaaataaaacaaagtcaagtcagaagtgttaatggaaaaagcaaactctgtaaaatatttaaagaggtttattctgaggcaatacgagtgaccatggcccaggaaacagtctcaagaggtcctgagaaagtgtgcccaagatggttgggttacagtttggttttatacattttaaagagacagaagttacaagcaaagacataaatctatacctgtaaggtatgcattgatttgacctgaaaaggtaggatgtctcaaagaagtagtgggtggttacaagtcataggtgaattcaaagatttctgtggttgggagttgtttgaaagagttaagctttgtctaaagactttaagtcagtagaaagaaatgcttgagttaagataagggaggttgtggagaccaaggttcttgttatgtagatgaagcctcatacgtggcagccttcagagagaatggatggtaaatgtctcttttcagaccctaaatggcatcaggctctttgttaatctctcctagatccaggaaggtcctggctgtattaatggagactctctacaaatgcaaagatcccccacaaaagatggctctgcagagccatttcaaaatatgtcaaagaaatatattttgggctaaaatatgtttgatttccttcaggacctcctatctgttatgtgatgctacatcaaaatcaggttgaaatgtggaatcttattgccccaaagagtttgttttgtcagtcttatgatctctattttaatgttaatcctggtcagttgtgcctaaactccaaaaaggagagggtacaattaggcatgtctaacctgccttcccctaatggctgtgagttccatttttcaggtttctctagggtccccttggcccagagggggtccattcagttggttgagaggcttagaattttatttttggtttacagaatgaagtatgttcattcttttatgatcattcctaaattatttcatgtcaaaattctatctcccacaaaatttgattatctcctaactgggcaattttggatgatttttttggcttcttgttgaaatggttttgtacctcaagtttctgctggaaacatacattattttttatttacatacagtatttgtaagccagagaaaaaattctcaaacataaaaataagagtgtactcaaattttaaagtcttagaatttttagccatgaatgagtaaaatttttaggaaaaaatgtgtaccctctttactaagaaaatgaaattttagaccacattcaattccttccatttaatcagatgtttcttcaccagttaaacaaatctggccgacacgtgttctttgaccagcagatgacatttttctctattcaacttgaatctttcactccaccatagctgttgacttttacatctgtaatggtttgtgtacatttttctgattttctggcattggagaaccgagtccaagatgaatgaaggtgataatgttactggcggcatatatgtatgggtctgcagcaacctcagttcttgccgcctcagaagaaataatttgaccaaggggcataaggcagagtgagactgaagcaagttttagaacaggagtaaaagtttatttaaaagctttagagcaggaatgaaaggaagtaaagaacacttggaagagggtcaagtgggcaacttgggagatcaagtgtgcagtttgaccctttgacctggtgtgttatgtgttggcgtgcttccggggtcttgtgttcctttctccctgattctttccttggagtgggctgcccacatgcacagtggcctgccagcacttggcaggggccgcatgcgcagtgtgtttaccggagttgcgcgcatgctcacttgaggcatccccccttaccagttgaatgctcctggaaagtcatataacaattaaactccaccatttttcctcttagtgtgcatgactgagcccactcacccaactcctgagatcttatcaggaagctgttgatcatgagctttaggtgtctttctctattgggagactgcctttccctggtgccagctgcaaccaattattattttagagaggcagttttaacaacaaccgactgaccatcacctgatggttgcctgacattcttgtttgttggggggtggcagggggatgctctcctgccctttcacgtctgactagctacctgctgtaacaataagtatctcacattctgaagagagctacctttcttggggcttacaagagacagccgaaggactctgctcacttactatcaccaaggccatccatgcttcactatgcccgtcttccccaccctcttcccaagatggggaagagggacagggtctttgcagtcttgagttttggatctaggggagctgttgggggaaggaagggcctctccacactgaccaaagccaagtgtgaggctctaagagaatccctggtaaataatagctatgaggcaggaatttaggaagctgactcgttagccttccttatatctcctatttaagcaaggaaaagagtcttggaaggatatggcagggcagagggagggggagctgtaaagccgcctgtgatcccatcattgtacatgtcaaagtttcttgtagatctggtttgacatagaggaaggttgctggagttgagctgtcttgatggtggcccacccaagaaagaatggctcctgggcaagagttttccagcagcaggaaaccatggggtgtgctgccctggacaggagccagggggtgttaaagaggtctagctggagccagccagatcccccacataaggaagctcttcatttcagaaacccttcagagacccctgcaaacctcacacttatgcacccgacgcagaggtgagcacctggacttcagcctcacagcactaatcagtgggaagcagggatttgccaatgacagggaaagccccttgcataagcacaggcagtgaagtcagaagatattcatccttcttccatttcccccgccagaaaggaaagaggcatctcagaaccagtccacgtcctcctcttctacttcagggtcttagagtgcatggaataaataagtaaacccccctcccattcagggttccagcaataagcctgctgtgttcaaggaaagcagaaggccactgtgtgttgaagcagagtgagggagagtgcacagagctcctagggtgagggaaggagagcattagaggccactggaaagactgtccttaattcagattggcagtcattggaaggtttggacagagacttgacatgaactgagacatttctaaggaatcactttggccaatgtgttaagagtggattgaaggcaagggtagaacaaggagaagagaagagaaggctatagaagaaatcctgataagagatgaagtggcctggaccctggtggtagaaatggcgttaataggattctggatatattttgaaggtagggtcaataggatttcctggccaaatttaaattaaaccctggactcagcccctttaataatgtttaaccttggtatggaaggcaaaataatgctcaccacaagcccccaaagatatccacatcctaaaatccccagaacttgtggatatgttccctgacatggcatgtggcaaaagggactttgcaggtgtgattaaggtaaggaccttgtgatggacaggttagcctgcttttgcaggtggacccagtctaatcccatgaatccttaagagtggagagccattcacaactgtggtcagagagagacatgactgccgaaggacagttagagagatgcagtggagaaaggacttgaactgccgtcactggctttgaagacagaggaaggggctgtgagcacggaacaagggccccctctagaagccgaaaaaggcaaggaaagggattctcccctagggcttccagaaaggaactcagccctgctgacaccttaattttagctcagtgacacctatgttatacttctaacctgtagaattctccgatgaatatgtgttgttttaagccacaagtctgtggcaatgtgtcatagtagcaagaaaaaaacgaatacttgaacaaatcacttaatctctatgggcctcaatttccttatccgaaacaaaaaaagcatgatgatagtgatcaggcaggattgccgtgagcatcagaaaaatgggtatacaatgtccagcacctaactggcactcagttccagtggccattgttgttctgtttatacgctaggaatactccatcctaagagagcctcagcttagttctttctgcaactttcttccctcacgaaccttaccctggaaggcagaagtctagatctttgaagttagatgctccttgtttagttcccgtcttcctcgggtctttgagcaaattacttatcctctcttagcctcattgttaccacctttaaaatgggaaagaatgcctgcctcacagagttgtgaggattaatgagcccatagggatgctcaggaaatgagagcatcttcccttcctcttaggcgacaaaattcctgaatgcctgcagagaccctaggagaaaggctcattttctttttttctctctctctcttccccgccacccttattttattttcattttatcctctgttcttcatacgggctttggtcctactttacagcatgtgtggctcttcataacctattgagaaagttaaagagttttctgaaattttcttatggttcatatattaagttatttccggagctctgcttttcccatgagattcgagaatgtcattgctttcccattattccaatctgcgtatttttacaagcactgtgctgagaatgcactattttctcatcttctaaggaaaagtctatctgggcagttgaaagcctgacaacagagagtatgtcttgcccttggtgcctgagaatgtccacttgggtgttggtcaaatcagcttcttagacctgcatctggacagaaaaggcttgtgtatataatctgtctcaatccccagtatttattattctgagttttttgttctcctacccccaacagctggttctcagacattctgggagtacatgaagaactagaattccccatgtgctattaaccttgccccaccctgaagtcatgttttatgtggttatgatccttcccccactccccagcttccctacagccatgcctacaccactgcttcttttccccatagtctgcccaaatcaccagtgtgatgctgcttgtgctcttgatgctacttggcaattttcctgtggatttctccagccatctctatccactcccctccacctccacctcactctcccagtcctcccagcagatggcctggccttttatttcacagagaagataaaagactctaaacagggactccttcgatctccccctacaaacatcatttctgcacccatcctctcttcacctcctgagacaataggaaaagggcctctatgtttttcagcaagcaatccttccttctggactctggcctcatacccttctacctctcctgggaccccattcatgcccatcacttcattctcctgtaagttcagtctcactgctggatcctttcaatcagcatctgaacacactgtagtcctagtctccaccttacaacattgctcttcttggaccagcccctgtacatctagctgcttccctatttccctactcacagctgagtgccttcaaagagttgtctgcattgtctctactctcacaccgcaaaggcttagagacaaggtggtatagtggttgagatagtggattcatgagccagactgcctaagcctgtattctgcttctgccatatgaactgggccaagtcacttaacctctctgtgccttggttttctcatctgtagaatgggataataataataagtctctcatcagattggcattaccattaaactaatactactctttagtatatgtaaaatgcataggacagtaactcacacagagaatgtactgtggcttcagctgtcattactttagcaaaattttggctgatgtcaccagtgacttctcctttgctgaatttatggaatgctctgtagacctcttctcaattgacatttcagcaatttgatactaaaacaaaccccccctcttcctgatacactctgttcctctgatttaggtgttgtaaccatttattttccctccattctgaagatgatccctctcagcctcatttgctggctctttcaactccccccaaacctcagtgttggaattcttcagagctcacttccaggtcctcttgttttactacccactctccctaggtaaacccatccacatgtgtttgcaatgcctccatttcggaactccatcccatacctctctcctgaacctactccatatctactcacttagcaactgcaaaccaacctcatgccatgccagatgtctgcatcccaccccaaacctgcatccccttgtcatcatcccaaaactagttgtttatgctggaaatctatgagacatcctcaacccatctctcttgggcccactccaggcagttgttcaccagtttctgagttctgtacctccagtgtacttgtagaatctttatgctttgctccatctccactgccaacactatggtccaagcctcagttatctctcctctcaaccactgctagaactgtctatccaaaggatcccagagtaatcttttataaacaaatgtcatcatgctactcccttgctccaagactgtggatgacttctcattgctcctcaagataagaaccaaaattcctttacatgttttagggggccctgcattaccggacccctgctgacctctggcctcatcatattcctccttcccttttgcttgctagctccagacacagtgatcttctctgattgtcaaaagcaataagcttcatccaccttcaaagctttcactttctttgtgccacaaacaaatcccacctctcccccagtcatgtctcgcaccagtgttagtttcaaatcctgctcctctttcaggcctcaacttaactctttttctcggggaagccctctctgattctccagacttggttcagcttctctgtgctacactactataatctgttgatttctgccaggggatttaaaaaatagttgaagttttgtggttatttgattaactctttctccaaagtctgcccccaaagtcccctcccttcactatctagagcaagaaagagaattagcacttcaaattatcttaaagaaaataaagagggcttccttgtctccagtattctaagagttaatccaagcacattttctttagacattacatcaataaaatgccacagaaaatatttctaagatagactttaataagagaaattgcaacagtgggttttagatgcaagcaaatagagaaaatgaatatatattacacatacacacacacccacacacgcacacacatacacacacacccctacctctcttacacttagttcaatggtaaccatataaagggtttacgacacccctgccatccatttctccaatattgaatttcagctttattgtctcttctcccacctgcctgattcatttaaattgccaactgaagctgataaagttgtagcagaaacctcacagactgcgctccttgccagagtgactgacatcctataggagagatgacctagttcaggcaataaaaacattccacatagaggaaatattcattaattagcaaaatcataacctcttcatttccccgaggggtgccttcttggtgtctttgagagtatgagagcattttgaagactcagaacatattctcttgtgggctgcatgggagggtacatgtatgtgagcatcttcacagggacccctatcctgcccagtcccacctttagcagatggttcccacagctgacagtaactgagaggaaaccagtccccaggcatttgtatctcccacagcacccaacagaggcacacattaaaatctggttaaaagtaaacaattcagatgaagagttatctgtgccagagatgagcttataccccaagagtcaacagaaatttatagcctaaaagaccatttgcttgttatgggatggaaatggcaagagaaacttgatctaaaatagccatataaaacattgactttgtacatgtaagtagacccatttccctaataattttcaaagtaagagaagcaactggcttattgttattgtaatattttaattctccaatattctgaaagatctgggtacatcttgactggtgacaaagttcattaactctctcaaacaagcacttattgagtgcctaccaggtgtcaggcattatgccaggtgcaggaggtagactatggaagaagcttcagctctgtcctcaaggagcttacagtctattgaaggatacagggaactaaaaagcaatagtcatccagttgataactgctatttgcaagaggaaaatagagtctacggaaggttctctaacccagacttagagagttctgaaaggcttcccggaggaaatgacatgtaagctgcctcttggagggtgaataagagttagctttgtgaaggtccaggataaaagtgtcccaggcagaaaaagcagatggcctagaagcaacggagaggaaaccatagtcagggagccaaagcagttcagtgcacctggacccattgacattttgccctcctcctgtcactgcaatatatattccacctcaactctccccaccaaaactgttttcatttttcctttctacagcatccttctttgactggttatttcatgattgggtgggtggttatttagatgattggttggttggttggttggttggatggtttcttgggtggttggatggatggttgggtggttggatggatggttgggtggttggatggctgggtgattggatggttgggtggttggttgggtgggtggttgcttagttgggtgattggttgattggtagagtggttggcccatttcctgtaacactgctcctactcagcctccttgggaggccccattcttcatactctctgatgctctagccctcctggcaagctttcatacactgcctctcctccaattttcatgtctcagccagatagtttttttaaaatgcaaattttatcctgtcaatcctcctacttaaaagtcttcaatagtttattttttccagtttgggtatttttttttctttctggtagcacttttattcttccttgcacaatgacgtatccttgggctgtgatattctcacgcaacagtagaaaaacaagatgtgtaagtcacccataaagctgagaattacgtacaaaactcttacataaattaaaatgatgcataaatttacaggtaaaaatacaaatcattttgcaactagaatgagtaatttagccctgtgacattctgctgcaaaaaaaaaaaacattggataagaaagaaaatggagtcctagagcctgggttatgtacgttttctacctctgctggaagactgcaacaaagaagtgacaattcattcataaattcttgccagcctctggagaaatccaggaattgtcatttgtactctgtggagatctgatcaggccctagaggagtgaacagcttgaaagaaattgtcagtcagccaaagacccatcacatcaggccaagtgccttctataaacatgttccccttattctccctttgccacacaaagtgtctagccacacatgctaaacttaagccaaagatatgtaaagaatgttagaaaatgtattataaagaaatagttaatatgaatacaaggtgaaacagtgctatttgcctatcagacaaagacaggtatctttttaaaaaggcatcttccaagtagataagtctaatataagatgctatccatttaaaagtagccaggtgtggtggctcatgtctgtaaccctagtcaggaggctcacctaggcccaggagttcaaaacccagcctggacaacatagcaagctaatagtcccagctaatcagggggctgaggtgggaggattgcttgagcccaggaatttgaggctgtagtatagtatgcttgtgccactgcactccaccctgggcaacagagcaagactgtctctaaaattgcagtgggcaatgggcaggtcaaactcatcagactcttgcttgctattccacatctgctggaaggtcaagacagtcgctagccacagtatgtgcactcagaagaagggaaatcttaatttttattgtgtttttttttcccaaggctgtgacatctgtctgtgttctaaagccagtaatagcaggacacatggtagtactaccagaccagatgggatgtgttgtgttggcatatagatcttttctaatataagcatcacatctcatgggtgacatggaagtgctatcttgagtgccactgctttcatacctgaggaggatggctgaaaagaacttctgggtctatgactctctccttgacagaggtgatcaactgactgtgagggagcttagtggtcttctccagggtagatggtaagcaatggtagctcctgtttgacatccaggacagagcagtaccacttctccttagcatcatgtacaatttcttctctgctgtgataatgaaactgtaatctcttcttctcacagtccttaggaatactcttccaagtctcagctagcagagtcgagaaatagcatgacatagggcaggtgtaactgtcatagaagggcattgtgtgggtgccacaatcatctaagtctaccagcagtatatgaccagaagcattacaggaacagcatggctggaatagcagtacacatagctgggctactgaaggtgtcaaacagagcctgttacaggtgtcatcaattgatggacatttggtttgtttctttttggctaaagatggaagtttgaagttatgaaatacccatatgcttaaagagagaaatgagtagcagagggatttcaagccactgagagggtctgattgaattcgaaaaccacagtatgatgctgcacagtcatgtaatttatgacacacaaaactcttcaacagtaggctctgcctcttctcagaacgccacacatcagctctgctaaactgcttgtagttccacgaactcacctctgggatttgcagtgttcttctctttgcctagataatttccttccaggtctcactgccattcccaatctaaccttgagtctgagatcagatgtcacatcctccagaagctttccctgacattctgagtcagtgtcaggtgcccctttcaagtggcaccctccattcaccccatcatagcatttctgacactgctgtgaaacatccaccgtgcaccaccaccgggctagaatcttatgggcaagcactgtgacattcaccagatgagccccatgtctggcatgatgcctgctgcctaagaggggctcaataaattttaaaggaataaatcagtgaatgagtggtgcatactttcagaaacatggatctatgagggttgaagatgctgagaactaggactggggaccaatgagcatgtcactccaacacattggcagtggaaattcttcagagatgaatttctgcacttttaaaaatagagaactggagtaattaatgtttgtcaaaacatacttgtttgtatttctggacaagtttttatcaaagttaaacataaatctttcagaaatattagctttgcaattctcccgttttctttgtccacatttggcgctccactcttgaatgatggtttctagaacacaactggaaagaggcaagagtctatttacccagttgcacacaggtagaaaagaataagttaccagccaggattcccagtgtaatctagcattagagataacccctgatagacatcagaagagggtgtaagtcccttttcaaaagaaaaaattaaaaactactagtgatatgccttccctaaccattgctttcaaagaccttttaaattatttttgttaattaaaatttgaccatgtatacttctaaaaattactaaattaaggaaagtcttgatttttatagcatattgagttaatacggatattgcttgacttgaccaaataaattctttaaaatagccacacacagaaaatagagctatattttttaaattgtatactgtaagcctttgaatgaattttccatgaagaaggcatcatggagaagaataaatgtctgacacatacaaatgaggtgaggacaaactattgagatgtagctggcaatgatccagcttcttagttcacttttaatagtttattttatttttatttttattttatttatttcttttttttgagacggagtctcgctctgtcacccaggctagagtgcagtggcacaatctcagctcactgcaagttaatagtttaagttcatgtatctttaaactaactgtgtagcttgtttttataaaagacaaatattgggagatggccataagttgactcttgctttgcaaaccaaagtgtatcttaaaacaagttcccctgtgcttatctaataatgagtttggacaagaataatgctgcctcggattgcaatgttcaaggcagtcattaaagttaataatcagtgctcttgtatagaagctttatgcctaacattgatcagccctttattgtgtggcatttgctagtattcaagtagcaaggagctcaccacaaaggccatcaggtaggtttccatggtagcagtctttcttttgttattcaccttggtaacacagactgggtgcaagccccaagccttggcagcttacacgtggtgttgggccattctcacgctgctatgaagatatattcaagatggagtcatttataaaggaaagagatttaattgactcacagttctgcagcactgcggaggcctcaggaaacttacaatcatggtggaaggggaagcaaatacgtccttcttcacatggcggcagcaagaagtacagagcaaaggtgtggagaaggccctttataaagtgtcagatctcatgagaactcactatcaaaagaacagcatgggggaaactgcccccatgattcaattatctttacatggtccctcccttgacaagtggggattattataattcaaggtgagatttgggtgggaacacagagccaaaccatatcagacagtatccaaatactcaccatgtcactgcttaatgaaaataaatagaatattgatagtgctagtagagtcaagaacctggtctctgggtgtgacaacaaggcaaggcatgatgtctaccaaggttttcttttaagcagctgtccgctaagctggactagtgtccttttgatcttattccaggttaataaccctccgttgtcttatattattgccctggagacaaatagaactcaatggtgactagaatagtttcattaatgctgaatcttatgaaagacaagtttgtgattgcacagtaataaaagtacaatataaaaactatggaagaaaagagaattctacttttttttttcagagaaactaacacttttatttttttattttttatttttttctttcttttttttaatttaattttattattattatactttaagttttagggtacatgtgcacaatatgcaggttagttacctatgtatacatgtgccatgctggtgtgctgcacccattaactcctcatttagcattaggtatatctcctaatgctatccctccccactccccccgaccccacaacagtcctcagagtgtgacattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtaccacattttcttaatccaatctatcattgttggacatttgggttggttccaagtctttgctattgtgaatagtgccgcaataaacatacgtgtgcatgtgtctttatagcagcatgatttgtagtcctttgggtatatatccagtaacgggatggctgggtcaaatggcatttctagttctagatccctgaggaatcgccacactgacttccacaatggatgaactagtttacagtctcaccaacagtgtaaaagtgtgcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaatgtcttcttttgagaagtgtctgttcatgtccttcgcccactttttgatgggattttttgtttttttcttgtcaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatctatcttgaattaatttttgtataaggtgtaaggaagggatccagtttcagctttctacatatggctagccagttttcccagcaccatttattaaatagggaatcctttccccattgcttatttttctcagatttgtcaaagattagatagttgtagatatgtggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtgcttcacatcccttgtaaattggattcctaggtattttattctctttgaagcaattgtgaatgggagttcactcatgatttggctctctgtttgtctgttattggtgtataagaatgcttgtgtttttgtgcattgattttgtatcctgagactttgctgaagttgcttatcagcttaaggagattttgggctgagacaatggggttttctaaatttacaatcatgtcatctacaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcagtacctaatttattgagagtttttagcatgaagcgttgttgaattttgtcaaaggccttttctgcatctattgagataatcatgtggtttttgtctttggttctatttatatgctggattacatttattgatttgtgtatattgaaccagccttgcatcccagggatgaagcccacttgatcatggttgataagctttttgatgtgctgctggattcagtttgccagtattttattgaggatttttgcatcaatgttcatcaaggatattgatctaaaattctcttttttggttgtgtctctgccaggctttggtatcagaatgatgctggcctcataaaatgagttagggaggattccctctttttctattgattggaatagtttcagaaggaatggtaccaattcctccttgtacctctggtagaattcggctgtgaatccttctggtcctggactctttttggttggtaagctgttgattattgccacaatttcagagcctgttattggtctattcagagattcaacttcttcctggtttagtcctgggagggtgtatgtgtccaggaatttatccatttcttctagattttctagtttatttgcgtagaggtgtttgtagtattctctgatggtagtttgtgtttctgtgggatcagtggtgatatcccctttatcattttttattgtgtctatcggattcttctctcttttcttctttattagtcttgctagcagtctatcaattttgttgatcctttcaaaaaaccagctcctggattcattaattttttgaagggttttttgtgtctctgtttccttcagttttgctgtgattttagttatcttgccttctgctagcttttgaatgtgtttgctcttgcttttctagttcttttaattgtgatgttagggtgtcagttttggaactttcctgctttcttttgtgggcatttagtgctataaatttccctctacacactgctttgaatgtgtcccagagattctggtatgttgtgtctttgttctcgttggtttccaagaacatctttatttctgccttcattttgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagagctttacttccaactatgtggtcaattttggaataggtgtggtgcggtgctgaaaaaaatgtatattctgttgatttggggtgaagagttctgtagatgtctattaggtccacttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttagtatagttaactcttcttgttgaattgatccctttaccattatgtaatggccttctttgtctcttttgatctttgttggtttaaagtctgttttatcacagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttaccagtctgtgtcttttaattggagcatttagtccatttacatttaaagttaatattgttatgtgtgaatttgatcctgtcattttgatgttagctggttattttgctcattagttgatgcagtttcttcctagccttgatggtctttacaatttggcatgatttttcagtggctggtactggttgttcctttccatgtttagtgcttccttcaggagctcttttagggcaggcctggtggtgacaaaatctctcagcatttgcttgtctgtaaaggattttattttgccttcacttatgaagcttagtttggctggatatgaaattctgggttgaatattggcccccactctcttctggcttgtagagtttctgctgagagatccactgttagtctgatgggcttccctttgtgggtaacccgacctttctctctggcttcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcccgcagagtgttttccaacttggttccattctccccgtcactttcaggtacaccaatcagacatagatttggtcttttcacatagtcccatatttcttggaggctttgttcatttctttttattcttttttctccaaacttcccttctcgcttcatttcattcatttcatcttccatcactgataccctttcttccagttgatcacatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgattgtctgaagccttcttctctcagctcgtcaaagtcattctccatccagctttgttctgttgctggtgagaaactgtgttcctttggaggaggagaggctctctgctttttagagttgccagtttttctgctgttttttccccatctttgtggttttatctacttttggtctttgatgatggtgatgtacagatgggtttttgatgtggatgtcctttctgtttgttagttttccttctaacagacaggaccctcagctgcaggtctgttggagtttgctagaggtccactccagaccctgtttgcctgggtaacagcagcggtggctgcagaacagtggattttcgtgaaccgcgaatgctgctgtctgatcgttcctctggaagttttatctcagaggagtacctggcagtgtgaggtgtcagtctgcccctactggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcaggcctccctgagctgtggtgggctccacccagttcaagcttcccagctgctttgtttacctaagcaagcctgggcaatggcgggcgcccctcccccagcctcgctgccgccttgcagtttgatctcagactgctgtgctagcaatgagtgagaatccatgggcataggaccctctgagccatgtgcgggatataatctcctggtgtgccattttttaagcccatcggagaagcgcagtattggggtgggagtgacccgattttccaggtgccgtctgtcacccatttctttgactaggaaagggaactccctgaccccttgcgcttcctgagtgaggcaatgcctcgccctgcttcggctcgcgcacggtgcgctgcacccactgtcctgtgcccactgtctggcactccatagtgagatgaacctggtacctcagatggaaatgcagaaatcacccgtcttctgcatcgctcacgctgggagctgtagaccggagctgttcctgttcggccatcttggctgcttccacaagaattctactttttaaggtataaggataacattgaggaatgaaaacagctttggatttttgttagtttatgtgtcctcattttttccagtgactcaacacctgggcttgctcattgtctctattgtctaaaataaatgcattctgataagcgtcacttctctttgattgtgaattgattatttgagttcatagcagcatgtgggggctttgttatgctgtctggcttgttctgaggtcaacagggaagtcaactagtactcagtcattcaaataaggagaataatgtactcagacttaacattgttctggtattcagtcctaccaaaacatcatttctgccacttactcaggaaagagtaaaagctctaactcttaatttaatttacctttctccttcctatacgatacctgaaaacatttatgaatgagtacgcctttagtgcctccattttagttactttaatctgtgaaatttccacaaagcattgtatggctttcccttgtagttttagcctttatcataaacagtctgagtgtaacatccataggggtgtgtaaagtttctgccatatataaaatatatttaaaaaatatatttaaaagaaaaactacaaataccaaagccaaagagaaaatcttgaaagaagctggtggtggggagtgggagagtggggggcttccttttacttatagagaaagaggataagaattataatatacttctcatcagaaatcatgcaagcaagaggggaatggagtaaaatattaaaagtattgagtattgaaagacaaaagccgtcaacctagaattctatatctagggaaattatctttcaaaagtaaagaagaactattttctcagacaagcaaaaatggagagaattcataatccacagacctaccctagaataaatattaaaagatgttcttcaaggagaagaaaaatatagttcagaaacatggatctacactaaaagaagagcatagaataaggaataaataatcctgaaataaaacatatgatttttctttttaagtgaggtattagagaagtgctttttaatgttacaaaggcaacaacttattagctgattatagtatagaaaaattataaaaagaaatacttttaagaatcagaagtattgtaagagagaagaaaaagcagaatcatataaaatactcaaaccaaagaaaacagaaagggggaagggcataaaaaaagaaagaaatgcccagtgcaatgaatagaaagcagttaaaatatggtagttattaatccagctatatcaataatcactttaaatgtgaatagcctaatacaccaattaaaagacaaagattattacattagataaaataacaagactaaaatattatacatgtttctacaagaaactcactttaaacataaagacacagctgggctaagagtaaaatgatgaagaaagatatgctaacactaatcaaaataaatctgatgttagctatattaatttcagacaaagcatactttgaacaaggaaaattatcagagataaacaggagtactacataataatgaagggattaattcaccaaggggacataatctttaatgtatatgcacataacaacagagcataaaaatacatgagacaaaactgatagaactgccaggaaacataggcatatccactattataattggagacttcaacacccctcttttagcaattattagataaagcaggcaaaaaattcatacagatatagttgacctgaacaaccatcaatcaacttgatctaattgacatctatagaatattttattcatcaaaagcagactacacattccactcaagcttatgtaggacattcaccaatatcaaccctattcggggcaataaaacatatcttaacagagttaaaaaaatagaaatcataccaagtatgttcacagtcaacatgggagttaaactagaaatcaataaaagaaaaatggctagaaaagtccaaagtatttggaaattaaatagcacactaataaataacccatggttcaaataagaagtggcaagagaaatttacaaatactttgtactaaaagaaaatgaaaatataactcaccaaaatttttgagatgcaaggaaagtagtgcttagaggttaatttaacattaaatgcatatattagaagtttctaatctgatgtaagactagagaaggaacaatttaagtcaaaagtaagaagaagaaatgaaataataaaaattaaagaagaaataaataaaatttaaaaaaaaacaataaaagccaaggctgattattgtaacagattgataaaattataaaactccagccaggctcaacaagaaaaaaagaaagaatatacaaattattaatataataaatgaaagaggaatcccactactgagcctatggacattaaaagaataataaaggaatattatgaacaactctatgcccacaaatttgataatctagataaaatggatcaagtcctggaaagaaacaatcaccaaaactcatgcaaagagaaaaataatatcttaatagacctgtctctattacagaaattgaatgaataattagtaaccttttaaaacagaaaacattaggttcagatggcttcactggcaaatcctaccaaacatttaaggaagaaatgataccaattcttcacaatttctttcagaaaatagaagcagagggaatacctcctaactcattctctgaggccagcattgccttaataccaaaacaactagagaaatacattacaagaaagaaaacttacagacacgtatctctcatgaacatagatgcaaaaaatcctcaaaaatgtttgcaaatccaattgaacaatgtataaaaacaattattccaaaatagctggatgagaggacttgaaattttctcaacatatggaaatgataaatactcaagatgatggagactcccgaataccctgacttgatcatgcatcaagtatatgcacacagtctatgcatataacaaaatattgcatgtaccccataaatatatgtacaaatattgtgtatcaatttaaaaataaaataaatttaaaataattattcaccaaaaccaagtggaatgtattctaggcatgcaaggatggtcaacattcaaataccaattgatgtaatacacaacatcaataagctaaagaagaatcatatgatcgtattaaaagatgcacaagaagaatttgataaaatccaacatccacttgtgatttaaaggaaaaaaacctctcagaagactataaatagaagagaactccctcaagttgatgaagaacatctattaaaaatttatagctggaagtcctagctagagcaatcagacaagagaaagaaatagagagcatccaaaatggaaaggaagtcaaattatccttgtttgtatgatcttatgtttggaaaaacctaaagactccaacaaaaaaactgttagaagtgataaacaaattcagtaaagttgcaggatacaaaatcaacatacaaaaatcagtagcatttcaatatgccaacattgaagaatctgaaaaagaaatcaaaaagtaaccccctttacaatagctacaaggaaaattaaataactagtaatcaacttaacaaagacgtgaaagagctctacaatgaaaactataaaacatggtgaaagaaatcaaagaggacacacaaaaagcggaaggatattccatggtcatggattagaagaataaatattattaaaatgttcatactacccaaagcaatttacagattcaattcaatccctatcaaaataccaatggcattctttacataaatagaaaaaagcaatgctaaaatttatgtgaaactacaaaagacccagaatagctaaagctatcttgagcaaaaagagcagaactgaaacactcacattacatgacttcaaattatactacagagatatattaatgaaaacagcatagtactggcataaaagctgacacagatcaatgaaacagaatagagaacccagaaacaaatccaaagaactgcaataaacccatttttgacaaaggtgccaaaaacatacattagggaaaggacagtctcttcaataaatgttgctgggaaaaccggatatccatatgtacaagaatgaaactagacccctatctcttgctatatagaaaaatcaaatcaaaatagattaaagacttaaatctaatacctcaaactatgaaaccactataagaaacattggggaaattctctaggacattggactggccaaagatttcttgagataccctacaagcacaagcaaccaaagcaaaaaatggacacataggatcacatcaagttaaaaagcttctgcacaacaaaggaaaccatcaataaagtgaagagataacccacagattgggaaaaaaaatacttgaaaaccacctgtctaacaacggattaataactagaatatacaaggagctcaaacaattctatagggaaaaaataataatctgattcaaaaattggcaaaaaatctgaatagacctcaaaagaagacatacaaatggctaactggtataggaaaaggtgctcaacatcactgatcattagagaagtgcaaatcaaaactacagtgagataccatctcaccccagtaaaaatggcttttatccaaagacagccaataacaaatgtcggggaggatgtggagaaaagggaacccttgtccactgttggtcggaatgtaaattagtacagccactatggaaaacagtttggagcctcttcaaaaaactgaaaatagagctaccatatgatccaggaatcccactgctagggaccccaaaagaaaggaaattagtatattgaagagacatctgcactcccatgtttattgcaacactattcacaatagccaagatttggaaacaacctatgtgtccaaaaacagatgaatggataaagaaaaatgtggtacatatacacaatggagtactactcagccatgaaaagaaggaggttctgccatttgcaacaacatggatggaaccttaggtcattacgttaagtgaaataagccaggcgcggaaagacaaaattcacatgttctcacttatttgtggatgctgaataggaaaacagttgaacttatggagataggtagtggaaggatggttatcagaggcgtgaaaagttaatggtggcaatgagggttaaatggggatgattaaagggtacaacaataaaaagaatgaataagatctagtatttgatatcaataaaagggtaactatagtcaataacatttaaagataactaaaagagtataactggaatgtttgcaacacaaatgataaatgcttgaggtgatggataccccatttaccctgatatgattattatgcattgtatgcctgtatccaaatatctcatgtaccccataaatatatacacctactatgaacccacaacaatcaaaactttttaaaaatttaaattaaaaattaaaattaaaaagccctacagctaacatgtttaaactaagaagcttgatacttgtctcctaagattgggaacaaggcaaggatattccctctcacaactcctattcggcatcatataggaaatcctacttattgcaataagacaagaagaggaaataaaatgtaaatacaaactgggaagaaagaaaaaatactgggctgggcacagtggttcacaactataatccttgcactttagaaggccagaactgcaggattgcttgaggccaggagttcaagatcagcctgggcaacaaagctggaacccatctcttaaaaaaaaaaaaaaaaaaaaaaaaaagttaaagtagctgagtgaggtagcccatgcctatagtcccagctactcaggagactgaggcaggaggatcacttgagcccaggagttgagctatgatcctactactacactccagcctgggtgacagagtgagatcctgtaagaaagagagaaagagagagaaaagggagaaagaactgtctttatttatatagatgacatgattatctatgcagacaatcccaaataattaatttctggaacttgtaagtaattataaaaatattgaagaatacaaggttaatatgcagaaatcaattgctttcctataactacagtaaagagtcagaatttgaagtttgaacaataccatttacaatagcaccaaaaaataaatacttagataacatctaataaaatatgcacaggatctatatgcaataaactataaaactctcacaaaagaaagtagatgtgagtaagtagaacgatattctgtgttcatgcatggcaatacccaatattgttaagataccagttcttctccagcttaatctatagatttaacccttttccatttagaaaataaaaaagtacagctcactaccagcactcatttaattttacataaacacactctttgaggatgaagcaaatctgattgattttcaatgtgaaaatataaaaactgttcttggagttatttctaaacaaaactaacatcagaattgtctgaatcatcagaatcatctattttggaaaaactggattcgtcaaatgaatctttggccaacaactgttggagaatgatgttaatatcacatgtaggaatgctacattttctagaattttacatattcagtgaccgagaattactatattttctaagtggaaataccactaccaaaaacagaatgctataaatagaatgatgtcttttgtttccaaagttgatatactaaagcaatgcgaaaataataataaaagggagatatttcgtggcaaaagtatatcggggtaaatgcgacagctgcaagcactgccggcaagtattctcagggcaaatgggaaaagggtttaatgtaagcctaaccaaaaatcccagtaagttattttgtagatagcaaaaactgattctaaagtttatattgaaagtcaaaaggcccagaacagccagtgcagtgttgaagaagaacaaagtaggaggaccggcactacctgacttcaaaacttactgtaaagctacagtaatcaagatattgtggagttggaaaaagaatagacacatagaccaatggaacaaaataaagagctagaaatagactctcacaaatgtaggcaactgatatttgacagaggagcaaaggcaattcaagagagaaaggacatctttttaacaaatggcactgcagcaattggaagtccatatggtaaaaagctgaatcaagtcataaatcttacacctttcacaaaatttaacccaaaatggatcatagacttaaatgtagaagttgacacttataaaaattctagaagaaaatataaggaatttgaatttgacatagaatttttagatacaacaccaaaggcatgagaaaacaataataatccacttgactcagccatgagcaaaggttacataatcataataatcataaatactgagtactgatttagtttctcaaaatatgataaaactaaacttagttgataacagataggggaaaaaaagaggggagagattgtaagaggactgaagccatatcttttattttaggaaatcagatgataatacataaaactgataaatcaagaaatagcagtatatagatattgttaagacataggggtataaaacccagaaagaggttgacatcagcagcatggcagaataggaggtctccagccttggccattacccccaaaaaaacactgattaagcaactattcatgaagaagaatgcctttgtgagatttagggaacccaagaaaaaggttgcagcacaccaatggtgcaaaatatctgagaaaagctgcatttaaaaggataaaatgagtagtttccctctatcagatttacacttcccctaagctaccacagcacagtaccaagaaagatcccctttgcccacaatttctcccatagggagtttcacttatgaaacttagtttcactggaaacaaaatttttgactgataattgttttgtttaaggaggccaaagataggacaccaatcccttctagcttgtaaggtttctgctgagaaatctgctgttaatctgttacagcaaaaggggatacagcaaaagcagtgctaagaggaaagttcatagtattaaatgcctacatcaaaagctctgaatgagcacaaagagacaatctaagaccacacctcaaagaactagagaaagaagaacaaaccaacccaaacccggcacaagaaaagaagtaaccaagatcagagctgaactaaatgaaattgaaacaaacaaagaaaaaaaatacaaaagataaatgaaacaaaaagctgtttccttgaaaagatagataaaattgatataccattagcgagattaaccaagaaaagaatagggaagatccaaataagctcaattagaaaagaaacgggagatattacaactgataccacagaaatacaagagttcattcaaggccactatgaataccgttatgcacacaaactagaaaacctagaggagatgaataaatttctggaaatatacaaccctcctagattaaaccaggaagaaatataaatgctgaacagaccagtaacaagcagtgagactgaaatggtaatttttaaattgccaacaaaaaaaaaaatccaggaccagttggattcacagctgaattctatcagacattcaaagaagaattggtaccattcctattgacactattcaaaaaagtagagaaagagggagtcctccctaagtcattctatgaagccagtatcaccctaataccaaaacgaggaaaggacataacaacaaaaaaagaaaactacagaccaatatccctgatgaacttagaagcaaaaatcctcaactagctaaccgaatccaacaccatatgaaaaagataatccaccatgatcaagtgtgttttataccagagatgcagggatggtttaacatacacatatcagtaaatgtggtaccccacataaacagaattaaaaacaaaaatcacatgatcatctcaatagatgaagaaaaagcagttgacaaaatccagcatccctttattattaaaaccctcagcaaaattggcattgaaggggcataccttaatgtaataaagccatctacgacaaacccacagccaacataataccaaacagggaaaagttgaaagcattccctctgagaactggaacaagacaaggatgcccactctcaccacttttagtcaacataatactggaagtcctagcaagagcaatcagaaataaagggcatccaaattggtatagaggaagtcaaactgtcactgtttgctgatgatatgattgtatacctagaaaaccttaacgactcctccagaaagctcctagaactaataaatgaattcagcaaagtttcaggatacaaaatcaatctacacaaatcagtagcttttctatacaccaacagtgaccaagctgagaatcaaatcaagaactcaacccattttacagtagctgcaaaaaataaaataaaatacttagaaatataactaatcaaggaggtgaaagacatctacaaggaaaactccaaaacactgctgaaagaaattatagactacacaaacaaatggaaacacatcccatgctcatggataggtagaatcaatatcgtgaaaatgaccatactgccaaaagcaatctataaattcaaggcaatttccatcaaaataccaccatcattattcacagaattagaaaaaacaatcctaaaattcatatgaaaccaaaaaaatgcaagactaagcgaaaagaacaaatctggaggcatcacattaccagacttcaaactatactgtaaggccatagtcaccaaaacggcatggtactggtataaaaataggcacatagaccaatggaacagaatggagatcccagaaataaagccaaatacttacagccactgatcttcgataaagcaaacaaaaacacaaagtggggaaagaacactctattccacaaatggtgctgggagaattggcaagccacatgtagaagaatgaaactggatcctcatctttcaccttatacagaaatcaactcaagatggatcaaagacttaaatccaagacctaaaaccataaaaattttagaagataacatcaaaaaaatccttctagatattagcttaggcaaagacttcatcaccaagaacccaaaagcaaatgcaatgaaaacaaagataaatagatgaaacttaaactgaaaagcttctgtacaggaaaagaaacaatcagcagagtaaacagacaacccacagagcgggagaaaatcttcacaatctgtacatccaacaaaggaccaatatccagaatctacaagaaactcaaagaaatcagcaaggaaaaaaaaaaatcccattaaaaagtgggctaaggacataaatagacaatgttcaaatgaagatatacaaatggccgacaaatacatgaaaaaatgctcaacatcactaatgatcagggaaatgaaaatcaaaaccaaatgtgataccaccttactcctgcaagaatggccttaatcaaaaaataaaaaataatagatgttggcctggatgtggggaaaagggaacatttttacactgctgatgggaatgtaaactagtacaaccactatggaaaacagtgtggagattctttaaagaactaaaagtagatctaccatttgatccagcagtcccactactgggtatctacccagaggaaaataagtcattatatgaaaaagacacttgcacatacatgttcatagcagcacaattcacaactgcaaaaatatggaacaagcccaaatgcccatcaatcaacaagtggataaagaaaatttggtatgtatacaccacggaatactactcagccataaaaaggaatgaaataatggcattcgcagcaacttggatggaatggtagaccattattctaagtgaagtaactcaggaatggaaaaccaaacatcatatgttctcactgataagtgggagctaagctatgacgacacaaaggcataagaatgatacagtggactatggggactccagggagagtggtaggggagtaaggaataaaaaactacacgttgggtacaatgtacacagctctggtgatgggtgcaacaaaatcttagaaatcaccacaaaagaacttatccatgtaatcaaacaccacctgttcctcaaaaactattgaaatgaaacataataatttttaaaagaagataacaacaaagctaagagttgggtttttttttgaaaagataaacaacatcaacaagcccctagctagattacctttttaaaaagagaagactcaaataaataaaatcagacatcaaagaggaaacattacaactgaagcaataaaatgaaaagattttaagggattattatgaacgattatatgccaaaaaacaggcaacaaaagcaataatagagaaatgagacggcatcatattaaaaagcttctgcatagcaaaacaatcaacaaagtgaacaggcaacttatggcatgggagaaagtatttgtaaattatagctgataaagaataaatatccaaaatctataaggacatcatccaatgcaatagcaaaaaaataaataaaaaataacctgatcaaaaaaatgggcaaaagacttgaatagacatttcttcaaaaaagacacacacggccagcaaatatacaaaagctccccttcactaatcatgagggaaatgcaaattaaagctacaataagatatcacctcacaccagttaaaatggctattataaagaaaaaaaaggatgagtgtttgcaaggatatggacaaaagggaacccttgtacactgttgatgggaatgttaattggtgcagccattatggaaaatagtgtggaagatcctcaaaagtagaaacagaactaccatatgatccaggattctagttatatacccaaaagagttgaaatcagggtctcaaagaggcatcagcattcccatgtttttgcagcattattcactgtggtaaggacatggaaacaacctaaatgtccaatgagagatgaatgataaataaaaggtgtatagacatagaatggaatgttattcagcccttaaaaaggaataaatccttccatttgctaaaatgtggattaagccgaaatgacattattctgagtgaaataaaccagactatatgatcccacttatatcaagaatataaaatagccaaagtcatagaagcagagagtagaatggtggttacctggggctgggaagggaatcaaggaggtgttggtcaaagggtacatttcagttatacaagctaagtcctggagatctactgtacagcataaaagccgtaattaacaatattctactgtgtacttaaaacttgttaagcgagtagattttttttttttttttttgagaaggagtttcgctcttgttgcccaggctggagtgcaatggcgcaatcttggctcaccgcgacttctgtctcccgagttcaagcgattctcctgcctcagcctcccaagtagctgggattacaggcatgtgccaccaccctggctaattttgtatttttagtagagatggggtttccccatgttggccaggctggtcttgaactccccacctcaggtgatccacccaccttggcctcccaaagtgctgggattacaggcgtgagccactgcacccggccgtgagtagatcttatgttaaatgtttgtatcaccaaaaaacagagaggaaggttttacaggtgatggttatgtttatggcactgtttatggtgatggtttcaatggacttatacttacctgaaaactcatcatgtatacattaattatgtataccttcttgtatataaatcatacttcaatttttaaaaaatgaattaggccaggcaaagtggctcacacctgtaatcccagcactttgggaggccaaggcgggtgatcacttgaggccaggagttcaagaccagcctggccaacatggcgaaaccccatctctactaaaaatacaaaaattagccaggtgtggttgcacgcacctgtaatcccagctactcaggagtctgaggcagagaatctcttgaacctgggaggcaaaggttgcagtgagccgaggtcacttgtccagcctgggcgacaagaggaagactgtataaaaaaaaaattaaaatgaaatgaaatgaaatctagaaggaaccgctgaaagggttgaatgtggcttcctctggggcagaacagggcatgaagaggaaactaaagggcagttggtggggcagggagtttctgcttttttaatataaacattttagaacttttgatggtttcattctgataaacattaaaaaggaacactacaacacaactgggaaaaaaacctgacaccaccacccttcccttgcttagtgagggtgtgatactgtggtgtcatctaatgtctgtgttgctgatagactgggagctctgtcacagggcagggaccacatctacttcatagactgctgtattcacaggtctgacaccttctaggcgccaatacgtatttgttgaatgaaaaaaatatataagaaacatttcacagtggtagaagcagcacccagaggacagatgtgacaaatgatacagagatagccttactacagtttgacatcaggcactggcatagagcaggaactcagaaaggtctggaaatttgctctttattaaaggaggttggtgatgagagagagaggttggtagtccaaggaggtagcgagatcaaggaagacattatcatggctgggatatcaggacattgtttgcagtaccaaaaataagcatctagtggagggagggatataagcgatgccagagagagacactgaagataatttctgcaaaatatggaaaattatgattttctgttgtggaatttcagatgttcttcctcctccccctccagagctagcagttctgccgtgttttgatgattgcttgggccgttacagtgccttgctaaccacactccctacctcccttctgaaagaacacatgttccctacaatgttcgatgtctctacttaatgtttggcatctatgtgccttgagaagctccaaatgattccagttaagcaaaacaggtcatgaatgttattcaggggaattcaaattgaattctctccagggtaacatcaccataaaaccaggtagactttagaaagtgggactgcatggaagcacatcacttaaaatcactgtagacgtgtgccaggaaatgtgttggaggaaaatgttctgaaggagattattggcctcctttatggattaatcactctgatatttgtgatttagaatcaggaagaaagcacattacctcattacaggaattcattctgggaggcattcacaatttgcctctttctccagggatgggcggagggacttgtaaccttgaaaacattcttgcatgtgagaagtacagaaaaatattatatatttctgcataaggagaagcagtagaaagtttttgtttgttctgtttgcttttttttaatctaacataaattgactatgccaaaaactacattatctgatgaccacgtctctaaggtaggctgtatggtttatagcactttaccaaaagggaaactgaggctcaatgaagttaaatagtatccaaggtgaactaacaaatttgtggatgagctcagagttgatcccaaatatacgtaggcaggaccagttaatcgttgatctcataactacgtaggcgggaccagttaaatttgtgatgcccagtgcaaaataaaaatgcagagccccttgttcaaaaatgatgtaagactttcaagatggtgacagcatatccttaaaccaagtgtgatccccttctgagcacaacaccctgtgtgactgcacaggatacaaatgcataagcctgccccatgtatagatacctcccagattctgtacatttgggctagctccactgaaaaaaaattgggacagctttgatgaatattaaactatgattataccttaaaatattgtcttgaaaaatactgtaaacccactgtatatcaaaaatggacttctacaatgatatttgtacctgagttagagatgatttcaatattatttcagattggctccttctatttgaaattgatgcattaattttttggctttaccatacactttactaaggagaccattttgagccctgtttccatctaagctgatgtcctttgtcctattcctgggacctacaggctgttcatcaggaatcttggcagacccccacacacactgtgagcccctcacagccacgcaatccccactgctgctcaccccacctgacacagagtgaagactcaagaaacattcattgaataaatgaatgagtgcatgaactctaggaaactgcagcagaatttcagattttcaaaaatggagcaagaagcagtctccatgcaatcaatactcaggcaatggtccaagggacctttagaatggttctaaaattagaccattaggtctcaagagagggccaggtctaaaatcagcatttgagccaaaagtcaaacctgtccttgaaaagtccttcaggagcttcaggttggaggtaccatgagaggctcacagaaacctactgggtgagaagctgatgcacatcccatatcttatcccaccctggggcacatgctcattgcctgccaagccatgcagtaaattccagtaggttaaatgcacatgtgatgtaactgtttcttaagaggtaagtcagtgccttctctgaaggaagtgtttattactttatgtctgcagcatttcttcccccttctcaggggaagttgtaaaattctgaactctgcgttttataagacacttagtcttgcgttaaaacttcacccaaagtgatttatcttgcatcttgcaacatttctgtatctcacacattttctataatgagcatgaattacttttatagtcagtgggaaaaaaactttacagggagattttatacttagatcatttttttgttctgagcaaaacattaaaagaaaagctttccagagccctgtccccatccatcaccatctagccttcagagcagtacaggagcttggcatccaggctgaacactaaactgctgaaatgtgtatctcagattctccacttacttaatctgtctaggcctcagtgtccttatctgtaaaatggtactaatacaataccttctccaaagagctgctcatataaagcctttagcacatgtgcattcagtgtggttagctaattagctcttattgcatatgagtctgtgtcttcagtgctaatagcctagatctcaagcaacctaattccttatctaaatgtgaatgatagagcaagtttttaaatcctctttaaagtaatctcaaaaatagaaaggtgacatagctagaagagtaaaggatgatatatcgacctcactgcgccctcaagggctccagtgaccaccccaactcatgacagaataggatgaaatttggccatgtagcaaaaagagctactgagcttgacaatgtcattttttcaactgactatatatcatttatacccagtcaacatccaaagtagattcgaatgttgtacataccacttggaatctgaaaatgctttcccttccactttattggtggcaaaccagttttctaataattctctatgaagaccctgtgctaatagatgctgtctacctttgaaccacttgtcccttggctttacaacatcacacttttctattttgcttccctgttactagcccatctttcttgatctcctttttaggctcatcatccttgaccttatcccttaaatcttaaccttttccaaggccctttcatgggcccacttccttcagaccctgtactcttcctgggtctcagtctgtcctgatagtttcaaccacaatcttcttttgccaatgaacttgatacctgtattgccaaatcagtcctttcttcaaagtccaaatccatagaactgactgccttcagaacatctccacttggatattttacaggtacctcaaactcaacatgtccagactgaactcatcatcccttcaaacaggctcccttacagcattccctctctcaggaaatggcagctgtttccaccctgctaatcaagccaggaatctgtgattaatccttaactcatctcagtttcctcattgcctaaatctaatcaatcaccatgttgtcttaactatatttgttaaatcagtgcctgtcaaatttcttttacaggtatacacacataactgaaatagaagtttcacaaaataattcttatcatcattatatgcaaggccctgtaatattttctcctctgttcacttctgttactgttttaaaatgctagtaacagtgagttactgacaaatgtttaacaaccagctaggtcttctggaggcaagggagggaatacctgatgtgtaacatttgcccatatccttggtgtgactattcccaccatggctgaattcaagctactgaccaaccagcttgcaaaccacctaaagatttaacaaccagctctcatgacaatctccagcacgccacactcatgactcaacagtttgatagacactggtctaagtgttcttaaatctttcagctaattttcattgccaatgctattgttcctctcctagccactaccatttctgatacaattggttcagctcaatctgatctatttcagatttatttattttcaaagactttatatttgcacactaggacggagtctacaattcttaccatggcttaaaaatcaacccatggtttggcacctgcctgctccttctgccctctcttccttgatcacaacaaaagtgttctcttcttgaacttctgggagcgttctcttgttctcagttctttagacatgcctttttttggctagaaagttctttcctcccatctttactcaatgaattcttatcctttctatcacagtttaaatgctactttattcattcattcattcttctagtgtgtgacaggcattctgataagtgctgaggatccaaggagaggtaaaaataaacagtccctcaccccaccgaacttacactgtagagggggagaaacatattatttaaataaagatattcaaatttaagtatgaataaaagagctttaaaaatgaatgagagccctagttctataagaacttataaaaatctgtcctaatctgatggatcaggggagactttcccggagtaagtgataattgatcagttgtaccagttgagctaatatagaaaagatacatataacctaattattctaagtggtggctaactaacagtacaggcagaaagaagaatatgtgaaaacccacattgcaggagggaacatgacaagatcaaggaaccaaatgaaagccagtgtgacaggaatgcaaagaggaacaggagcaagatatgggatggggccaaagagaccgatagaagccactctatgaagagcactctagactttgttgaaactttgggtctctaacaaaaaatcagtgggaggcctttgacatgttgaaagcagggatatggtgtgttcatacttctggtttggaaagatcactctggcagcagtgaggatgacatggaaggaggaaaaaatagatgtagagacaaattagaaactatcacagtcctctagacagaaatgcttctaacacaaattaagatgctggtgatgcacatgggaaaaatcaacatattagagagatgtaaggggtaaccttgataagacaagctaatggattggacaatcgctacactcttcctttccaacttgggcctggcagaatggttctcacaaagaaggatggcaagacaaaaagggccactctgccatcaacaaggtggtgacctcgttgatgatacaccatcaacattcacaagcgcgtccatggagtgggcttcaagaagtctgccccttgggcactcaaagagatctggaaatttgccacgaaggagatgggaactccagatttgcgcattgataccaggcccaacaaaactgtctgggccaaaggaataaggaatgtcccatactgtaaccatgtgtggttgtccagaaaatattctgaggatgaagattcaccaaataagctctatacttcagttacctatgtacctgttaccactttcaaaaatctgcagatagtcaatgtggatgagaactaactgctgattgtcaaatacatcaaataaagttataaaattgtaaaaaaaaaaaaaagataatggattaactaaatgtgatgaaagagagggaagtatcaaagatgacttgcaatgtttgagttacaaaactgaatgaatgatagtactatttgcagaaataagaaatactggaggtttggggagaaagaacatgattttgtctttagatatattgagtttgaggtatctttaagatgggcaaaatgagatgtcttaagaacagtttgataaactgcctagaatagaggagagatctgggttaggatataagtttgtaaaatacctgtgtataagtagtgaacatgatgccatagccatgaatgaactcatcaactgagaatgcataagagaaaacagtttggaaaccaagatttaagcaaatccaaaaattagtggtagggtagtgaagggtgcactgacaaagggaagaggaacagccaagtggtaggaggaaaaccaagagaaattgatgtcaaagaaaccagtatcttttggtcgaatagcaagaagagatgccagactgctgtgggtgaaagtgagtacaatgtacagatatggtgtcagtgaatctggaccacttattggagaagtttgcttttgaagaggagagacttgagtagtacttgtgaagtatttggaaacttttgattgtgctttaatgaaaggcatctgaacatattcatcagctatgaaaaacattggtttgaaagaaagttaaatacacaagagaaagaaagactaaaggcaagtgggaggtttaaaaaaagttggggaataatccctgtgtacccatggcacgcctacacttaccctttcttaattctgactacacttgtaattcttaattatctgtgtttctcattacactgtactccatgaggacaggagttagctctgcctcatttactttttttcatcgatgcattatagatgtacacagtttcaaggtatatgtgtaatttaattcattcatataagccatttactttgtatcatttgtgagtaacaaagcactcagataggaggcatgaataaatgttatttttttaattgtacataaacgtgaatgcaaacggaggtacatttaataaaatagaccatccaaaaatcttattatgctaatatgtgcatatatatgtatgcacacatatcatggttattgatttcttaagctaaaattaaaattggtaccatgaccataagcatatgttatttgatcactaagacaagaagaccttagaaggagagaaattaaaagtcagccaagaactaagcactctccagatagatgggcaaggccatgagtcatctttgtgcagagaattgagccctgataaaaatcaaggaaacaaatggtgaaagcacaacttgttaagacaagtggatgcatcattcacactgatccaggtgaaaccccaaataacaggatttctttatctgagatggtttgatgacctaacaagttaagaaaaccaaaccaaaacaaacaagaaacgctcaattccattttggagacaatattgaatgcctcatttagggaagcaagtccatgcagcaaaaaagaaatcagatgtgcacttctttcccagctttgccagttttatgataagttctttagtctgatctcagtttctttacctgtttaaagagaataatcatacctaatagggtggttgtacaaagtaaaggagattacatctcatgtttataagcaccacactcagaagagctgtctgcttctctgcctcgtaggttgcaaacctgagaatttcacattacattagcagctctgacatagtctcatttataccctataagctctgattcatacaatagtacgatgagaatgccatgctatatctagaattgctgagaagactagatgacattgtgtgctgaaggaactttgtgaaatacaaagaactacttaaacaagtagtcagcagatgacagccggtgtgccaaatccagcccaccacctggatttttgtttgtttgtttgttttatgactcaaaagctaagaatggttttcacatttttaaatagttgaaaaaatcaaaagatgaatatttcatgatgtgaaaattacatctaattcaaatttcagtgtctataaataaagttttattggaacacatccacactcgtttacatattgtctatggctgcttttgcactacaatggcggagttgagtaggtgtgatcgagaccatatgggaatatttactatctggttctttacagaaaaggtttccctactcctgacttaaattaaatatagtgacaaaaagcataaagattttggaggttttttttgagattaaaaaaaattcataagttattggcgaagtgcctgccatatagtaatggctcaataaacagatgttgctgtttatattccttcattagattattaattcaacaaatagttattgagtgcatactctgccagatactgctccaagaaccacagaatacagcaatgaacataattggacaaaattcctttgctcattgaatagacaataaacagacaaataaaaataagtagagtatattatttggctgggagaaaaaataaaggatgaaagaatagagagtttgagggtagaggttgcaatttttagatacagtggccagggaagacatcactggaaaggtgacatttgagtgaaaacccgaaggacacaagggagcccaaggggatgctgtgggggtggtgaggagtattgttctgggcaggggaataatacaaaagcctggaggcagagagagcttagagtgttcgaggaacaccaaggagttgatgggctggagtggcggggaacgatggggagaataacaggagattaaatcagaaaagtgcggggtagggccttgaagaaccatctagggactctggcttgtactctgagtgggagaggaagcaagttttgagcagaatagtggcatggcctgactcacatttaatccagatccatccgactgctccagtgcaaacaccctgtagcacagactgattaaaattttataagttgatttgcaacatcaattacagcttaatggtgttaaattgggggaatattgcatattctctccatggaaattaataaaccatttgatgggtacacagcaccttccttacattatttaagacaatgtcagaatgatgaaactgcttctaatttatggacaaacaatatgatatctcagaatcccacagggtagttctaaccatttaatttctgcggattctcacaactgcttcagcttttctaacagaatctttggactaacatggcctctttttttgatacaaatatttttgtttggacagtgattgagactgacctggacagacctagagaatgcctctttgctgtaagattgttcctcaatctttctttcattactacttccctctaccaaggaacctttgtagacctgttttttttttcctaatttccaccacaggaacattttttattgtgctaaaatatacataacataatatttgtcattttagctatttgcaagtatactatttaatgtccttaaatgtatttacaacattgtgtaaccatcaccagtatctatacccaaaattttctcatcatccccccacataaactctgttcccgttaaacaataactccctattctccactcccccgagtccctggtaactgatagataccatgctttctgtctctgtgaaattgcctattctaggtacctcatataagtggaatcatatacaatatgtgacctgtgtctggcttattttgcttagcataatgttttcaaggtccatccatgttgtagcatgtatcaacattttactcctctttatggctgagtaatattccattgcatgcatatgccacatttgattgtttgttcacctactgatgtgtttctatatacatatatgtacatctgtgtgtgtgtatatatgtgtgtgtgtatatgtgtgtgtgtgtgtatctgtgctttctacataaaaagtgcaaaattgttttaccaccaaccccagaatgaattttcgcctgcaagaagaggggggatctcaccctcattgataacgcaggttctcaggtatagatccccaggtttcctgccaaaaatgaggtacatgtgtaggtaatgtttattattattattattattattattattattattattattttgagaccaagtctcactttgtcacccaggctggagtgcagtggtgtgatctcagctcactgcaacctctgcctcccagggtcaagtgatgcttgtgcctcagcctcccgagtagctgggattacaggcgcgcaccaccacgcccagctaatttttgtatttttaatagagatggggtttcgccatgttggccaggctggtcttgaactcctgacctcaggtgacccaccctcctcagcctccgaaagtgctgagattacagatgtgagccactgcaccctgtcagtaatatttatatgtagataaaccacttagagtgaagccaaggataaggaaaatgacctcagaacacataagtatgaaaagtcatctttattcccaatgcaatagagttatctgtattttatttagtcttcacaattgccaacagtttataaaggaatgaactcaagaatgtttggaaaacagctgtaagcagtcatgtcaggaccaagccaatggagccgatattctaactaaacttttgaaagcagtggcaattcatgatgttactattcccactgagtcaaaaatatttctggaacacaaagagaatgattaagtaagaatgtaaaataggaaaaaaaatgaaatcaatgtcacatctgaagatcagaggagtgggaagctggtacctgctagggtatgcatggttgtgtcagcatatggcatgagtgttggtgtctagttggaaggccatatggcaaggtatctggcacagactcacctaggtcttattctcctgtggttgcccaatgccatattgtctcattctgtaaagaagagatttaaaagattgttgaacagtgttaataaagtcagccatttcaaatacatgaccagattgtttaacagtgttaataaagtcagccatttcaaatacccttcaaatatcatcaaagacaagtagagactgagaaactgccagagtatgagactgcggagatgtgaagactgaagaccacatggggtcctggattggatcctggaacagagaaaggacattcacaggaatactgggaaattctgaataaagcctataatttagtactgtcatatcaatgttaattttttaattttagtcaattgtcccaggattatacaagatgttaacatgaggggaagctgagtgtgttgtgcttcttctgtgagtctaaaattatttcagaataaaaagtaaatgaaaataaacagcaaccaagtttccagtagctcctgagtatcagaagcgaacttgagactggcaaatgctgaagcatggggagagtgagggagtgtatatttgcatcatagcagctttgatgcctgccataagagtgactcctgtccttgtctcctttccgattcttttgcagggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtaagtattgtctgagggaacataaaacaagagaattactgccggcaacagtctatgcagagactgagggaaaattccactgtagcctcttcttttagccttcacacaggatctcctataaagagctccatttttaaaactacaatatgaatttaagagctgctgacagttacctgaaagttttactagtcacttggtcttgttagctagtaaaacctccaaatctaaagaggaaagaggcatgtctataaaattttatagggaaaaatgtagtgttagcaaaaaatatatattagggaaatttgtcctcattaacaacacaatgctgccttagttagctaaagggacctcaaattaaatagatacattattaaatgtaaccaatctcctttaaagtcacccagatctccactttctatgtgggtgcagtcacctgggagaggtcttactaccattctgctagagctctatctaagcagtgtgtgatgctccggccaccttgactcaccagtggctgtcacggaaagtctgaaagtggcaaagagctacaagcagtaaaagataatatttcgtggctggaaaaactcttttaacctgtgatttgatttctcttttgtttccatttatggcagagcctccatcttggcaaggcacgtaatcttatccaagctgtgcaaaacctgtccaaagtgtatgtacaataacataaaaattgaaaggtggaaaaagcgccagcacagacatgtagtgattgagtcctgcatgaaaatacatccaaaggcaagatggtttggagattttaggaagccctggctctttcctctgacacaatcacagcattctagacatccccagtaaatggactctgtgacacagacattgagcaccctgctttgtgccagacaccctgccaggagctcaatggaatcagacaaataacgcacagtgagtgcatggttactgtgcatggttactgaatcagacttttgtgtgtgtggatcctctaagattgtatgtgtcagggtattagccaatgttaaatggcgcagaggaatttgagggtttcttttctcatcagcttttgattttaatcaatgttctattagaaaaagtatcaacatttttaattctgttcaggccacagcttggggaacaagacactaatcttttaataatgttccacctgttcaatggaaatagtgatctttctccattaatttacagaagtatttagttacttgacaaaaatattttgagaacaaaatataaacctttctcagcttcttggaagaaaaactgtatttaaacttaaacgaatgtgtccaatatatgttattcaggaagtacttaagtacctgcttacacttgacttgattgatttgacagtcatttggccacagttctactacttctatgagaggatgacctgaaaaccactagagagaaatatccactctacattaatagaatactgctttttagcagctttgaatgaggagttaaaaatgaataatgaaattaaggttttttgaatgatttgtttaatttatgccattcttttaagtaacataagattgactaactttttttaaaaattcattttagatatgaaaattaagtttatgtacctaggaccatctagttagttccacaaagacagatgttttgtgccaagtaagtatcatcctcatttacaagaggggtcacaaactgctggcctcccccaacttctacctatcaagttctgttaggcctacatcgtggaatttttgtttttgaatcagtattttaaaattgggtgattttggctgggcgcagtggctcatgcctgtaatcccggcactttgggagactgaggcaggtggatcacgaggtcaagagatggagaccatcctggccaacatggtgaaatcccatctctactaaaaatacaaaaattagccaggcatggtggcgtgtgcctgtagtcccaggtactcgggaggctgaggcaggagaactgcttgaacccaggaggcagaggttgcagtgagctgagatcatgccactgcaccccagcctggcaacagaacaagactccatctcaaaaaaaaaaaaaaaaaaaataggagatttcacatgaaggccagattttcagcttcttaggaaatattttaagatctggaacacagagcccactgttctattctggtgacaatggtttagaatagagtatcagttatcccttggctgggcacggtggcttacacctgtaatctcagaactttgggaggctaaggtgggcagatcacttgagcccaggagttcaagaccagtctggccaacattgcaaaactccatctctactaaacatacaaaaatgagccgggcgtacatgcctgtaatctcagctacttgggaggctaaggcacgagaatcgcttcaacctggaggcagaggttgcagtgagccaagatcgtgccaccacactccatcctgagccacagagtgaaactctcagaaaaaaaaaaaaaaaacagaaagaaaagaaaaaagaattgagtatcagttatccactttagatgactaactttccctcgttctcacctggccactttactcagtcacattagctgcctgattctgttagctgttgagtcaaaaactactcactaaaagcagtgtgttaggatgaattgaggacatgggagtacagtactacaatcctgagtatttcacatcagttactatacaatcccccaagaagaaggaagattgcattggagccaccctcctttttccataatggtttttaatagctcaactctgtctacttgggtaacttatgttagctacaacttcaagataaaaatcacattattgcagaatcttactgctgaaagagagattggaaatcatcgaaaccgaccctttcctttcaccaaaagtaactgaggccccaaaatcttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaaaaaaaagaaagaatcatggttcccaagcaagtctgaagctagcgggggaaattccattccattttaaggcttgaaaataatcctctttggctagatgttctgtcctcagggctcacaggggaggggatgcatagccctgccttccaggcacagggtcacaggagccccacccccacagccctgggcaatagttctaccctctacaaccaaggaggagccagtcgctgaaccatctttgaagccattggtccttcatttcatcctgtctctgtccctttcagtccatgctgtcaatgtttctgctggtataaaattctcaaaaaccttattggcctcccatgcaagtcatgggggtccaagcagtcagacaagagggcactccgcggatctttttcagataaccacctctctatttctggcatctactgtggaggttgattggatccgtgagtcacgtacctaatttcgttagcacatggctgtccagccacacccttggcattctctcccaatctgaggtactgagagttaagcacttcgatgtagcagtttggcggggtggagcgcggggggggacacaattcacagctgaaatatttctttacttaagctaagactttatcccaattttggtatatctgaccagtcttactaaagctacattttgtaagaccagaaatgagtcttttcaaaaccaaaaggttggtgtgaggacagagaaagtaggcaagcggggagacaggagacgtctatgtgtgcagaaacctgcacctcttctcctccagctacccgtgcaggtcatttccccccaggcccatccaggtctagcgatgtcccagcactgccccctggtggagccctccaccggcctgcaggaagggcatgtgactgactccctcagcgccctgcagtcttgtcccctctggtcccaaaagtgtatcctgccttcgctttgcgataggtttcttcctgccctttgcctggaaattttatctctggttcttgcaaacattatttacagctgtctaattttttctgtctacctcacagctgccaaactaaagtaggtgggaagccattttccctctctaggtcaatgaataccccccgttctccacccgcgcttttgaagattccagcactgctgccaagtcaacccatctgcaggagaacgctttggaaaaaacagactttaaaaagaaaagcaaactgctcttagcccctgatagcttctccacaggagagggaatatggacagagctgaggttcaagacacatgtgctgtttgagctgaatctgtgctgttttcttctttccgtggttacccaacaacgaaggcgtgttgtaccttcttgccttcaaacctgttcctcctcccgtcagatgtccttactcctcaatttgaagttttccttcataggatttctgagaaggactttggaaaaagtgctccagatctctgccagttccttagccatgaaaaccaaacataaaagatcatctggggacattcattcagagcacgttacccacattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgtgtcaggagggtgaatgggagaagtgagggcagatgagtggatgtgtgagtagtgttagcaagccagattaaacaaactgcttgtggtttaatctgatgctcaaataaaacactttgcctgtatttctaggtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaacctgacgtctgcattgtgcatctcaaaatcctaacagcattagtatctccttttcatttttattacctgttgaaaatgggtttactgaacctggttctttcctataatttttggattttaaaaaatgtgaatctttttgataactccaaaacaaattttttttttctttttttccagatggagtctcactctgtcgcccaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaagcattaaactttttaatttgaaaaaaatttaaactcaaaaagttaatttaaaattagttacatttaaatgtaattaaatgctaaaaatctctcttccttccgtctctctgtctctctctttctcccacacacattcactctatatgccccccatttctgaaagcaaaattgatagaaatatagaatgcatctagcagcattaccatattagtttcctaactcatggagctgggacttttaagtaggaaagtcaagcagaaatccaccaaaacagaaaagcacagcaataccacatccttggaatgactgctgcagttagtacaggatcaaagacttgaaggatccagagttggtttccatcacaactacatgtatcttacctgtctgacctctattatgggttacattgtggcactgtgtccccctaaaatttatatgttgaacccgtaacccctagtgccttagaatatgactgtttttggagacagggcctttaaagaggggattaagttaaaatgaggccattaaaatgggccctaatccaatctgagtagtatctttgtaaaaagggggaattaggacacacaaagggacaccaggaatgtacatacacagaggaaagaccatgtgagggcatgggaagaaggttgccaactgcaagccaaggagagaggactcagaggaaccaaacctgctgacaccttgatcttggacttctagccaccagaactttgagaaaataaattaatattgtttaagccaccagtcagtggactgacattttgctatgtcagtaacagcaaattaatacgaactgtgtacaaacgatggatgaattttggaggatgataaattattgtaagcttacttaggcggtggctccactgatagcagtgtttccagaagtctttttgctggagtaaaacaatataatccctgggatatcgaatgaaggtactaaaaaatttttttttgtttttgaaacggagttttgctcttgtttcccaggctggagtgcaatggcaccatctcagctccctgcaatctccgcctccctggttcaaacgattctcctgcctcaacctcccaagtagctgggattgcaggcatgcaccaccaagccctgctaattttgtacttttcgtagagacgggtttctccatgttggtcaggctggtctcaaactcccgaccttaggtgatcacccgccttggcctctcaaagtactgggattacaggcgtgagccattgcgcccgtcctaaaattttcttgtagtgggaaaatggggtggcgaggctgggcgcagagaggctggggctgcggctcagcgtgggctcccctggtgcgcagcagcagctgcgaggagctcactgcggttctagccccgccgcagctgcttagacgcaggtttaacttctttattcagaaaaaaatgtggttcagaaaagaacccagtaaggttgaacctcgaagatcagacacggcaacaagtggtgaagcatacaagagaagtgctttgattcctctggtggaagaaacagtcttttatctttctccctatcctataaggactctcataaaacctttatttttttactgttgggtttacaggctgtgcatttggatcagctgctatttggcaatacgaatcactgaaatccaggggtccagagttattttgatggcataaaagctgattggttggatagcataagaccacaaaaagaaggagacttcagaaaggagattaacaagcggtggaataacctaagtgatggccagcggactcaggtatcatagctgcaaacgtccttgtattctgtttgtggagagtaccttctctgcagtggacagtgatctgatatttcaaatctaatccagcctcaaaagtccgttgttctccaatgttgctgtcaacattcaatcatttctccttatttcacatggcagcaaatatgtatgttttgtggagcttctccttcagtatagtgaacattctgggtcaagagcagttcatggcagtgtacctatctgcaggtgttatttccaattttgtcagttatgtgtgtaaagttgccacacgaagatatggaccatcacttggtgcatctcgcgccatcatgatgatcctcgcagctgtccgcactaagatcccagaagggaggcttgccattatttacttccaatgttcacattcacagcaggaaatgccctacaatccattaacgccacggatatggcaggaatgatcctgggacggaaattttttgattatgcagcacatcttgggggagctctctttggaatatggtatgttacttaccctcatgaactgatttggaagaacagggagcctctagtgaaaatctggcatgaaatgaggactaatgcccccccaaacaagaggtggctctaagtaaaactgggattgcacagtaccggtgcacctgtcttgtcctgccggagagccccaggagacatcggccctagagtgatcatggctacgttcccgcctggaagacgccagcatctggcctcccactgttttcagctgtgtccccgggtccgtgtcttttcagaaagtgaaaatgacatagttgtgacgtaaaggtttacatctagttcgtaaaaaataaaaaaataaaaataaaaatacattccttttaccttgcaaggatagcagaatgccctcactatattttctcaaggctatttctttgtgtgtttgtgtatgtgtgtgtgtgtgcatgtgttataaatatttttaatttaacttttaagttcagaaataaatgtacaggtttgttatataggtaaacttgtgtcatgggggcttgttctatggattattttgtcacccaggtattaagactagtacctattagttgtttttaataaataaacaacaaatataaaatgatcctctccctcctcccactctccaccttctgaatggctccagtatatgttgttcccctctatgtgtccatgtgttctcatcatttagctcccatttataagtgagagcatgcactatttgattttctgttcctttattagtttgctaaggataatggcctccggcttcatccctgttcctgcaaaagacatgatctcattctttttttatggccgcatagtatttcatggtgtatatgtaccacattttctttatctagtctactattgatgggcatttatgttgagtccatgtctttgctattgtgaatagggctgcagtgaacatatgcatgcatgtgtctttataatagaatgatttctattcctttggttatatacccagtaatggaattgctgggtcaaatagtatttctgtttttaggcctttgaggaatcgccgcactgtcttctgcaatactggaactaatttacattcccaccaacagtgtagaagcgttcctgtttctccacaacctcatcagcatctgttatttttttgactttttaataatacccattctgactggtgtgaaatggtatctatctcactgtggctttgatttgcatttctctaatgatctgtgatgttgagctttttttcatgattgttgaccaaatgtatgtcttcttttgaaaaatgtctgttcatgtactttgaccactttttaatggggttgtttgcttctgataaatttatttaagttccttatagatgctggatattagacctttgtcagatgtagagtttgcaaatgttttctccaattctctaggttgtctgcccagtctgttgatagtttcctttgctgtgcagaagctctttagtttaatttgatcccatttgtcagtttttacttctgttgcaattgcttttggtgtattcatcatgaaatctttgcccaatcctatgcccaggatggtattgcgtcagttgtcttccagggtttttatagttttgggtttttcatttaagtctttagtccatcttgagttaatttttatatatagtgtaaggaagaggtctggtttcgtctcctgcatatggcttgccagtaatcccagcaccatttattgaatagaaaatcctttccccattgcttgtttttttgtcaggtttgtcaaagctcagatagttgcaggcatgtggtcttacttctgcattctctattctgttccattggtctatgtgcctgtttttgttcagtactgtgctattttggttactgcagccctgtggtatagtttgaagtcaggtagcatgatgcttctggctttattctttttgtttaggattgccttctcaaggttatttcaatcatggctttatatcatgatttagtccacagtgaccttgtttgtctaactgtcccatgggaaatcaagtttctattacattgattatatcacactgctagaagaattcagcaagtaacctagataacttgagaagacacaggcatgccagagggtaatagataaacagcccccttaaaaaaattgggccatctacctttgtgaagtttctagggctgcagtgatctgaatgagacatatcaatatatgccctctgaagtaaaatcaaattatttcattttgcgtgcattactactatgaaagaagcacattgcttggtatgtcttattagattttgaaggaagcatatgtcgcattgagtgtgctgttcttatctctagatcacaaccagagaaaaattgagttataaaaattataacaaaaaatctaaaatcattacaatttgctgatgaatgattttttttttttttttttgagacagagtctcgcactgttgcccaggctggagtgcagcggtgccatctcggctcactgcaacctccgcctcccaggttcaagccattctcctgcctcagcctgccaagtagctgggattacaggcgcccaccaccacattcagctaattttctgtatttttagtagagatggggtttcactatgttggcaaggctggtctcaaactcctgaccttgtgatccgcatctattactgccaaaaaccatctcaaaacttagttgtttagaatatttatttgcaaatgaatctgcaacttgggcaggacttggcagcctgagcttgtctgtgtgccactggttatctgctggggtgacttgaaggctggtggcaagaatcctctgaagttttgctcacttatatgcccagtgattgctgctggtggttgactgaggcctcagctaaggctgtgactggaacaactatatgtggcctctccacattgcctcttggcttcactccatgtgactgtgtgccttttccatgtggttgcttggctttatcacaatgtggtgccaggatcttagcaggcccagatgaaaagtttttatttaatataacttagagtcagaagtcacatagtatcacttctgctgcagtcatagtctgacctaaattcaaagtaagggaatgtagatccccatgtcttgatgagaaactatcaatgttacattgtaaaaagaatatatgtgattatgaaatattggtggctagatttggaaactacaatctgtcacacacatccaaaacaataaactgaaagctgactttgaaattaagataataaggttatagagtacaaatatatgcaaatccatagttttattatccataagatgtaatgggatataatgaaaggaaaggaccctttgcaatagcaacaactttatgaaaaaatttttgaaactattaaatgatgcaaaagaaggtttgaagaaatggaaacatataccatgtgcttagaaagcaagactatatcatagataccaagttccaagttaatttataattcaaaaatacaaacctttgttttttatttatatgctttgtttatttttgaaactagacaagttaatctttaagatcatatgtaaaaattaacaaacaagaattgttaggaaagctctgagttaaaaaagcaatgagaaagaactagaagactagcccaaccaaatattaaaatataaatgcctcatttaaaaaagcagtatgaaattgactatgaatacaccaactaatacaacaaaataggaagaacaataatagaaataaatacatgtgggaatttagaatataataaaagtagtacctcaaatcagcaaggaaggagataggttattcaataaatatcattaggacaactggaaggtgatctggataaaaaaaagctgggtctatatcttgcatcttttaccctgacatatttttacaaatggcttatcttcctaatatatatagagatccttaaaaaagaaagaaaacaataacctaataggaaaataatggcaagaaaacgtgaataattcagagaaaaacaaagtatctcttaaacaaatgaaaagaatgcaacttcaatcataataagaaaaaatacaaattaaagccacactgaatatcatttatatctattggattgtcataacttctagcctttgaccacgcgttgtattgaataagagtatagacactttcataattgcttgtggaagtacaaacaggcacagtccttatagaaaggaatttgtctatatcttttaaaattgcaaatgcacaaatcatttgacctagcagttctgttactcagaacttatgctaactcctgtttccacatatgttaagcttattaattgcagcaaagtttgtaataggaaaaaatggaaacaattgaaatgttaataataggaaactgcttttagaaattatgatgcctccatttaatgactactataaaaaggaggagctgtaaaaagaaggaagaagagagaaaagaaatgatgacattctgtgtactgatattgaaaattttctaaaaatctattttaaattctaaaaagaaatatgttgaatagtgtgtatagcatgccgattttcaaaaaggatggggggagataaaagaatggatttttgcttgtatacacataagaaaactttagaaggatacataaaagtgtaaaaagttgtccgtttaaatggtagagggggaaacgggactgataaaatggaaataagaattggtgggagattgttcattatacatgttatttttttatttttgaaaaacctaataatattacctgttctaaaaaaggtagttaataatcttaaaactaattctttgaggaaggaaaagtatgttaaagaggaaaatttaaaagggattgcaatttattcaggaaataatgacacaatacctcataattaaacttaatgaatgtggccaaagctgtacacacaaaaaatgtaaccttagattttatttttatacaaaactaaatgaagaaaacaaactacatattcagcagaacaagtagaaaacaaaaacaaatcatagagaaatataaggaaataataaaaataaaagcagaagttaaataagcagaaaaacagcaaaattgataaattgattaataaatacagtatctcacctataaaagtgtcaataaatatgcaaactaatgacatgttaactggaaagaaagagagagagagaaacacgaatacttgacaatataaacacagataggaagaaaatgtttaattacagaacgttttttagcttcatggacacaaattattagaaatcaataaaatgtacaattttcagggaaaattgattcagtaagaattagaaagctttaataagcttacatttagggaagacattttaatttttcattaactatctccaaaaaaggaattgggtccagagcatttgatgagcaagtccttaaaaaatctttcaaacaacaattcttgtgttattttaaatgttccaagattgcagaatgatgaaacacttcccaaattacttttcaaagttaatataatccttataaaagccaacaaagaaaaaaatgtacttgctttaactaaaatattggcaacataaattcaacactaaatacgttttcatgtctaaatagttctatgctaaaaattcaaggatggcttaatagaattttcattaacactactacctcaataatgcacaaaagaaaaaaatcatgatattctctatagttgttctaggacatttgagaaaatttaacattgatttatgataatattagtgaaagaaaaatataaaaatatcccatatcattataagaaatagccatctaaaacaccaaaggctttcccatttaaagtcagaaatgagacaaaaatatccacaacactgttattgttcttgtttttctgaggagttggggatgtcagatctagcttcaaatgagttatatttttaccttcaatgaagcatcatttttccatttttagttgacatgtaataattgtgtatatttatgggatacagtgtgacattttgatacatgtatacgatgtataatgatcaaatcagggaaactggcatattcatcacctcaaacatttatcatttctctgtgtttgaaccttcaaaatcccctcttctggcttttttaaaatatccaataaattatagttaactatattcatgctgcagagcttcagaacaccagaattcatttgccctatctagctgtaattttgtatctgttaactaacctctccccacgctcccctccctctacccttcccagcctctagtatccataattctaactcttttcttccatgagctgaatttttttgtagctcctacatatgagtgagaacatgcagtatttctctttctatgcctatttcacttaatgtcctataggctcatttatgctacacagatggcaggatttcattttttgtggctgaatagtattcccttgtgtgtgcatgtgtgtgtgtgcgtgtgtgtgtatgtgtgtgtgtatacaccatattttctttatccactcatctgttgatggacatttaggttgctttcatatcttagctattgtaaatagtgctgcaataaatatagggatgcaggtatcccttcaatatactgatttcctttccttcagctaagtacccaatactgggattgctggctcatatgctagttctagtcttagttttttgagatagctccatactattttccataatgtctgtactaatttacagtctcaccaaccgtgtataagagttacctttattccacatccttgccagcacttatgttttgtttgtttgatagtagtcatttctaactagggtgagatgatatttcattgtggttttgatttgcattttcctaatgattagtgatgttgagcattttttatatgtttgttgcccatttgtatatcttctttagagaaatgtttattcagttccttcgcccactttttaatcagattatttgtttctggtgttgagttgtttgagtttatgagttcactgtataatctagatattagcccatagtcaggaaaacagttcgcaaacattttctcacattctacaagttgtctcttcactctgttgttttctttgttgtgaagagcttttttagtttactataatctcatttgcctatttctgcttttgttgcatgtgcttatgaagccttaaccataaaatctttacctaaatcaatctcctgaagcatttcacctatgtctttaattttaattgatttttgtataggtaagaaataagagtctagtatcattcttctgcatatgaatgtccagttttcctagcactgtttatttaagagggtgtcctttccccaatgtatgttcttggtgcctctattgaaaatcagttgtatgtttctgggttctatgtatgtttctgggttctctagtatgtatgtttctgggttctctagtctgttccattggtctgcatgtctggttttgtaccaatacaatgctcttttggttattatagctttgtaatatattttgaactcaggtagcatgatggctccagctttgttctttacgttcactattgctttggctatttggggtctcttgtggttccatatgaattttaggaggtttttttaaaaatctatttcagtgaagaatatcattggtattttgataaaggttgcattgattctatacattgctttgggtagtatgatcatttaacaatattaatttttctaattcataagtataaaatttccatttgtttatatcctttttaatttctttcaagtgttttgtagtttttgttgtggagttttcttacttccttggttaaatttattcttatgtattttattttttgtagtcattataaatgggattgctttcttgatatctttttcagttagtttgttattggtctatagaaatgctattgatttttcatgttgattttgtatcacacaactttacagaatttgtttatcagctcgaagagttctttggtagagtctctatgcttttctataaataagattaggtcatctaaaaatggggacgattttatttcctcttttccaatttggctgcatttgctttctttctcttgcctaatttctctggctatgattttcagtagcatattgaataagagtggttaaaatgggcatcgttgtcttgttccagttcttagaggaaaggctttcagctttttcccattcagtatgatgatagctgtgggatggtaatatatggcctgtgttatgttgaggtatgttccttctaggcctctttgctgagattttttttttactttaagttctgggatacatgagctgaacgtgcaggtttgttacataggtaaatatgtgccatagtggtttgctgcacctatcaacccaccacctaggttttaagcctcacatgcattaggtatttgtcctcatgctctccctcccctttccctccaccctctgacaggccccaatgtgtgatgttcccctccctgtgtccatgtgttatcatttgttcagctcccaattatgagtgagaacatgtggtgtttggttttctgttcctgtgttagtttgctgaggatgatggtttccagcttcatccatgtccctgaaaaggacatgaactcattctttttaatggctgcatagtattccatggtgtatatgtgccacattttctttatccagtctatcattgataggcatttggggtggttccaagtctttgctattgtaaatagtgctgcagtaaacatatgtgtgcatgtgtctttctagtagaatgatttataatcctttggattggctttggtagggtaagactttttcttgtgggtgtagctatagtgttgctttggtaggatattttggctttgattctgggtggccaatgatttataatcctttgggtgtatacccagtaatgagattgttgggtcaaatggatttctggttctagatccttgaggaatcaccacacagacttccacaatggttgaactaatttacactcccaccaacagtgtaaaagcattcctatttctccacatcctctccagcatcttttgtttccagactttaacgatcgccattctaactggtgtgagatagtatctcattgtggttttgatttgcatttctctaatgaccagtgatgatgagctttttttcatatgtttgttgaccacataaatgacttcttttgagaagtgtctgttcatatcctttgcccactttttttttctcagcccattgtgggctgagaaatacttgatataatttcacttcttttcaatttgttgagagttgttttgtggcctaacgtgtggtctatcctgaataatgttccatgtgctgatgagaataatgtgtattctgcagctgttggataaaatgttctgtaaatgtctgttaggtccatttggtctaaagtgcagattaaatctgtgtctttgttgattttctgacaagattaatctgtccagtgctaagagtgggttgttgaagtccccaaccattatggtattgtgtctctctctttctctctttagctctaatagtatgcactatctatatctgggttctccgatattgagttcacatatatttataattgtcatatcctcttgctgaattcattacttgattattatagaatggccttcttcatctctttttatgttttttgacccaaagtctgtttttttctgatataagtatagctatgactacatgcttttgttttctaattgcaaggaaaatttttaccacttcttcactgtcagtctatgtgttttcaggtgatatgaatttcttgcaggtagcttatagttgggtctttttaaaaaatccattcatctatcctatgtcttttaattgggcaatataaaccatttacattcaaggttgttactccagtcattttgttaattgttttctggttgttttatatagcctttgattctttttttcctcttttattgtttacctttacaatttggtggggatttgcagagttaatatgtgattcttttatctttctctttgttatcttctctatcagtgagttttatatcctcatattttttcacaaaagtagatattgtccttttgctttcacatgtaggaatcccttaccatttcttgtagaactagtttagtgatcatgaattccctccatttttatttgtctaggaaataatttatttttcttttatttctgaaggatagctttgctggatatagtattttgcctggaaatttttttctttaagtacttttactatgtcatcccattctctcctgggctataaagtttctgctgagaaattcaccattagtctgatggggacagttttctcttggtgtttttagaattttctttttgtctttgacttttggcctctggactataatatatatgagaaaacctttttggatttaatctagttgggaactctgagcttcctgtatctaaatgtctgtattgcttgcaagacttgggaagttttcagctattattttatttaataggttttctttgccttggcccatttattctccttcttaactcccaaacatgagatatttgttcacgttatagtgtcccatatgtcacacaggctttcttcattctttttaattttttattctttttctttcctctttttgtctgaatgggttatttcaaaagacctgtcttcaagttcaaaaattctttcttcgacttgatctagttcattgttgaagatcttgattatatttttttcattcatggaatctttcagttccaggatttctgtttggttcttatgcatgatatttatctcattgttcaatttctcattccaaacataaattgtttccctgatttctttgtatcatttttctgtgttctctttcatctacctgagttttcttaggatcaatattttaaatttttttgaggcatttaataatttctttttcttaggcgtctgttactgatgaattattatgtccttttggaggtatcatgtttcctttctttttcatgtttcttgtgtccttacattaatatctgcacatctgatgtaaaagtcactttacagtctcttcttccaatattatggattggctttggtagggtaagactttttcttgtgggagtagctatagcattgctttagtaggatgttttggctttgattctgggtggccatagtactgtagtcaccatacaatttattcagctttgccctccagtgtggagttccttctggctttgagctgattctgggccagcttcttctttgcttttctctccttctgtgcctcaaaggttcactgccacttccctgctgaatttcagtgttctgtaaaaatttttatttgtttttaaaaagtcttatgtaactatagaattgaaattattaatggaatagaaaattaaatgtaagaaaaagcaagaaggaagcaagaccaatatttaggaggcaatcatctctccagatgactcacagaagaggaaatctcaaggagtagattatttttaagaagtttctggtacagttcctctgaggtcctgtgactacccctcccccaggaaataacttttttatttaaccactacattgacatctacagaagttgacacctgtaagttttagacataaaattgattcaacttacagtgcaacaatttaaatgtatgcatcactgctatattgaaaatataatatgtcgttagacttaagactttcctttgttttgtcaagtttttttttctcatggtgggttagtttgctttgggaaccccagacctaaacctcagccatgcttctggcagcacacccagcactgtctctccaggtgctaggaaggcactaagacacacccacccagtccaggtgggctaactcaccaactgacccatcatagcaacttggcttgcccagcagcatagcccatccggatgactctacctactgctctataatcactgtgtggtgagaaaaaaaaagaaactctgccttgaaacctcctgttcccccaactagttctcaggagaatgtttgtgctttactctctctctctctcactctctctctctttctctctctctctgtgcctatatgtaaagactgatctgcagtctgccatcatagggagaaatgtgcttctagcctcacctctggaaaaagaaaattaataattaattaattaaagatcttaagatggagaggttatcctgaattacccagtggttccagtgtaattacaaaggtccttataagagggaggcaggagagtcagaatgagagaaagaaatgtgatgatagtagcagaaatcggagtgatgcaaggaaggggccacaagccaaagaatgcaagtagcctctaggagcttgcaaaggaaggaaaatggattctcccttagagcccccaaaggagtactacactattgacactttgatttgaggacttctgacctccagaaatgttaagtaataaatgtgtattttaagacattaagtttgtgataatgttttaatagcagtaatggaactaatgtataagaatttttacttatttatgtaggctactcttgtactatgctgaatagtacatacagtaataaccatatggtaatatctaaaactcataactgtgattttctaataattgggtggccaacagtgttgtccctcattaagccaaagcaattatccggtgctgacaagccagtcaaaatcattcaaattcatgtatgtgattgattgaaatggaagcactgaggatcattgaagaagtaccatggaaacagcatttgccattccaagatatttagatgctttcatgactactcatcaatgaagtaatgaaaattttgggaacagatgatcataattttgagtacggttcaaagaattttaaagtaatgacaaatgtctatgcttactatagggagatttgccagaaagagagagagttatcttatgtccaagctttatgaaaaatatatatttttaaaagctcagtcaaaacagtccatgcattaaaatcctctcaaaggaatttcacaagcatgtaaaaccaaacacaacaaaaaagctgtctgaatgctatgtttggtttcacatacttgcataagcatattaatatttaatgaaattgtcttaacatagatgtatgtaagaatgaaatttattcattttcaaacagcacaaaatattctgggcccacagccctgcattctgactaggccagacatcttatttctttatcccactcaggtttaatatttaatcttgggttttttgaaatcaaacttcaaaactccctctcccttctctttccccttggtccctggagaaggagaatgacttacgctttcatagcaaatgacatcagaggtggtgagttccttctctgcctcttggtccaatacaaagggaccaacatcaagtgctagcattgtctttccagtggggatgatgaaattgttagctctttagggagctccatgagggcccacccttgcactgtcctgtcctcttctcccttaacgccatggcaacaagcagtccacccaaaagtctctgcttctgataaacccagaccatcttccatggcatttactcatccctccctgcccagccaagggaagatcacaggctgccatagggcatgctcacagtttcagcaacaatagcatcaactgttctgccagctaagtggcatcccccaggtcccaaccctgacagttcttcctgggggtatagggaaattggagaacacagatttcatcagaacagggtggaacacattgaaacttccttgctccctgcctcccagtctctccaccaagggaagaggagggaaaaggcactgttcatgctttatggactctgcttccttcagtgctcccatatccttgccctctctgtgtcctttattttataaaacccaaaagagtggggcttaagaaactggttctgctgaatgccttatgctagcaaatcccacagtggaggactggcattaagaacccatttttctgcccttgaaaggtgagatatttggcaacttttatcctgaactatggactctagcaggctgttccaggaaagcacaaatgtcccttatgaccactttatcactttttaaaaatattaatttcatactatagtagtcattaatttttgaatttttgtattgcaaaatggttttccaagacagattcccaatttataacattttgcctctaagaactaaattttccatttaaactaattcaacttgagactgtaatcttggcactaattaagttataacttgggagatcactatattgatttcaaaactccaactaaagctctgggataaaaagttttctgagaactagaagtaatatagataaggggaggatgtctaagactaaacagcttttcatttatgagagatcctagcaatcttcagcatttttttctcactcaaagaatattgaggcaaagttcaaagtatattgtatctggggaatttctgcttccatgtaattcctgccaaatacttgggtctggatcaccacacacacacagacacacacacacacacacacacacacacatgcatgcacacatacatgactataaataactagaaaaatggtaaaatataataaaaaacaattttcagacattaatcagaactgtttaggcctgtgatctctgaagaaagggaaataaacgatgtgagccctctgtgagcactggctttttgcctagaggcaattcccagattatagcactaagaggagaatcccaaacaaagcctggtggtctcactgggttaaggagaccaaagttcagggagactgaagtgactagaatttgtggtgaagagaaagagctccagaaatctgtctggcatcccctctagtctttggctgactcagtctgcacatgaattaggtaaaactctacaattttggggaaagaacagttgctgaggcaccataagctgaataaatagaagagttccataaggccagaaaccattcaagttaccactagccagagtgaagagggctcattgaacatacagggcattcagtaaagaccctggaagagtcagatgtttgttacaaatcttgagtaaaggatactctagacccactcttaaaaagctttaaaagaagcctcaaaattattaaactaatctttagcaatttaaccacctgccagaataaatcacaattctctttaaggaagacaaaaaaaaaaatccaacactcaagacataaaatttatgcctggcatccagtcaaatttctagacatgccaggatgcaggagaacttgccccaaaaacagggataaaattaatcaatagaaatagacacagaattgataaaggagatgaaattagcagacaaagacattaaagcagctattataaatatatttcatatgacaagaaggcagagggagaaattaacatgtcttggagacaaatagaaggtataaaactgtgaatagaacttttacatatgaaaactacactgaactggattaacagattagaaactgcagggggaaaaaaatcagtgaacatgaagacattgcaataggagctatccaaactgatgcacagagaataaaaagaggaaacaaattcaacatagccttagtgatcggtggaataatatgtatgtaattgggcacccacaaaaagcggagaaaaaggggagaggaaggaaaaatatatgaagaaataatggcagaaaatgtttcacattggttagaaactataaacccccaaatccaaaaagctcaacaaaccccatgcagaataaaaaaccaagaaaacttcaagagaaataataatcatattgctgaaaacaagtgataaagagaaaaatcttaaacgcatccacagaaaaaaaggtacacttagagaggaacaaagataaaaattattatagatttctcatcagaaatgatgcaagcccaaagaaatggaacaatatctttaaagtgctgaaaaaacctgtcaacctagaattacatacccagagaaacatttttcaaaaattaagacaaaagatttttacagacaaacagaagttgactctttgtcaacaaacttgtgctataggcagaaggtaaatgcaaccagacggaaacttggatctctacacagaatgaagaacattaaaaatggcaaatctgcagttacatataagtcatttttttcatcttataaactctctaaaagataatgaatgtttaaaacaaaaaataaaacaatgtgttgtgggatttaaaatatatttagaagtaaaatatctgaaaacatataaagcacaaaggatgggagggagaaaatgaacgtgtatagctgtaagtttcttcattaattcttcattggtatgatactgttcgaaagtaaactattataaattaaggataaaatttgtaaactccaagacaaccactaaaaaacggaggtatagctaataaactaatagtggagataagatggaatactaaaactatcctattattgaggtgttctgtatcttgattatgttggtgattccatgtgagtttacagctgtcaaaactcaacaaagtatacactttaagaagacatggtttattgtaaataagtaatttctcaataaagttaataaaaacaatctaatggaaagcaagaaaaaagggaaacataaaacaaatgggacaaagaaaataaatcagaagattttatatttaaacccaatcactcgataattacattaaatgtaaataatctaaactattcaacaagagacagaaactttatgaaagagcacaaaggcaagacaaaagtatattctacctataagaaatttattttaaaaataaagacacaggttaaaagtaaaagaattaaaaatatagacaatataccactagtcacaagaaaggtggaataactatattaatcataggcaaagtaaactttacaacaaagaatattaccaggaataaagatgaacatgttataatgacaaaagacttaattcttcaagaagacataacaattttaaatgtgcgtgcacctaacgaatgagtttcaaaatgtacgaagcaaaaaagaatagttttgaaagagaaataggcaaatccataattataattggatatttcaaacttctctctcagtaattgatagagtaattagaagaaatcaataaagatatagaaaatttaaataacaccatccaccaacttgacctaattatcatttatagaacactccatctaacaactacagaatacatatgcttttcaaatgcacatgggatatacatcaggatagaccctacattgagccataaaacaagcctcaaaatacttaaaaagacactgaaccataaaacaagtctcaaaatatttaaaaatattttttctgactctcctctttttctcttctttttgtgggtgtccaattacatatatattgttccacagatatactgtaatatactgtaatcatactaaatatattattcaactacaatggaattaaatccgactaagtaaaattgaaaattcaacatatcaaaatttgtgtgctatagctaaacgggtgcttagaaggaaatgtatagttgtagatgcttattttagaaaagtaggactaaaataatctttccccttaagaaggtagaagaaggaataaaaataaacttgaagtagaagaagaaagaagataatatggataagagcaagaattaataaaatagaaaacagccaaaccatagagaaaaccaatgaaaccaaaagcggtttctttgaaaataattgataaacttgtagctagactggtcaagaaagtaagaagacaaatatttgccaatatcagaaataaaagaggggaaatactaaactgcataataaatcctataggcattaacaatgtaataagggaatattatgaattattttatgccaataattttaatttagataaaatagacaaattccttgaaaagcaaaaattaccaaaatgaactgaagaagaaagaaaacttgaatagccctataaaaactgaagaaatttaattcctaatttgattttcacaaagttaactccaggcccggatgtcttcactggtgaattctatcaaatatttaaagaaatagcaccaatcccatacaaacacagactacagaggagagggggaaactccccaactcattctgtaaggcctacatcatcctgatatccagtactgcccttggactcaaaaaaactggcctctgcttcgtgcccttatgcttcagaaactccacttggcatgccctcctcaagatgttctaagtcatgctctgctgcctggaatctgttggggttggcaatgtcatctgggcagggtgccttgagcttggactgggactctcatgggccctatgcctagattctcccttctctgaccctctacactgctcatggtatcaaccagaagcccaaggaactcagggacttacatctctggggttatcccaggatcccatggcaaagatccagctccaggagggaggcttggcaagcagattgctccctccgggcaacacaatattgctcttgtaggatcatgcaagattggtctcccagaatgatgctgaaaacatgctgatgttgagcgattctcacttatgtcggacacagagcaagttcaggactctgacctaccaagaagtcactgccaagccttgggtttgagccacatgtttggacccttgcctggactctcacccatctacatcctgactgcaatgctgcccatgatcacagcacctaaaggcagcaggtgtcttttgcccatggtagcaagaatcctttgccctgtacactcccacctttaacacccaggttggtcacttggccctttccatcagcttcatatggtatgccaggcagtcccctggaagctaggtccagaaaccatctcctccagttgtttattactaaaggcatagcttctagctttgttctgtctctcactttgagaaaatgtagcagtgctgttattactcacaatgctggaacctgttttcattgaaacagcatagatcatcttacctttgcaattccccaataccacttctttaatgttcgttacatcattactcatgatgccacatcaaccatctgctacccatgaatattagctttcaaagactcacagtaaaagttgttactgtgctttgttggtgatggccacaaacgcaggtcttacccacagtgtgcagaaaaaatgtgagtgatattttgtgttctggtcatgtcaatatttaaagaattagcccgctggggggcctttgagaacattgccctgcagcatcaattggcctgattgatgttctctcttgcctctgattggtgtggttgtgctctcccaggatgtttttaagtcacaccagatgaggaatggatatttcttgcacaaatgggactgcctgcttaccctacccacgggcccctcgtggcagtgtgtagatggcaacagcatagtcaacattgaaagagatcacattctagaaatgcactggttacagtctaaagagtccaacatttatgctataaaatcctaaacagtaaatttaacatgaccagaacacaaaatatcacccacattttttctgcacactgtgggtaagacctgcgtttgtggccatcaccaacaaagcacagtaacaacttttactgtgagtctttgaaagctaatattcatgggtagccgatggttgatgtggcatcatgagtaatgatgtaacgaacattaaagaagtgatattggggcattggaaaggtaagaagatctatgctgtttcaatgcaaacaggttccagcattgtgagtaataacagcattgctacattttctcaaaatgggagacagaacagaagccagaagctatgcctttgataataaacaactggaggagatggtttctggacctaaacaggaagagatgctaccaaaataagcttttatgaacaataattagacaataaacaaatgtataagtacttcttctccacccatttttctaaatctttactagacctcacataggctgatgaattttgtaatatgttttaaatcaaattgtttatatagacaaaggcctggcaaaaaatatttgtctggagctctacatattttagacattcctgctaatatcaaaaccaaacaaaccaagcaaaaaagaaacctacagagcggcatccctcaagatcataaacacaaaaattcttaacaaaacattagcaagttgactccagcaatataaaaaaaaagataatatgccacaaacaagtagcgtttatcccagtaatacattatttgtttgctgtcataaaataaatcaatttgctatattagttgaataaaaaagaaaaccatatgataatctcaacagatgcagaaaaagcatttgacaaaattaaatatctattcatgaaagagttgttttatgtctggcagacacaggggccttctgaaatagagacaggcctgatcctggggtgagacggattcataatggtatgtctatcacatatcttccagaaactgaggggactgagattgtaggaccagtgacattctgaagagcccactgcagtcggtggcagtgctaagattcagtgttttcctgtctgtccccagagcatctctttccctataccacagtgtctccatataaagaatgactgatttcatagagtgaaactgcatttagtactattaggaaaaaaagaaaacattgaaatgctatttccactaagaataaaatgatatttattccctatattgagatattcatgggtatatttttgagagatgaagtaaatgtgccaagattactaatttttttttctataactgaatcaggagcagatacagtgtggtaggacagcagatttaagtatgttggaggccctatttaagaaaaaatgtaatatgaaattagtaacatgaacatttcttcaaaaaattattagttttacaaagctgacaaatgccacacacaaaaatccagaacaggggcagggtgtggtggctcatgcctgtaatcccagcactttgggaggccaaggtgggcagatcacctgaggtcaagagttcgagaccagcctggccaacatggtgaaaccacatctctactaaaaatacaaaaaattagccaggcatggtggtgtgcgcctgtagtcccagctactcaggaggctgaggcatgagaattgcatgaacctgggaggtggaagttacagtgagccgagatggtgccactgacctccagcctgggtgacagagtgaggctctgtttcaaaaaaaaaatccagaacagtaacaaatattctcattcactgagtgcctgccacacctctatgctactttttccttgcctttcttttttgttggagttgggattgtatatattttattggctttatattatgattttcaatagagaaaatagaaagataatttaatttttttctagcatagtcaaatgcttttttattgatagtcaggattcataaaacatgcaaattcacacacaaatggaccatctgcatggtttgtgtcctataaacatagagatctgtataaactctatttccacaattcccaccaaaagaaaaataaatggtgcattcatattttaatataccaccttatcaattatatctctgcaagagaggattccatatcaaaagcaagttatggagtgcctctatgtgagcaacctccaaattgtgtggtatttctctcttcctgctatatcccaccaagaaattgactcaacccagagtaggctgcaaggccccctgttccggtgtctaactctcttagacctatgccaactctcttcccttccagcttagaggctcttcttctggttgtgacagggactagtgatagcctactgcatcttctcccaaatcactcctgcctcacatttgggctgaggacttttgacattcttgtcctcaagttctgtgtgcctccaactttgttatctgggctgggacagagtcccagagaacaagggaagaaattcaataaacaggagtgggaaatatctgggttaagtcacccacgaagtgccacaacccagtggaactaaattctcagtcaggattgttttttgaggcagatgtctcttgataggtgtccttcaaaattttggagttatttaatttttgcaaataacattcatgaagttaacttcttgccacacaatctaataaaaagttatttggggccacaaagtgctctataattttaatatcaattgagactatggccaggagaaaagactgtttccccgctggagggcctgagcttaaagcacctttccaattcagctatgtaggagacaagggtgtaagccctggacactgggaaaagctatttgcatccccaaaagttaattttttttttacctgcaatacacccttttaaatagtaaaggagaaaaaattatcatcccatactcccggtaaaaatatatctcctttcttgcatggtcacccaggaaaaggacctgttttacctactatgtgctttctcacactttatttaggcatgagattgtaacgatgtaaaaattaacatatatgtgtgtgtgtgtgtgtgtgtctataacatactttatatgtatatattcttttacatgtataaaattctacattttgaaagatagtactagaaaaataacttgaggatgattctggaatccatcccaagctaatggtggctgtacacaatttgctcttctcactgggaccccttctctttctcctgtcccctccccttctcctcagggactctcctccttcttctcacagatttctggccattttctagcaagcctgtttctcaactcattatttttgcctatttattaggcttcagtcccctctctttattcttgtccacaacactcccttccccacaacttgcattctttctccttttttgagaccgtgggtttcacagcctgcactgggagtggtggtcattccccaccactgagaagcttgaccgcttttctctagaggaatgacaggtgagggggcctgagacaagggtgtgggtgtgggttcagagtggacctgggattctgccaggccccctgctaaccttgaacagtattctattgtgctccccaccatacgggatagcaatggaaagaagttatttctggacattggacattttactgttaaattgtttgaagattaagtgattagcatattggtaattgccagagacccgaaaactctgtccccaacatcctccaacattctcttatttctgtcactgtcccagccatgggacagtggaaaggggcaatcttaagaaacagcagagagataagaaaagagagaaatgaacagaataacacctttcattgccttttgtgacatattcccaagctgacctttctgaagctgaaagaaaactattctgtctgaaacaaaaggaaatgaatagtcagttcaaatagcatagttcttaggaggagctccagctgtagatccagacaggcatggctctgattcccagttctgccattcactggctgggggaccctgttactaacctctgtaaacctcagttttctcatccaaaaagtggagataataatgtctccttcctcgcagagctattgtaaacattcaatgagctggctatgaagatggcctcacttctaataagaattcaagagatagaagccagtgctactttttcaatgcaatgtggttggaactaaagggcaaattcaaagtgtaaggtaatttgctgactttcatgagttcacaatccaactgaagaaacggaacacaaaggaaagataaaccacaatgtaattcaaggaaagatcagtgtttttagaacatgccacatctataaattaccccaaagagaaattgtccacttggctctaattaatgaaaaataaaacctgaatgtaaatcttggtaattacaacaacaaaaagaaaagattagtgttataaatgatagtcatggtcaggactctgagacaagagaaatttgtgaacactgagggaggaagtccagatgctattaagggcaaataatttttttattttaaaaaaatagtaatttttaatgtaaacaattcctatgcagtgttcatcatccttaaagtttggaggcagtggaaaattacataagatttagaaggattaaatctgtgactacacatattaaaattggcctgagtcttagtcttttgccctaatagctataggagtcatatcaaaagggaaaactggaataaactgttaaaaagattattttcaagggggttatgaggttgctcgccccattccatgatcttagacatcttgtagggacggtcaaccactgataataccagctcctattacacatctcttttaggtgttcttcaagctaatcaaccacaagtcaaggtcacctttcagacattccataccaccatgtcctcaactcttgtgttgcctgcaaggaccaatccagatcaggtgataaaaaaaaaatttgtcctcaaataaatttattattattaattatttcacatattaataaatgtaaaatttgattaataaagagtagtcattgttcctctaatatttttaaaatctctttgcctttttgctctactttcttggaaatttcttgattttatcttctaattcttcaattgagttcttcaactgctaacagctttttaatttccaaaagctcttttttagtttcctggatgttcctatcctatagcatcctgttcttgctttctgcatacaatgtcttcttttgtttcttgaggatatcagtaaagttttaaatacattctttcttttggtatagctttttttctgcaagttacttttgctgctggttccctttcttgtctctttttcattttaaggactttcctcagaagtgagagagttcttggctgtctcttcatatttaagagaggaacattaaaaatcaatatgtagctctaagtaggtgggaggaactgtccactgaacacttcacattagaggatttatctggagagtttgatggcatcaaattttattatctgtatgtctttcttgttgggtttattagatgccctgagaaggctctttcaaactcctgcctggaggattggatggtctgaggcccagttatcagggttccagcagtcaaatagggaagaggcctcaagggagggaatgagtcagcactgcagatttagtttcataggtttgtgtgatgtgtgtatatactctgcatagtcatagagatggtagagagagaataagtcacataattacctcatgcactttctgattttcaaacgatgacacgtaaaagagatgggtaataggaactggtatgatcagtggttgactatccctacaagatgtctaagatcatgaaacagggacaagcaacctcataaccctctccacaattattattgcctagcatgaaacctcagagtttaaaaatggtgaaatatttggaggagaatggggggagactaaaattgtatgaaattatttgtctccaacgaagataattcaagtacagtcatgcactgcataacaacatttctgtaaacgatgaaccgcatatatgacagtggtcccataagattatactatatttttactgtaccttttctacatttagtatgtttagatacacaaatacttcccattgtgttacaattgcctaaattattcagtacaataacatgttgtagttttctagcctaggagcaataagctataacatataacctaggtgtgtagtaggctgaagcatctatgtttgtggaaatgcactttatgatgttcaaacgatgacaaaatcacctaatggtacatttatctgaatgtacccccatcgttgaatgatgcatgaatgtacacaatttattatgaccaagaaaattaggcttaaatcctttagaaaaacatatttaaaatacaattttatgtttaataaaatatatataatattctagagtatgtataagcatggaaaatacagttcaggtatcaaaatgtcatccataggatgatgtaaaatacacacatcaaacctcctactctataaacagaaattgtaccttcttttacaagtccacatagaacactcataaaaatagacatacattaacccacaaagaaagtctcaatagattcctaaaataaatagactcacgtgcagatgtcacggggcaaactttgccacttaattgtctaaagagccaggcatggtagcttgcacgtggaaccccagcactttgggaggcccaggagagaggatcacttttgaggtccaggttttgagacaaacctgggcaaattagtgagaatcccccatctctaaaaaaatatttaaacttagccaggtatagtggtacacccatgtagtcctatctacacaggaggcttaggcgggaggatcacttgagcccaggagtttgagactgcagcaagctatgattgtgccattacactccagcctaggtgacaagagtgagaccccatctcttaaaaaacaaaaaatccaaggagagctggaagacttcataggtatgatcattttcaaaatttaaaagtgtaagcataaatgcacccagtagagatgcaaacagtgagcttccttggcaaagaggagcaaattcgctaatgtttctagagaacaggagcctagataaaggagtaaagagacagggcagaaaatgaggacggaaaggtccttcccttagcttacatttgcaagagtttggatttcatcttgtggggaaatttgagggattttgagcaggaagtaaccagggcagatttgcattttagaaagattgccccagtttctaagtggaggctaaaagcagaagacctcacctttgacaagatcataaagtaaaggcatagaaatgaaaacgagggctaagtaggagaattatttacagcaatgctgtccaatagaacttcctgcagtgctggtaatgtcctgtgtctgcactctctaatagggtagccactagccatatgaaactattgagcatttgaggtgtgtctagtacaatgaaggaatttaatttctaattttattttattttaattaagttaaataaccatgggagttcattagacagtgtagctttagaaggtgtgtgtgtgtgcatttttaaaattttaaaaatatcttcactgaggtagagttggcataaattgcccacacttaaaacacatattttgatgttttgatgtatgtatataccatgaagtgatgaccacagtcaagatagtgagtatatccatcactccaaaaggtgtatataaaattaatgcacctgaaaagcagatactggataaatatggaaggactctgaattttatcagctatttctttgtctgctttaaggataaaaatgcagcaataaaactccataaaaccttatgccatttttgtttattttttgcaatttcaacactatataaagaaccacacagctaaagcaaaagttttagaatgggaatgggaagtaagaaattcagaaaatgattcagggcacagaaaagaataaagcagtttctgtactatggttcttcttttgcctcaagggaagcgctgtcaactcttcctggagcattttttgcataaaatttgggttacttccaataaattaccattaggttccactgtccttgaaaatttcaccctgagattaaaaattttctgcacgtactgcttttttgtgttttgttttcagtttacacattttaccacttaaaattggtgtgtcagcagatttctgtctgaaacacatatgtgctaacacgggtaagttaactattttcaatatttctgagaaatagacaacaatttggcagaaatttaatggagaagaattttctctctcgcacactgcccctcccccgccccccaacacacaactttttttttaagaaacagggtctcctttagtggcccaagctggagggcagtggcaccatcacatctcactgcagccttgaactcctgggacccagcaatcctcccacctcagcctctgaagtagctgggactacaggcgcatgccaccacatctggctaatttgtttttattttttgcagaaatggggtcttcatatgttgcccaggccggtcttgaaattctgggctcaagtgttcctcccacctcagccttccagagcactgcaattacaggtgggcaccaccatgcctggtctattttcacctctcttttctttcttttttttttttttaagatggagtcttgctcttgtcacccagactggagtgcagtgccacgatctcagatcactgcaacctccacctccagggttcaagcaattctcctgtctcagcctcccaagcagctgggattacaggcatgcgctgtaatccacccggctaactttgtatttcagtaaagacggggttttaccatgtgggccagactggtctcgaactcctgacctcaagtgattcacccgccttggccttccaaagtgctgggattacaggcctgagccactgtgcccggccccattttcacctttctaaatgaagaatttaaaaacaaatttaaacacatgtagactttaagccgagcttctcttttcatctgaggctgtgaggctccctggacctgggtgcagtttcctgggcacaggctccacatggcatctgccacaagctgggtgtgctcctgggcattctgccctctcccgaagagtttttagagcaaattcttataattctaggaaaaattactcatgttgacaaaggaaatctctgtacctcttcacttagtgataaagctgagaaaattccttttattcaaaaacatatttgtgatacatccaagcactctacttaacacgggtcattttccctcatctcataaactctgccctgtgtaaaacaacagcactccatccatccatccatccatccatccatccatccacccatccgtccgtccatccatccaatccattcatctatccatccatccatccaaccatccatccatccatccatttattgcattcactaaagtattctatgtgccaggcacttttctcagaactggagatacaacagtgaacaataagaacaaaagtcctactctcatcctacacacagccttgctagcggacatgggtaagacagaacattaaaacaacaatagtaaatatatagcaggtcatataaagataagtgctacagcgaaaataaaatcaaataagggtgataagaattgccagaggaatgagagaagttattttatcaagaaagtcactgataaggtgacatttgattatatttttgcagctaatggaatcagccatgtgaatatttaaggaaaacgccctgaggcaagatttttttggaggggtggggtgtatttgggaccggctggggctgagcaagctggaagtcagggatgggagcagggagtcagaccataaaaggcatgggaagtattattacaaggactttggtttttaccctaacagacatcaaaagttattggaaggtttcaaatagagttgtgatgttatccagcatatgttatttgttgtttttttagagacttggtttctctctgtcgcccaggctggcatgcagtggtgtgatcatagctcactgcagcctccaactcctcagcttaagccatcctctcaccttggtttctgaaagtgttgggattacaggtgtgagccaccacacccagctaacatatgttttttaatggatcagcctgagactactgtggtaggaattgacatgatgctgtaggcagaataatgtctatgtcttcatccctggcacctctgaatgtgttatatctcatggcaaaggagagttaagattgcagatggaattaaggttgctaatcagatttggagagatagggagattatcctgtattatcctgctgggcccagtgtaaccaccagcactcttataaatgaaagagggagacagaagagaaaagaaaaattaggaaaatataaataatccattaacacaagaaacacgaccacaagaaagaagtgttgagtgaatgtctgaatgaacaaagatttaattacttaattctgggacagtttttattattcttatgtgtccagggaagaaggaaactgtttaatcataaaattgctcagattttgctgtaaagtaagtttcagttctctatatcttcatacagttgcactttgtaaaatgatacagctttatctgaaaaaaaaaaataagttgccctaatataatacagaaatcttttccagatcaaatcttactttcacactcacggagtaaaaatttttcactgagttgaaacacattaaaacatgctcattattttacatgcctaggaaaatttcgaattcttcatattacttttcccaggcatccagatgggttctaagaaaagttctagtgagattatatttcgtctgtatggttaaaagaaggagtattggcagtctcctaatttagtggtggtttttagcccaaattccagattaaggaggtttaagtttctgcaattacagcttttaaaaacacagcaatgaatcttcacaggtttaccttcattacaaattgtatcactaagaagatgagagaaaataatatcttttgaaattttgtagatccattctctggatgttatggagatctctcatcttaactctaacacctttaaggtatccaaggagaaaatcaggtgcatggatggcaggtcaacttcgggtatgcctctcttactaatcactattttcatggggccatagaacttcctgtggttaatggttgacaccttctggtggcctgcaggacaggtggcaaactcagacacattgggactcaaagggggtcttgagaggtcgttgaaatctatttctctgccttcaggcagaaccactggggaaatatgagataccatcatagttttaaaagactgtcaagaaagtaaattccaggacataagaacaataactccaggaaaaaaaaaaacaaaccctcagtgtctagtaaccctcagtgtcaacccttattttcattgtggagctattttaaattaataagcctggaaaatagatacatggcacaactgatctctggatgtcaacacatcagttaattgcatatgactccctagaaagtatatgtaactcacaacttgcaccttacaaaagaagagttcaaagtccctatcattactaaagggattctaagccagagtcacttccattcttttcagaataaaatagtgatttcaggaaggtgaaaccacctgtcacatttctatttaccagaaccagtcaagatttgggctttttaaactgctttgccatttcgtttcttctcctcattgaaatttacttttcataggaaacatgaatgtgaacatgtactttaaggacttaaaaggaaatacaccctttaaatgttaacgatgtctataattatttagcacctgcttaaataaagacaggaattgctccagagtgttacttattttcattgatcataggatcctagagaaggcagaattttgttggggggaaaaataacaccccaagagaatgacaaggggaaactactgaaaagctatgatagttacaaatcaaaatgttcccaggcaactgccatatctctggttttccttgatcacatcaaatctcaattcatatagcaaattacatcacgctgtggagtttgatgctctaacatctgtaccgtagagccaggtggtgtttatgattagaaatactttctcacacaacttttactttctgaagctattataataatagcctcatgtgtttgcttgcttgcttaattttttaatttcgctattactaatccttacccaaacttttcatcagaagcatgaagtccctctcaataggatcaaacacatcaggccatctatccatctcatcattttacttgaaaggttctctctgggggccttccttccttttgctccatgtgaccaggctgcttggcctgctccacgggtgacaccctgaaacttgctgtctccatccacctggaaactcccttttcttctctcccaagtttgagccgttgttttggggactccatgtcttcctctttcttggtttattctttatttacataagaaaagcctcagagctgggggtggtggttcacagctataatcccaacagcttggaaggccagaggcaggaggaacacttgatgccgggagtttgaaacccacctaggcaacaaaatgagatcctatctctacaaaaatcttaaaaattagccacgttggtggcacacacctgtagtcccagctacctgggagactgagctgggaggatcacttgagcccaggagctggtggtttcggtgagctatgatgacaccactgcacaccaacctaggcaacagcacaaagccctgtctcaataaaagaaagaaagagaaaagagaaggaaagaaggaagggaagaaggaaggaaggaaggaaggaaggaaggaaggaagggagggagggagggagggagggagggagggagggagggagggagggaggggcctccaaagatttcccaagagagaatacatgggaagttgggtttttttggtttctttacttgttacatgtctggatgggtctttattctgtcttcatggttcatgaataaggacacaattctaggttagaaataatttccactgatatttaaaactgtgcttcactgtttttgagcttcttgagttgatgctgagaagcctaatacttattataatccccatttctttatttgccattctctttctgtctgtctctctctctctctctcaaaactttttggcctgtctctttattcccagtgttattaaatttcacaatgtgccctggtgtgagtcttttaaattcaatgtactgagttttgttaggcgtttacaatctgaaaatgtatgtctgccagttctcagaagtttccttacattatttctataatatttttccgacttcctctgctctctctctcttactctttctctcattctctctctctctctctctctctctctgcatcctctccccttgctctctggaaagccattagacattaaaattcctatgctaattgatatgatttggttctgtccccacccaaatatcatcttgaattgcagctctccaatccccacatgttgtggaagggacccggtgagaggtcatcgaatcacaggggcaggcttttcccatgctgttcttaggatagtgaataagtctcatgagaactgatggttttataaaagggcagtttccctgcacacactctcttgtctgctgccatgtaagatgtgactttgctcctcattcaccttctgccataattgtgatgccttcccagccatgtgg

SEQ ID NO: 263 - DNA, 128353 bp, Homo sapiens
aattgaagaagacatacttaaatatacaggcaagcataaaaccttgttttaaacatttaacttaaaaaaaaaaatcagaattttatccctccataggaaaggatagtttaaaatgagcatgtccaacccacagctttgaatgcggcccaacacaaattcataaactgtcttaaaacattatgagatttttttgcaattttttttttttaagctcatcagctgtcgatagtgttactgtgttttttgttgttgttgttttgagacagagtctctctctgttgctcaggctggagtgcagtgttgtgatctcagctcactgcagcctccacctcctgggttcaagcgattcccctgcctcaacctcctgagtagctgggattacaggcgcccaccaccatgcctgcctattgtttttttgtatttttagtagagacggggtttcaccatgttggccaggctgctcttgaactcctgacctcaaatgatccgcccacctcagcctcccaaagtgctgggaatacaggcgtgagccaccgtgcccgaccagtgtattttatatgtggctcaagacaattcttccagtgttgctcagggaagccaaaatattggacatccctggaaaacactgcataccttgaaattgaagttttaaccgattaggacatgttaagaatttagaaaaataaagttcttacgcacagttttttctaaatcttttgttaattgggtaaaatggttgccagaggtgattgtgttttttttttgttttgtcaacatcatagaatttataaacttttttataaagagtatgacttagttttttttttcctgcaatcatattttccagttgaaaaagcttttggccattacattcagctataaattagtaacagtgtgcatatgatttctgattatttttcctcttgagccagaactagaaactggtcctgtaatatctgtggatcttgttctaattatatatccctttttatttgaaatacttagtattttcattgcctatatggtgaattctgagttttttaacctaacacacaatattgaaatctctgccctgaaaaattcctaaacatccttgaagtctagttctgttactactttctctctgaaatcttttttgattacctagctggaaacgatctaatctcccattctttaacagtacattcccttgtattaaaacttcttctgtaaatgtcttagtcctcttctagattataaattgtcttactcattattgtatcatctacattcatacattgaacaaaaagcaccaagcactgttatagatgcgagggaaagagcagtgcaggagaatcttggttcttgtcttcatgggatttatattccactttggaaaacaatgatgagagagacagaaaattaaataaatacatagatagagcttttcagatctcaaatgcttagaatgtgaaactccatcatgtggtagaaagtgtgaggatagcaccagtgcgttgataaggtgatcatggaaggtgtgatctttgaaaatttgacatttttgccaaaacctgaatgacatgaaggactagtcatttgaagatttggaagcagaatttttgaggctgaacgaaaggtagttctaaggcataagaaagaggtaggtgaggaaggacaggagaagtgataagaatcagatctagattatgcagagttgtaaaccaaggtaaagaatttaaaatttattctgattacactgggaagccaatgaacagtttgaagtttttaagggctcatgtcattacattgggtctacccaggataatctcatgattttaaggtcagctaactaataaacttaattttatctgccaagttccttttaccatataatgtagtatattcactagagtaacaccagagggcaagtcttcagggcctaaatgctgccacattttgcatgcataagttttatttaatctaatatatatttagtatcttacaagggcagtgaaacagaactaacttagggtagctgagttgttgagtcatcacagtttttctgatttattttgcctttactaatatgcccactccttggcattacctcttatttgctaatgcccatacgataaccccaaactctgtttctctttagttatttaactaaattaacataaagatgtctcctgcatttaaagaaattttgttccagatattttccagagagatctgtattttctcatggataaaaatttatgggtggattcattgtagattctaaaaggacattttcaaatctgtttgagttttcttatttttacctattctgattataataaatccattcattcaataaatatttatcaagtacctactgctgcagagccagctactatatagtaagcatcagaatgataacagttgaacaagtaactttttatgagggatgaggcttgaaaaagtacaagctgctctgaaaggtaccttagtgaaggaaattgctgctgagacatggaggatgaggcaatatagtcagcattggctttgaaggcggactgccatttcactgttgggtgaatttggatactttttaaaatttctttgagcctcaattttccatgcatgtgaatagtgatacctttatctctatagaagttttgttagattgaatatatgaaaatgcctaacgtaatgtttgccactggtttagaagcatatttatcatgaaactgatgaagtttagtgaacctaattgcatggccctttctaaggcccttgcaggagcagccctagcaatcttgaattaatttgtgtttttcttaaggaccctcccacccagctgcccctttattataggctgctggtcaccacaaaatctgaatctgcctttggccacaggttaagtgagaaatgttaatttctctctcctctaatgttgtgacttcagttagtgtcgaacctagaagtacttaacttaaaaaaaatggaaagaaattatatatattaggttgtaggaattttataaaattcagaaaaaccgaaattcttgtaattcctagggaggaaacatgatgttttatctctctctgcttttctctgtgtacatacgcaatttattttttaaaagctagtttatatcatattaaacagacaatattctgcattttcacataatatatggattatataattatatatcatataattatattttacaacgtaattttaatcatcttataaatgtgccaaaagtataattaaccaagctgttgttagtaattgttgaggttttttctaacatttcagtagtacaagtaatgccaaattacaaatctttgtaggggtatctgtacataggataatttcttttaattgggcttgcttgagtataagaattgcctttgtccattttctgctactataacaaaatacctgagactgggtaatttataatgaacagaaatttattggttcatagttataggagctgagacgtccaagagcatggcaccagcatctggtgagggccttcttattgtgtcatcccaaggtggaaggaggaaggacaggagacggccagagcaagcaagggatcaaatttgtagcctcaggctttttaataaaacacattaatccattactgagggtggaacgtgaatacctcccattaggctgcagctcccaacactgttgcattggggattaaatttccgacacaggcttttgggggacatactcaaatcgtggtaaacattttaaagacttatatgtcctcactgaccctacaatattattttaaaatatcattgcctatttttatagtactcttgtgtttatttctatttctttgatcatttgatatactaaaacattcttctgggtttttttggttttgttttgttttgttttagacagagtcttgctctgttgcccaggctgcagtgcagtggcgtgatctctgttcactgcagcctctgcctcccgggctcaagtgattcttgtgcctcagcatcccgagtatctgggactacaggcatgtgccacctcgcctggctaagttttgtatttttagtagagacagggtttcgccatgttggccaggctggtctcaaactcctggcctcaagtgatctgcccaccttggcctcccaaagtgctggggttacaggcatgagccattgcacatgaccagaacatttttctatgtatttattagtccttcatattttttctcatgttaattgccagtacttatgcaagataccgggaaagctttttgacaggaagaagtaagtttctttctcctgtaagcaagtcctgaggctgtataacactccaaattaaaaggctatttcaaaatggtttccctactgtagtgcagtgggaacttcgagagcagaatctaaaggagtgcttggtgtttctcatccctggcagcacataccaaagcttgggcactacccacagattctttcttggtgttttaaaagctcctcggagtactaaagggattctgcagtgtaacaactaagctcagaaacttagtcccgtggctgcatcacaacatttgtttttccatatacaggggccagagttttaacttagaatattccgtttcctcagtagaaggttatattttacaataatattatttaacaattgctctactattattccgtgagggcatcttaattgaatgccctttgcgggttaatttaaaatcactttttaaaataatgtttaatgaacacctatgtagaaaacattgtgatatacaccatgagatatgagacaaaatcaggtgagggctcttcccttgggattttaatagtcaggaatgggataagaggtgtatacacacaggtacaaaatgtgtttgtgccataaaagatgtaggaacaatgaagggaaaaggagatgaattgattctaggtgggttgctggattacttcatgggaatttatgtttaagccaaaccatgatttgggccagtagagcaattaatcatcctttactttaaaaaattgtttcagtttataaagcttgttcataatacataatgatccttattacagctctgcaagataagtcagttattcccattttatagatgaaggagtagtcaagccttagaaaagttaaatgacttttccagcgttatcaagctacaaagtgaaagattcagaacttgaacctaagtcttcaatctccatatgctggagccttctaaagtatctcagtagagtagcgaagagctatatgagtaagaaactataagttttagaaagggctgatagttaattttattattaggatggaagttctgaaatagttggagataaagctatagtatggtcagcagaataatggctccctacaaatgtctgcttcctagtccccagaatctatgaatatgttaggttatgtgacaaaagggaattaaaatggctaatgaggtaactttaaaataggaagatcatcctggattattgacgtgggccaaatgtaagggtctttaaagaggttacttaagagtggaagagggaggcagaaaaatgagagtcagagaaggagatttgagaaggggcaaggtcagtcctgcagaatgagaaagactcagtccaccattgcttgctctgaagatggaagtgaagtgctatgaaccataaaatacagtggatctgtagaagccagaaaggataaggaaacagattcccccttagagcctctagaaagaagtgcagccctgcagacaccttggttttagcctagtgagacccattttagacttctgacctacaaaactgtaagttatcaaatgtgtgttttaagacactaaatttgtggtaatttgttttggcagccataggacatttaatacgcctaggaactattttattgtaggaagactaattaacatgacctcagggcactccatgactaaactccaaactgtctctgttccactgtcagcagtagaaagacatggaatgttcttgagcaaaagtgtgaagaactattttggtgtttgctgattagagaggatattggtgagaggaaaattaattaagattctattagatgctaggaacacttcttttgagactcactccttgaggtaacatagaacatactggtaagtcttgcccgtagaagactatgaatatatctcccagtcctgtgtggctgctcacgtctgtaatcacagcaccttgcgaggccaaggcaggaggatcacctgaggttaggagttcgaggttacagggagctgtgcttatgccactgcactccagcctgggtgacagagcaagacctcgtccctgaaaaaatgggagatggttaggtggatggatagacagacagacatatagataaagatagacacgtgggtcaagatctcccacttagtttatacatcactgaaaatctcattgccattgtaacatttcacctcgttctcgtatcccatgaaaaatacagaaccagttaggcacacatctaacttatctcttcttaggcttttccatcgtaccataactaactataagatccgaacactgaaaggtttctaaatctgagctttatttgatgccttagtacctgtagaagttaaatttatactagtaactgttttttcaatgcataattattattttgaaagaaaaaaaaagcttgttgatatctgtaggcataactctattctatgtctaaggtcttcggtaaagagagacgattaagtttatcagtaaagcaccagagtcaattaaggcgactgaaaggagcactaattttaattcattttacactagttaatattgtcaatattcttcttgtcagttttttaaaccaaaagtcttaaattaggccaaaagtgcctaggtaaaaatggaatggaaagggttttcttgtgtgtgtgtgtgtgtttttttttttttttgagatagagtcttgctttgtcactgaggctggagtacagtggtgtgatctcggctcactgcagcccccacctcccaggtccaagagattctcatgcctcagcctcccaagtagctggggaatgtaatatttaagacattaagaatcctattaatcctatttagtcatttttttttgtagctgcagaaggttcagaagggttttttaagttgaattatatgttcatatttacaacatttacatatgaaaccatttactaaaagcaatgaagctggttataacaaacactgatactgaaaataagagatatgtttgtcagtgcggtctttaaacagtgttacacaatttatttctgtttcattttgatcagaaaaaatatatatatcttttgagacatggtctctgttgcacaggctggagtacaatggcgagatctcggctcactgcaacctctgcctcctgggttcaagtgatcctcccacctcagcctctagagtagctaggaccacaggcgcgtgtcaccacagctggctaatttttttgtattcttggtagaaatgaggtttcgccatgttgcccatgctggtctccaactcctgagctcaagtgaactggccacctcggcctcccaaattcctgggattataggcatgagccactgcaccctgcccagaaaatatttttaatgcatacatatatatatatatatatgtatatgtagtgtaaataacatcttcaatcaaatagagatggcaggagctttattctgagctatgtgcaaacttgataagacaaggtaatgcttcagtaattttccatgctgaaatttggcccagtatactttgattatatatctatatttaattatagttttaaaatagctaagcagttttaaaaattcaaattaaacttttgtggaatctctaaaaataagaaaaatattactgagtaattggcaacataaaatacaaaatgtttaacttggctttcttttagatttgaagcatagtgactaatgaacatataatggtcgtagctttctttacaactatgtcatttaagtcactgatgaatatctatgatacatgcagtaaaaatttagacaaacattttggctacaaactggtttactaaataatagcttgtatcatagtctgagtcaagagtaataggcttacaattgtgtcttagggtactaagaagttcttttgaggaccttttaaaaggtattctttgttttgaaagactgttttccttctggaagttctaggccttatgagaaattacctattctgaatttgtcacaaaaaatgacttgtaaataagtcctgtgcagtgaatcatgtgctttcagtaagaggattttgaaagccttttgtaaaatgaagtcattctcaaaagagagttatttagaatataatcaaattgatttacatgcttttatttatttcaaatatgaagggaaattgtttctaaatatatttaaacttttaatagaacagtagtatgccatcagtgtggaaataactcacttgttaaataaatatttggggtgtatttgctgtatatcaggcattgtaacacagggactaatgaaagagaaaaaaaacaaagcacgaaaggacagcagaaatagctccataatctcactttccaggaataacctctatggacattttgttgtgtgtctattgcttttctaatatatacattttttaatcaaatggaattgcctcaaatatgctatttaatagcttgcttcttttcatactatttgaaaattaagaaacgattataatatgcttcatttaaaaactttaagtttaggccgggcacagtggctcacgcatgtaatcccagtacttggagggaccgaggtgggcggatcacaaggtcaggagattgagaccatcctggccagcatggtgaaaccccgtctctactaaaaatacaaaacttagctgggcatgatggcacgtgcctgtagtcccagctacttgggaggctgaggcaggagaatcgcttgaacccgggaggtggaggttgcagtgagcggagattgcaccactgcactcgcctggtgacagagcaagactctatctcaaaaaacaaacaaagaaaacttgaagtatagtatccttttaaattttaaatagataatagaaactggtttccccccatttaaaccagaatttaagtttaactttatatattcttgacagtttggattttgtccttcaacctcataaaattgggaatttaagcatcacctggttcgatttaaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacttccagagttctgatctccactactaagctgctagcatagcttttctggtaactatttttaattcaaatataattcgagtgatctatctaacaagtcatcactctgacaactcagtgacttgtaatgtaaaattattcattgtaattcatttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacgtaaattactttgtcaaaaattatggtgaacaaatttttgtaggcctaatatttaagacctatagttaagtaattttatatttctctttggttgcttttagataacactgaataaatatttaagatattaattcagtgtgcaaatattttaaattaaagcaacatggcttttcttctagatgtatttctgtttagtgagtactcatgagatatactcttgatataaagtgtttttcattgagcttttttttcctttacctaaatgtaaaagcctatctttatgcatacttatagtagccagcctgccacacctccccactccctgaacaaggatggcagtggctttgtaaagccctccagggtcagtgacagtgtctcttaaataatgtttatgtaatagaaagtcttaagatgacctattatattgtttcagtaatattttcaagataatgcggaattgggctggcttagataaataagactacataagtttttcactgataaatttaaatagttctttaaaaaattatttctgctttaagaattacttgatcatggatatcagggttaatagtacttaggagccgggcgtggtggcccatgcctgtaatacaagctaaacaggaggctgagggaagctgaggcaggaggatcacttgagccttggcgttcaagaccagcctgggcaaccaagcaagaccctatctcaaaaaaaagtacttagagtctcttttttaaaatctgatggaaactatggctagaactaaagatgtcacattaaaattccaaatgacatttaacagctaatattactcagttctttgaattccattagcatagtgtttgagagtctataaaactattatttttacataaattaccttttaccattttaacagctcattgtagcattatttttattttaaatgttagagactcctattcaagtatgttgtgactttatccaaggtcaaatattgtataacaatgtaaagaacttaagtcttctattttattctaattctataaaactataatgccttttattacatacatacaaaataatatataacagaggtaatttgaaaaacagtgtaagtcactgacaaattattcaaaaaatgaaaaggcaatcctacttggttgtggatttttatctacaatataagaatgctttaaaaaatacctggtgactaagcaaatggagaagcagcagttttcataatgacattcataaacgactttttaaagatcgtcttattaatcatatgaacacatttaagtagaacagtgttagattgagatgtttttctgaattaaataagaaataaagaactaaagtttatttcattcctcttgtagtatatctaatctatgactgacctattggctttagtggtctttgaaattattcactgctctgatatggcctgaattgtgctgtttaaggaatttaaaattaaatattcataaatgttttatgaactgaatttaagctattgaagtttttgttttttgtgtttttttttctttttttttttttttttttgagacagggtctcactttgtcaacccaggctggcgtgcagtagcaaacatggctcacttgcagcttcaacctcgcaggctcaagtgatgctcccacttcagccctccaggtagcagggactacaggcacataccaccgtgcacagctaatttttatattttttgtagagatggggtttcaccatgttgcccagggtggtctcgaactcgtgagctcaaatgatcctcccacctcagcctcccaaagtgctgggatttacaggtgtgagccaccatgaagtttttccatttgcattaattgctctgtagattttaccatttttgtctgttttataaactgttactcattttatgaaatttaaccaatcttttatacttgtatatgtttaaatgatcttttatacttgtatatgtttaaatgttctcttcaattttgatctcccttctcccccttttcttgtattagaatctgaaacctacctatgcagcacataaaatgggatagagtattatggttcagaaaagatgggtaatagtttaggaaatatattcactacatatttattaggataccttctaaatatcatctttgaaaaatgctggagtcaaataagacacgtaaactaatctctaagaaaactcatggtagaattatgtgaaatttcattacaagttaaacactgctttggctactcctaggatatttaaagatttatataatctaagatatcctctaatttagaagaatatggtggattgctgtttgaaacactgctttttcataaaatctgcttagagtcacagagaatttttgaaaactaaattacttttgaagtactaagtatcttgaatgtacaatgagaacattaggtgaataggtatgttctcaaaagttgactttgtaaatcaaatcatacatcatcagttgatacaaggtaagccttctcccctttattctcacaccctgcacccactcttcttgtgtgtttaatatgcataaattcttgagaaatagcatcattttgtgagtctgttttttacagttaatgagatttttaaaaaaattttattgtgataaatatacataaaatttaccatcttaagcacttttaattgtacagttctgtggcattaagttcattcacattgttgtgcaaccatcaccaccacccatctctagaaatttttaatcttccctaattaaaactctgtgcacattaaacactaacatgccattttcccctccccccaacccttggcaaccaccactccactttttgtctcaaagaatttgactattctgggaacctctaataagaaaaaccatttaatatttattcttttgcacctggcttatttcacttagcataatgtctcgaaggttcatccatactgtagccatgtgtcagaatttctttcctttttaggtctaaatgatgttccattgcatgtatatgccacattttgttcattcatctgtcagtggacacttcaggttgtttccaccttttgtctatcatgaataatgctactatgaacgtgggtgtgcaagtgtctgcttgggttttactttttttgtgtgtactcaaacctgtgtttttaatttacataatttttgaacattattaactcaatactgtttttaagatctatccattttactttatgtccatctagtttgtgatgctaactctgctctatagtattctatagtacctatcactgttcctccagtgaaggccgtaagttttctccaaatcccgttaaccacaaacacctttatgatatacattcttatacatatctccttggactatgttatttatgtatttctgtataacaaattgtaccaaaacttagtggcttaaacagtttctgtggggcaagaattcaggaatgtcttagttggatggtctgactgaggcaggatctcttatgaagtagcagtcacgatgtcagtcacagatacagtcatctgaagggcttgactagactgacggatcttcttccaagatggctaactcacatagtctcagtttttcattggctattggcaagagacctcagttccttgtcacgtgggcctctccatggggctgcttgaatgtcttcatgacatagcagctggcttccctcaatgattctaacagaaaggccatttatgacctagactcagaagccacacaccattgcttctgctgtattctctttattagatatgagtcactaagtccagcccaccaaagagaggaattaggatccacctcttaaaggagtagggtcaaagaatttatgatatattttaagatcattacatcgaccagtgaaacagtttcactggatttatccctaggagagggatcactggataataagggcattgtttcctattgctgttgtaacaaattaacacaaacttagtggtttaagagaacacaaatgtattatcttgcagtcctggagatcagacacggttttcactggaccaaaatcaagatatcagtggctctgcgtctcctctagagattctattgaagaatccattttcttgcttttcttcagcttcttgcattccttgtctcatggcctctttctccatcttcagtgccagcagcattctaaatctctctctgaatctgaccctctgctgctcttgtcacatattcttctctgacccttctgcctccttcttaaaagaacctttgtgattacattgggtccacccagataatccaggaaaatcagcttcaagatctttaacttaatcacatctgcaaagttcctttagccacataaggtaacacattcataagttttggggactaggatttggccatctttgtggggccatacacaggcatactcatctggttctccattttttttaagctgaaggatttttttagttatttttacttttgcgaatgtgtgttactttcttttggtaatttcagattttcatttaccaagtttatttaaagcatagtataatatataatgatcaccaagatggtaagcagatattcattgttcaattagattcttgattttatcatcacttaatttatatcagtgtatcagctacttctgacatagtctgtaatagaaactgagaaacgttaaagcaacacagccttattaaatttctctttgtatcttttagactcgttataacaccagttctgtgggcgctttgttgaaacttgatctgtcattgtcttaccagtcattgaacttagggccactctaatccagtatgacctcatctcaaacttgatccatttatgaagactctgtcctcaaataaggtcacatttgacatgacattttttggtgtttttttgtttgttggtttttttccctctgttgcgcaggctagagtagcttctgggctcaagcagtcctcccaactgagcctcccaagtagctaggattacaaacatgtgccaccacagctgactaatttttaatttttttttcataaggagagagtctcactatattgcacaggctggtctcgaactcctgtctacaagtgatcctcccacctcagcctcccagagtgctgggattacaggtgtgagccactgtgctcacacctgtaacatatctttttatgaaacacagttcaacccataacactcccttaatacttggtaccttgtgaataataagatacctaaatatggtaccttgtggataacaaggcatattgtcttactttttttatggaaaagtcatcttggacattctctgaacttgtgccctctctttctgttgtctgccctctgtggctgataatgcaccctttctgttcattcttacgtgtatatttgtcttttatatggctgtcgctgagtaaagcattttgggaattacaaaagctaagtattagatatagaccttgtcttcaagatatttatgctccagctgggaagacaaaacaccccaaggtaaaatggaataatttgagaagttaggccaaattgtatagtatttactgttcagccagcaggaagattcattattggctagagacatcaggaaggttttgtgtaagaaactgagctgggccttaaaggatgaggatatattataacagcagaggaaaaaaggatgtggtattcagaaaggggaggaggtataaacaaaaatataaaggtaagaaatagtttgtagaggaaagtgaggagagacttacttgaggaaggttatcttggaacttaataggaaataagttttgaaggtagactattatcagatataatagattgtgaacaccagacagaagttatacagtctttgagagcatgagcattaaaaacaagtacagatttgaattctggcataggctcttgatatgtgttcttagggaagttatctactgttttggagttccatttttcttaactcaaaaatgagtaacacctacctcataggtggttgtgaggattaaatgagttaatatatagaaagcatttacattacgtgagatattgtaagtactaaatagatatcaggctttctgaatttcacatatcaaatacataaaaaataagggcatatataggatttaaataatatgctggtcagttatagaactttatatacttttccttttaaaacatttttagtaaaatttttatgaaaattagtcaaggcaaacctttaaaaattttcagatggtaacaattttataagcaatagtcttccattaatctaataagcaatgtatcaatgacaataaaaagatgactcaaaaagccttatatacctaacaattgagacagatctttgaagtatcccctagatcaaagaggaaatcaagatggaagtcatgagttatctggaaataaagaggggaacacttcatactaaaacttgtggaatgtagataaggctgtactaagagaaaaattgatgtccttaaaatttatattattaaggatgaaacgaataagtgaatgtttaagtaaagtaaggaaataaatgaattaatattcactttattattattattattattattattattttttgagacggagtctcactctgtcgccgaggctggagtgcagtgttgcaatctcggctcacagcaacctccacctcaagcgattctcctgtcttagcgacccccccaccccacaccatagctgggactacaggcgggtgccaccacgcccagctaatttttgtattgttagtagagacaggatttcaccatgttggccaggctggtctcaaactcctgaccttgacctgcctcgcaaagtatggggattacacgcgtgagccaccacgccagcctttcactttaaataactattaaaaataacaaagtaaaccaaaggaaaataagaggatataattagtaaagataaagaaattgataaaatagaaaataaagtagtggaaagtatgtgttgatgtttttgtttgttttggtaaacaccaataaaataaatgaaaccctaaaaagtttaaaggaataaaaggcaaacagaacatcagtgagaaaagataccttcagataaagaatttttaaatgacagaatatatacaactctgacaatacatttgaaaaactagaggaaagaaatagtttactagtgaactattaatgaataaaattaatacaagatggagaaagcattaaaagagtaaatcacagaagaaactttaaaatactttaaaaaaatcttagctctaaaatggcacctcttttgagtatccgtcactttgataagaaaaaagaaaaaaggcaccttctgatttgaattctagctgactttcaaagaatagacactattcaaactattccagaccatataaaaagatgagatagcataagcttaattgaaaaccttatttcaaaatactataaaaatttaaaactatacattttctctttaaaaattctaagtgaaatatggaaaaatcaacaggctcgtaaaagcataaaacatgaacaactggggtttatttcaggaatggaggataggtcaacattcaaaaatcttataactgactgcatcaagaaattaaaagagaaacgatatgattatacaaaaaagtgctatttacgttcagcaaccactactaacaaaaactttaaactcaaaggaaaatgcctaaacatgtttaaaaaatttactgaaatctgagtaagaatattaaatagtgaaataatatgccattcttattaaaatcgagaataagatagtttattcgacattttaaagtttcaagctaacaataaaacgtgaaaaagaagtgaggtacaaatgcaggaaagaagagtcacaagtatcatcacttacagattatatgattgcatacccagaaaatccactggaaaccctattggaattcatagaatcatttgataaggtggccacacaagggttatgagttaaatagaattagtagcttttatatatactagcaatatttgtttttctttctttcttttattaagagaaggggtcacactgcattacccaagctggtctcactcaagtgatcctccagccccagccttccaaagtgcttggattacaggcatgagccaccacacctggccattagcagtattcgatgtggggtggtggtggtcattcacagcaactcaaatagccaaaagcctagggataaatttgatgtgaaagatacagaggcataggacctttttcttgaggggggaaaaccctggaaaatttgattgcagaggctaaattattcatgagatatagtaagacttagtatggaaatgtgagcctctctcaaattaatataaatatagttacagttctaagtatgagaattgagctataagaaatacgtttccattcagtggaaaagaaatggtttgtttaatagtgctgatgtaattgcactgtttattactactttcagttatccatatgaaacacaataaagttagaccactacactcatgccatacacagcaataaaaatgccttatgaattaaagatctaaatgtaaagtaaaatttcttattcaagctagtgaattaatctcccaaatttatcacctctttcgcctaagaccccattaaagtgatagtaaaaacaaaataaagatgggagcttacaatgccataaagagtaagagacattcaaattgacattgtaacaagtttctggaagatgaagaaatcgtgggaattaaaatggatcactgaaaagaaatcaaggattctaagacttcctagttctctgttctttccaacatggcaggttggaaatttagtatttaaaagtaaaatactaattttagtattaggaatttctcaatggcctttgaaattatttgggttaccttggggtgtttgaaaacccaaattaggaaattatgctttagaccacctgtttttgtaaattaagttttattagagcatgggcatgcccatctatttatgtgtttggggctgcttttgtgctacagctacaaagtcaagtagttgcaacagaaatcatacgacccacaaagccttataatatttattatctggcccttacagaaaatgcttgccaacccccgctcctggtcgttgggatgggcatcttgagacctgcccacacgtggtatgggcttggataggtctagccagtgttatgtagctatttacagaatgtaagcaaaggaaagtgtggggaaagaatatggcaaacagaaaactgaatatcaccacctaatggggccttagtagggaagagaaagagaaatagaaaagggttgttaaagagaaaattaaaatggatgaggtgaattctgcttggaatttaaaactttttggtatattattgattttgtatctggcaagcctaaaatttttatatttctaagatgtttctattttgtttctttccaatgataacactttctcttttttaaattttactgtgtgaattaggacttccaggattatgttgactggaagtgtggatagtagacatcttattcctgattttaaagagaatgtctgtaacatttcactatgaagaatgaagtttatagctgggtgtggagcgcctgtaatcccagcagtttgggaggtggaggcgggcggatcacttgaggtcaggagtttgagaccagcctggccaacaggtaaaaccccatctctgtaatcccagctactcgggaggctgagggatgagaattgcttgaacctgggaggttacagtgagcccagatcatgccactgcactccagcctgggcaacagagcaagactccatctatttaaaaaacaaaaaaaagaatgaggtttacaaaattagctgggcatgttggcttgtgtctgtagtcccagttactctagaggctgaagcaggagggttacttgagacttgagccagggaggtcaaggctgcggtaagcctaggtgacagagtaaaaccctgtctcagaaaaaaagaatgaagtttgctttagctctgacagtttccctcctatttccaggtttttatggaaagttttttctttgtctaagatggtttttctttagtattttaatgtagcgagtgacacatataaatgatcttatattgcactctactcgcattcctggaataaactcagctttgttctgctgtagtttctttactgtatgttattgtattctgcttcctgataatctcgtttagatttttcaaatcaacatttgtaaatattagcttatgattattctttttcacacaatctttgacctgtatgtcatggttagattggcttcatggaatgcattggaaaatatttgctatttttccatccttagaagcatttgtataagattggaatgatttgttccttaaaagtttggtagaaggtgtttgtaaaaccattcagatacggtattttgaaggatttggaggaggaggggaaagatattaatacttactgctccaatttttttttttttttttttttttgatatggagtcttgctctgtcacccaggctggagtgcagtggcatgatcttggcttactgcaacaacctccacctcccgtgttcaagcgattcacctgcctcagcctccggaggcgctgggactacaggcacatgccaccatgcccggctaatttttgtatttttagtagaggcggggtttcaccatgttggccagatggtctcgatctcctgacctcgtgatccacccgccttggcctcccaaagtgctgggattacaggcatgagccaccacgcctggtccaattttttaatagttgtagaactattaaggtttttctgttgcttcttgaatcaattccccctccctagaatctttaatatgtttggaggttgttttctttttcctgtctctaatcatacttagttgtttttttttttttaaatccaacttttggatggttttctttttctctttttttttttgttttttttttttgagatggagtcttgctctgtctccctggctggagtgcagtggcgcgatctcggctcactgcatcctccacctcccaggttcaagctagtctctcacctcagcctcccaagtagctgagattacaggcatatgccaccacgcctggctaatttttgtatttttagtagagatcgggtttcaccatgttggccagactggtcttgaactcctgacctcaagtgatccgcccgcttcagcctcccaaagtgctgggattacaagcatgagccaccgccacctggccaatgctttgcttttcaaactcttcaaagggtatgtaataaaaaggaaggcttaccaccagacaccataccttgattctataagcagtgactgtatttttgtatgttctttaagtgatattttttatccttatgcactcctttatttttactggaagaggagggaccacatgaggcattagtgatgagcattctttttttttttcttggcttttgcctgttttttatgtttgtttgttttgtttttcatcaacctcatttttacatcagcctcattcttcttaataccaatgtagtatttcactgtacagatgtgcattatttattttaacgtagttgtgcttttatagcaaatagaaactttcccatttgtttgaagtaccctaagaatctcctttattactcctagtctagtaacggacatcattactttagagaactctacttggccctctgtgtgtcttacacccattaaacaaattaaaattaaaatgttccataccatcctttgaagagggtgtacaccatttaaatatctttacttaaaaaaataaaagtctgctctcataagcaatgaaatgtttttcaaacatttaaatctctgttcctttttgcaagttatcctagtgtgttgtatgaggaatagatgcagttttttctttttcctcatggctgtcctatttcccagcaccactttaaattccatctttttacaagtattgagatgctactttaatcatatactgaatttatatatatttacttctggattttaaacattgtgttctcgtggttgatctattcatgtactggtattgtagctttttaaaaaacttttaattttaaataactttggacttacagaagagttggaaaaatagtacagagagtttctatataccttttacagattccccagatgattaacatcttatatatctgtactacaattatcaaaacaaaaaaactaatctattggtacaatatagttaactacatttatatggttttaattataaaggctttgtacaatattttaatatgttgttggtttactccctgctcttctttcatattttcaattttttaaatgtctagctgcagaaaataaacaaaagctttatatagtatttttactgggactgtaaaatttataagttagcttagggagaaatggcatttttatgttgctgaatcttggtataccagaataagaaacgtctttccatttgttgaagtctacttttctatctttctcatatatgttttggactctttttgtagtttatgcccagatatttgcattttttattgtaaatgggatcttttctttcatttatcttctgtctggtttctctcccctataaatgaatgatttctgtatattttgtactatactgtattgccaaattatattattataataatatttcatcgatgcttttgtatattccaggtatataattgtgttatctgtgaataatgttccctttctaatttttttctaattttattcattaatttgtgttgactaatattatgactaatagaatggtaccctgactgtaggactatatccagtgtttccacattaagtatgctgttggccttggggttgatagatcatgttaaagaaatgttcttttttattcagtattttcaacaagaatgggtattaaatttgtaaagtgtcttttcctcatctttggcatgaacatatgattttttcccatatctattatgttaaatgatataattaattttctaatagtgactttttcattgtaaattatatttttcatctcttttgggatcagttctgatagattatatcttctagtaaattattttgggttttcaaatttgtttgcatagagttgagcagagtcatcttttatgattcttttgctttcctgccttcttattcatattttcctcatttcatctaaaaatgctggaaaatatatctttgtttttccatgaaaacaaaacaataaaagcagctccattaatgtaaaaaagaagtgatctcaaacttctgaaaataataatcctccacatttaattctgattatcttttgccagcctgaaattttttgcttccttgctttaatttcttacattacttgtaaatttattttctaatgaacatttgaataaaagtctagataatagtccttgtgctttcttctcccctaccccacacttacaaggtgcagcagtgtctttagtggtcatcttaactgcagaaaaacaaattgagaggtttgcatgctctcagtaaagtgaaagattgggaggttttccccatttcatggtgtgtggcagctgtaatgtgatcacacaagtttcaaatttgaaaaatgttttaaagatatatttggtatgcaattcgtgtaattgcaaaaaaggcattccaaagtaaatttatgacttcacaaattttgtatgacttcacaagttttggattagggaggtatggctgcagcatcctaaaacaatataaggttgggtattcttccatgaaacttgttattttttccataaagttagattctttctagagcagaaagaactttaatgattgggaatctggagttaagggaaaaaaagatgattaaaagtttaattgttcatctgaagagttgatttttttattcctgtaataaagggtacttttagcagtctctgctcatcttgcccatccggctctttttgtggttgtgtaaggttataacttctgtgtctcagtaaacttgtgcatgcccatttttttctctgttactaccttttctcttattttgttttattattttgatgtaaaattacctgttaattttatttgaaatgagaaattttaaggttcacattattcaaattctgtcagatccctacctctgtcatatggtttataatgtgctgggtattttcagacctgcttattaaaaagatgtaaaacaaaataatgatcactcctgtggatttttcctttatttttgagatgtctcctttggctgcattacttcttcaccccttgcccattgatcagaggaggggtcttaactatgggtgaaccctatatcttactgaagaggttatgttacatgtatattttcataatataacttacatttacatagtacttttatttttagcatacctttttttattaatcctaataatatcactgtaagttatgttgaagcagattgtaagtgttcatttacaaattgtgaaatgaattaaaatgaaagggcaaagattaaatcatgaccaggcctgaaattaacacacaagactcaatttttttcaaccaaagacttttgtaggtgatccctgcctgcaggactccccttcctcctcagatgtcattggattgtaccaggtttactgtagattctagccgttgtagaactaactagatctaagatgagtcccctgatttcctttggtagagtcttccaattgctgaactccaatattgtcgtgactagccagtgttacaacctgtctgccttattttgtgtaatggatttcatattacagaggcatttttttaatgtcaagatgtttaagtattgcttaagtgcaaactacttaatactttttagctattaagtaattaagataggcaggattttatttgttccaaaatgatttgacctaaactaaaaagagaatgtggatctcctgaatcttacttggttaatcttaatataactcctagcattctataattcttcctaaagtcctcttacctggctatcttttgtatcttctttgtctctcctcttctttcccagtcataataactgccagactctgcttcatttctctttgacagtctctactcctaaggtcatccattctctttaggtatcttttggcctcagtttgagcacagcagatcccaagaccacatatgccatagcataggctattatagtcaaccttttgaataaatgtgattgaactttatgttagtaattcttatttaccatcttcctatcaaaaaggcttaaagtcttcatttaatgctctccttcatgtccattttgttaaatgattgccttttaatgacatcttagaacttcagaactatttcaccatggaggatgtgtaagattagccttttatcaaataaaaagtgtgaaatggaatatgtaatctcattaatccattctggctctaaaattctgtgactatcagataaaattcagaaataaaatagtattactaatataaataaatttttatcataattatatttcctaagttttgcctgtaagaatgggtaaaatatctttaaaaccttgaagaaattattacttgatagaaagtttaatccatctgtgagaaggcaaatgtattcagacacaactaaagttctctcttctattttaatttcatttatcttgaactaagactccactgtttcatcctcttagatgctgctacttgaacaatattgttttgagaccaaaaactagcatattaacacaattcttcttaaacgtcttaagagttttgtttcctttacccctttctttaaaaacaagcagccactaaattttttagtagtgaatttcaaaatcctttttaaccttataggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggtatcaagactgtgacttttaattgtagtttatccatttttattcagtattccctcttgtaaacttgaggtaagacactttacttaaaagtgtattttaaattaagcaataatatgtaaactctttcttgcaaaagttagcatttatatttttaaataagatatattgaattcattcagtgaatcatataaagaaaataagtgtaaaactccaatggctagttagttcttagttctttttaagattaaagagaagagaccaaatatagcatcactgtactgaggcaaggttttctgtgtagttcatagaaactagcctcatgattttagaatatgccttgaatattaagtgtagccttcctccccaactccctcagatcttgccaccccttaagtgctgcagtgataggtgatcaagaaaatcaggataccctactgggaagagccatgaactgaaagtcagtacctggttctatccctggctttcccacaaactgagctatatgacctctgtatattcttcagaacttaagttgtcttatttggcaagtacaggcatcacactagtctagatgatttccatggcaccttcaagccctaaaattggcttgccaaatagtactgaaaagttctgatcacctccaagacaggttagaaaatcgtctatagtggggaaaatgttctggtttcaaaataattgaggttaaaactttagccattttaattcccacttaggcagattctcttctgactgaatttaataacttcatagaattggacattatcaacaaaaatattacttccaccgggtgtgatggctcaggcctgtaatcccagctcttagtgaggcagaggcaggaggatagcttgagccaaggagctcgagacctgcctgggcaatatagcaagaccccattctcaaaaaaaaaaaaaaattacttcctttataaaaaaaaaaatcttcctgctttgtgttgtttctccctcttggctattttaacatttgagttcctggtccagttcttcctgtctgttcactactcttattccttactaatttcctattctatcctagtttttttcctatgcatttcaaggtttcccttattctccagacttttgtgtgtcactgaggtaactgtttctgcttctcttttaccctttatattcagtatcatcacagctcaacctttgctcatgtgtcctattctctttttccatccctctatcaatcttttctactctaattagcctcttctgtggtaaaactgtccccagcaatgacagacatccaatatacctacttcaaatcccttgggaaataaggtagactataaacaaacattttattctttccacaaactatgggtgacctaaaaagacttgcattagttgcctaacaggttaaaaaagagtagtttggtattttaacattgatcaacacattacatttcaaatcattatacttggcatgtgtttttaaaagttttaaaatacagaattaaaatattctttcatctactttagtatggtatatttcgcagagaactcctcctggcaggcctgtttagatagtacatgtctgttttgtagtgtagaactctgagatctcttttttaaagtttgtttaattccttaagcaattcaaaactcatatttgagagacaatgtaacttacccttagatccatctccacactgaagtggaatgtctctcagagtgacaatagaagtcacaccctcaaatttctacagtggaatatctagttgatcatttatatgtgtggtataatacaagttgagtatcccttacccaaaattgcttcaggccagaagtgttttggattttatattttttcagatttttaaatacttgtattatacttcttgagcattcctaattcgaaaatccaaaatctgaaatgctccattgagcatttcgtttgagtgtcatgttggtgctcagaaagctcaagactttggagcatttcagacttcaaattttcggatttagaatgctcaacctatatacatcaggaatagtggcacttcagatatacctgaaaccaaccataaattttattttactcagcatgtgcttcaacagacatcttgtgaatccattaacatatttccttagaattggacatgtggtaccataacaattacagccctgtaatgaaattatatctctttttaaggttttatgctgtgaaagagcataaaccatgagctatttattttgtcttagaatattgttttgtgtagacacttttgaaaccattggcacttcctactgtggattaaaattaatccacacaatggttatttctcccaaaatcacttgctagactttgtaataccttatataaactcgaatcacgtttcctgttcattaatctctttacccccaaaaaaggcaaaaggaggctgggcaccgtggctcatacctataatcctagcactttcggaggccaagcagaaagattgtttgagctcaggaatttgagaccagcctgggcaacatggcaagactctgtttctgcaaaaaaatacaaaaattagccaggtgtggcgtatatctgtggtcccagctacttggaaggctgaggtgggaagattgtactccagcctgggcaaaagagccagacctggtctgtctgaaaaacaaaaacaaaaacaaaacaaaaaacagcaaaaagtaggtctcctccaaccggattacttaaagtctaaaatttatgtagtagtaccatctagtggcaaaagaggacactgctttgctatttgattatatgtgtctttgtagcagccagggaaataagtgtttatgggttagggaaatgtgaacactgtatattaaggaaatatttatttttaagtataatgatattattgtgtttgtgtttagaaagaatccttgtttaaatatacatattgaaatatttacaaagaagttgtatgatgcctgagctttattttaaaaataagtctgaggcagaggggtggaaatagaggaagtggatatgggtgtagatgagataaaactgaccatgaattgataattattgatgtgggatatgaaggtacatggggctttgttataattttctgcatacttaggtatatgtttgaaattttttgtaatgaaaataaaatagagattacatggaatttagatgatatgaaatcagataaatgcagaattatagctaatcttaaaaaaagttgtgtagtgtattttttactccatggctagagccctccccccaacttgttttttttgtttgtttgttttttgttttttgttttttgttttgagacgaagtctcacactgtcgcctgggctctggtgtgcagtggggcaatctcggcttgctgcagcctccgcctcccgggttcaagcggttctcctgcctcagcttcccaagtagctgggactacgggtgtgcaccaccacgcccggctaatttttatatttttagtacagacggggtttcactatgttggctaggctggtctcgaactcctgacctcgtgatccaccgcctcggcctcccaaagtgctgggattacaggcatgagccaccacgcctggccccctccccacaacttttttttagatggagtttcgttcttgtcgcccaggctggagtgcagtggcacaattttggctcactgcagcctccacctcctgggctcccagagtagctgggattacaggtccctaccgccacgcccggctaatttttgtattttagtagagacggagttttgccatgtttgccaggctggtctcaaactcctgacctcaggtgatccacccgcctcggcctctcaaagtactggaattacaggcatgagtcaccgcacccagcctacctagagctctttaattgactttaaaatactgagtatagcaacaaggtaaatatggcattttagagataaaaagctgaaagatggcatggtgtaggaagaattatctataggcaagttattgaagcatttacatctttgttgtagtttgacaaaatttaatatttataaattggtctataaactgtaaaacaatatacatgtaaagtatatcttttcagaaagtaaggaaaaaccgagatcaacatttcagaatgtattttgaagatgtaattatcaagtgtacttatatctggtaatgaaaagcatctttaattatgatatactgaaataaataaaagtgggtcaagtagcagcctccctgaaatgacaaagttgctcatagataaatatcactggtataaccacagcagatttcatttctaatgaataattttctttctttctttctttcttttttttttttttttttttgagaccgagtcttgctctgtcaccaggctggagtgcagtgacatgatcttggctgtctgcaacctccgcctcccgggttcaagctaatctcctgcctcagcctcccgagtagctgggactacaggcgtgcaccaccacgcccagctaatttttgtatttttagtagagatggggtttcgccatgttagccaggatgttctcaatttcttgaccttgtgatcctcctgcctcggcctccaaagtgctgggattacaggcgtgagccaccgtgcccagcctaatgaataattttctaatgtttctaaaatgttaaaatacttctaagacaatgtgtgattatatagtgtaattaatcttttaaaactgagcttccagaattttaaaatacaaatgaatattctctccttcaaaattacatatgtatttaaaagctgccacttctcaaagaactttttgaaacatttttttttggaactgctttgcaattgtattccattttcttttaaaaactcttcaaaatcaagggcctcttctaggttgtatgcagtatgcagcccccaagaaatctgtcccactcaaaaactagaaaacactggataaaatacaaaaatcatacttttaaggacactggaggactgtggaatcatcaagctctttattaactataattcttaggaagaaagaaccctttctagataagctgagattactggtaattttcttcctggggtatattgattctgggtacagattgagattcatcattggcacaagcaggaggacttcactgggagaaagaaactcttgaggactttctgcaggactaggtatgaaagaaaatgaaatcgttggcagccttgacaaacatgagggcagatgtagagatactagcatttagaggagctctaaatgcatggctcatttttaccatgagatattggccgagtcttgtagtgcaggagacttgggatagactagaaacgcagaatgttagcaggcgaagtcctgctagagggagagacatgttactttcataccacaggtctcctcaagtcatttgccagattttaaattttgtagagcaggagattaaagacctgagtttacaacctccaagagaaacaacatttaaggctagagagttaagtgctaccagagaataaggctgaactggaaaggcaaagtgaaatatcccatattcctgcaatgtttaggaaagacctattagagggagacctacctagtatatcaaacatgactggttttccattcaagataaatgtcagattttgatactgtatagggtaagaagttaactgctgaggagatggagaactttcatattttctatctgaatatagagagacacactcaaggaactgggaaaaccaaaccagttagttgtgaacttaaaattgcaactaggtctcaatccattttttttttttttcaagacagagtctcgctctgtcgcccagtctggagtgcagtggcacagtcttggctcactacaagctccacctcccaggttcacaccattcttctgcctcagcctcccaagtagctgggactacaggcacctgccaccatgcctggctaattttttgtatttttagtagagacggggtttcactgtgttagccaggatggtcttgatctcctgacctcgtgatccacctgactcggcctcccaaagtgctgagattacaggtgtgagccaccacccccagcgggtcccaatccatttttagttgctaattggattgaggagatcagaccccaacaatggaaaaggcagactctctagaggaaaatactatcaatcatcttaagtctcttttgttcttgtatacacagttggcatacagtcaaacgttatatgaaatgcagagaaactggaagattactgataatcaagggaacaaataggtaataggagcaaactcagatgatccacatgttgcagttagtagtcaaggattttaacataagtattataaatgtcttgaaaaaaagaaaaatgaacagatagaaaattttgacagagaattggagtctataattaaaaggaatcaaatagatattctagaactgaaaaatatatttgaaattaacattggatgggcttaacagcaggctgaacactgaattagtgaactagtgagaagacagaattagtgaacttgaaaaaagatcagtagaaaatattcaaactgaagcacagagaaaaaaatggaaaaaacaaaaaagacaaaacaatggcttctagaagaaaacataggtaatagcttcttgtcctgggagtaggcaaagatgtcttaaacagaatgccaaagcaccatatatagaaagaaatttgatagacctcattaaaactaagaactcttgttcatcaaaagactcgagtgtgcttctagaagaaaacataggataatcttatctatgtggccttgggtgggcaaaatttcttaggacacacaaaagactaaacataaaaatgtataagataaacttcatcaaaattaaaaacctgtgcttttcagaagacttcattaagaaaatgaaaaagtaagccatagaggagaaaatatttgcaatacatatatctgaccaaaggctcagttcagaatatattaagtaattccttcagaatatataaatcccacaaaccagtaacaaaaagacaatccagtttttaaaatgtgacccagggacttgaaaagacaattcaaaaagaaagataaatggcagataagtccatgaaaagggattcagcatcatttggcatcagggaaatgcaaagactatttcactcctactcaaatgactgatgtttaaaagactgatcacaccaaatgtggagcattggaatgctcaggcattgctgagagaagtattaaaaaccattttggcagtttcctttaaaattaaaccctatgactcagtgtttgcactcctagaaatgtactcaagagaagtgagggcaagtgtccactaaacggtacaagaatgttcatagtgacattctaaataatagcctgcagactggtaacagcccagatgcccctttaagaggagaaaggatagataaattgggctgtatttatacagtggactgctacatactatacaacatttaaaaacaatgaactgataaggcaacagcatggacagatttcacagatactatgttgaacaaaaaaagtgagacacaaaatacttatgtactgtgtgattccatttatatgaaggtcaagagcatgccaaactcttctgataaagaagccagaatagtggttacctctaggaaatgaagattggtaaaaggagcttgagggaaccctctggggtgctagaaatgtattttcacctagatagtgattacatgggtgtgaaaattcactggatatttaggattagtgtattttacatatgtgtgttgtgcctcaataaaacaggaaaaaaattacttgaggtcagtttttattgtggaatagccataaactgttcacagcaaactagtaaataatgtaggtcatattggatggtatcatcttaaggcaaagtaactggatgtgactgtaaatttacacagattttgttgatgaggttcataactcaaagcacttacaaaagtaatttaacacatcattggagtaagttagtagctttccaaggtgactactttgggaatctttttaaaaattgtttgaccttaaatcttatttacctttatgcttatagctatcaatagatttctaacaatgtgtacagaaatttttaaaaatagaactttattacaagttgagtatattcactattttattaaattaggaagtgtggacaaaaaaaatcaaaatcaactatttttttttaaatttaaatcccatcaccagaggtaaaagtaacctttgatagtatatatatatattcttttctctatacatttatgcaaacttgcatttgatgacatcatattttgcaggttttttttttctgtgtaatttattgtcatcttacgtcagattatgtattttacagttgcatagtattccattgtaggtacagctaaaaaatgctatggtttatttaatacttattgttggacatctgaatttatatggctttttaatttctttttttagtattttaagtttttattatttctttttaaaaagaccattaatgtaccattagttttgaaaaaattagatgtatgtccaatgatgtacgaaggattttttatttttaaacttttaaatctttgtaacttttctaaaaacaagtaggattttttctaatacatattgtttaaaaagtatgacacaacaagtaaaaaagaaattgcttgtaatttcagtctccatagaataacactgttaacattttaatgattctgctttcagcatcagcttcacctgagaacttgttcaaaatgcagattttcagcctctaccccaggcttactgaatcgacagtctatgttttaacaaggtcttcaggtgattctgatccatgctgacgcttgagaacactactgtaggctttggagaagaatcttacaaagagagacctgatcggccgggcgcggtggctcacgcctgtaatcccagcactttgggaggctgacgcgggcggatggtgatgtcaggagatcgagaccatcctggctaacacggtgaaaccccgtctctactatactaaaaaaaaaaaaaaaaaattagccgggcgtggtggcgggagcctgtagtcccagctactggggaggctgaggcaggagaatggcgtgaacttgggaggcggagctttcagtgagccgagattgcgccactgctctccagcctgggcgacagagcgagactccgtctcaaaaaaaaaaaaaaaaaagagacctgatcacagctgtgccttaaaaaggctgctctgacagctctgtgcaaggttgagccacttgggaaattattttcatagtttaggtagggttaataacaagatagtggcagtaagaatatgaaagagatagctgtaagagagctaatagaggtagaatcaccagaaatccataactgggaatgtgaaggaagaggtgctaaggatttgagctggaggagaaagagaaggctaatgccatttaactgagagaatacaaggcaaagaataggctttattggtacaaaatgttagttcagttctggacatttagatgtatggtacctgtcatacagatgtaaagcatccatcagttggttggaaaagtgagtctgaagtttgcaagtgaagttaggattcgagacatgtcattggaaattaactgctcaagggtagttgttgaattgtgagaccggaagcctgagaaataaggataagattaaaaaaggattattgaaggactaaaacagtagcaatggatggaaagagaattggaatcctggaaaaatcacaggtagtctccaatgagagttcttaaatggaagagatggtgccctgaagtttatagtagacattttgatgggcatattcaaattcagtaaaggaagttatcactgagcaaatttgttttctattccacaaatgtaaaacactctggaatattttgaaaataatacagtcaccttcatgcccccacatctacttaccaaagcctttcaaactccaacatagtctattattttgaaggtcagatactaaggctatttattaaaaggaattctggggtttgggggcgatttctttgtttctgtttttttagctgaggtctcactctgtcccccaggctggagtgcagtggtgagactgtggctcactgcagcctcaaacttctgggctcaagtgattctcctgcctcagcctcccaagtagctgggactacaggcacatgccaccactcatggtttttgtttgtttgtttttttaattttgtagggacagagtctcgctatgttgttcaggctggtctcaaactcctggactcaagtgaccttcctgccttagcctcccaaagcgttgaggttacaggcatgagccaccatgaatgcttacaatgtcactgtcaagataaatcagtgaaaccgtctttgctccagtcactcactttttgacaggttttccttttaatgtatttacagattacttttcttataggggaacgttccatttagttacaaagttgcaaatgttcaaatattttgtcttgcattcaggaaacctgattggccaaagaactatgctaggagctagaatggaatgcctcagtaaatggaaaataatataaattattattaagtagcatgcaataagagccaaagttcacaaatgtaatggcagaaaaactggtagaaaatgaaaatttccaacattctttgagaaaaaatgatcaagaaagggattacatgggaaagaagaaaagcatcaaaagtcaagaagtagtgaacatacagtcatttgaatgtatgctaattgtaaattagtatactagcagaatatacttaaatgtggtatataaaagcttgaatgttgaagttgttaaatagattatgtgttaatttggtgttttttatggtcatgttggtgcacgcttaagagacatggattctaaacacataagtagcttttgtaacttgagcaagtctctgggtctcacttgttttatctgaaaaatgagaataatttgcattgttggtttttaggtttgaaataatgaatgtatcttaaatgtgtttctaataccttgcacagagactccccataatcaccattatctcaaaatatcactattattatttggccatgatttatttattaataatgaataataggtaatatatataaggtgcgtgctttgagagtgatctgaatttttttctcagcatacttaaatgtcaagaaatacagaatcatgtcttgaagttatttagaatttcatgttaatatattgtgttctttttaacaggaagtacttaaacaactacaaggaagtattgaagatgaagctatggcttcttctggacagattgatttattagagcgtcttaaaggtagattttaaaaaggtgttttaaaataattttttaagctcaaattgtcatctttaggtgtgtagatccaagtacagcttctctcgatttgggtgttggtatcagttttcttggtatgttagccttaccctcaggatgtaattgttaaagtacaaataaataaaaaatgtatttgtgtgtcatttcttcagttaaacatttaactggctttgaatgaactattttaaatccctcccttaaataattttcggctctttgtaaagcttgttgctattctgccagtcactaaatagggctttagtattctatatgccatagacttgagcctactgtttcattggaagaagtattgtcttcttcattcaggatagaaatactttaaccttttcacatatataagttgattataattcatttttagcagttttaaaaggatatctttctcattctgttgcttgaaaattccagtgtcagaacagagaaagtgcttgataataattgaagccagacagagaaattacttttggattctaaaatattatttagaggaagtctaaggaagtacattttatctaattttcctttaacacactccttatttttaccctgacccaagtggacttttcagggaaagtcctaaataatttttgttttcagtcatgtatatttgtggttaaaatgtaaacctaatatttcactttaaaataatataacattaagaatattttagactgcttaaagcaattgttgtataaaaacttgtttctattttatttagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtaacttttcttcatatagtaaacattgccttgtgtactccagtttattgttattttgtaatataatatttaaattgtgaatttatagtaggtgatagctaacacttagagcattttgcatttttaaactcaaagatagcatgttattgattgcacttacattaaatctaaaaatataaacaaggccgtttcctgggattctgaagacctattttgtcacttattttgtttttttgtttgttttttggggtttattttgagacagggtgtcactgtgtctcccaggctggagtgtagtggcatgatctcggctcactgcaacctccacctcctgggttcaagcggttcttgtgcctcagccacccaagtagctgaaactatagacgcctaccaccacgcctggctaatttttgtatttttggtagagacggggtttcttcatgttggccaagctggttatcacttaaatactttgactactctgtacattgagtaatacacataattattatatttatacgtagttaaaatgtgtaacttgccagatactttggcccacacctgtaatcccagctactctggaggctgaggcggtaggattgcttgaggccaggagttcaggactagcctgggtgacatagtaagactctttctttttttttttttttttgagatgcagtttcacttttgttgcccaggctggattgcaatggcacaatctcggctcactgcaacctctgcctcccaggttcaagcgattcttctgcttcagtctcccaagtagctgggattacaggcatgtgccaccacgcctggctaattttatattttgagtagagacagtgtttcaccatgttggtcaggctagtctcaaactcatgaccttaggtgattcccccctgcctcggccttctaaagtgctgggattacaggcatgaggcactacacttggccaagactctgtctctttaccaaaaaaaaaaaaagaaaaaaagtagtaactggatttttattgaatttctgattatctattgaagtatattcagtaactactagattcagtaaaagatgactcttttcattatggaaggcccactacaagtggccacaaatgaaatacttctttttttttttttttttactttataaataataattgtacatttcatggggtacatagtgatgtttctacacatataatttattgcaatcaggttagcatatctgtcatctcagacatttattatttcttcgtgttaggaacattcactgtctaccatctagctatttgaaactatgtaatattgttaactgtgctcatcctatggtagcgtagaacacagccctgtacagtagcgtagaacacagtcctgtacagtagcgtagaacacagtcctgtacagtagcgtagaacacagtcctgtacagtagcgtagaacacagtcctgtacagtagcgtagaacacagtcttatacagtagtgtagaacacagtcctatacagtagtgtagaacactagaacttattcctcctatctagctgtaattttatattctttaacaaatctctctttatctcttctttccctctgtgtttcctagcctctagtatttactttttacttctgttagtaaaaagtaaatttttcttttttttcttcttttttttttttttttttttgagataagagtcttcctgtcgcccaggctagagtgcagtggcgcaatcttggctcctgcaacctccacctcctaggttcaagcaattctcatgtctcagcctcccgggtagctgggattacaggcacgccccaccgcgtccggctaatttttgtatttttagtagagatgggatttcaccatgttggccaggctggtctcgatctcctgacctcaggtgatctgcctgccttggcctcccaaagttttgggattacaggcatgagccactgcgcctggccaacaaaacatttcttaatgtataagttttaatacctgaaaaaaaattgcttgatgtatggaatgagttctgatttttcacagctagtgtattaattcttctcttcctaaagttaacattatctcactgcagataccaaaatatagatcattatcaggaacttcgtcaaatgttttatgtcccctaaaagattccttaatgcacatattaaggaatatctttattatctttatatttctaaaagttctattagacattcagaaaatggtaaaatatataaaagcttcatattatctctgtgaccttggttaagtcattaaatttttgtaccattttcttctgtaagataaagatatggttctactttgtggcattgttgtgaaaattgaatattagtatataggaaatgcccagcatatctccctgagaggcagaagaccttttataactttctctccagtttcatatatgcccatttataaaaatagggataattatctggacgagaaatgatgtttcactgtcttttatttcttaagtttacataagtctctgtttcatacattgatcctagactattgaaacaccatcttgaaaaataaggagtgaacttgggtccataatcttccatctctttttcccctttgagctctattaagaggcagagggcatgcatactaacctttccttacttgctttcttttccttactttgctttatgtaggcaaagtcctgattttattagcagagagagggaatttcagagaaaaatattaatttttgaaataagttttactgcaaatactagtaaacctaacaaatacagctgtaagtggtaaggaatacttgtaataaaaatgttcttagtttctgtcttgacattatttcttgctagtcttccagagttctttgcatctaaatctaggaaaagcttatttctctgttcaaagacttaaatgcaatgatccccatgttttatttattatataataccactgtaagtaactttaagctagtattctgacttttaactccaagtggaaaatacatttctttttaaaaatatttaaaggtgctttagccttttctgttgttactgtagaaaagacgtcttgtttttgttttcgtttttctcccaaaatatggcccaacttctaattcaggctttattacactctataaaaagttgctttatctggagagaaagaggtatcaacatggtgttgttagaaggttctcaactctcactgatcattagtatcactagtttagctttataaagcatcataaatgaaaagtatcagtattcctttgctatgttcagtctcatttcccatgagatagttacttctataactctaaataatatgtttatattgctagtattggacatgacttactgactcaccactctgaaagatgaagatttgttaaattcactcaattatccatccagtttttaattctgtaccaattctttggtcgaatttgtatacatatacacataagcaaatacacatacatatatataagttctatttcttgttctttcctgtgagtgactgtgtctactgaagccccgctgtataagatttggcaactgtgtgtttacctttattttgttaagactgttaacagttacatcatactatatatatttaagtcttcatgtttttttattctgtaaattaagcataatgttgatgtgaaataagtgggtttttttaggactctgtagtcgttggacactgtgagtcagtagtatgccagaattaatttttgctccctattgatagaatatcatactctttgtgctgtttaaaggaagatgatgctatttggactgtgtctttcttatatagctctttgtttttgtctcaagtttctaattgcctttcttttatgttttcgggagcagaaacttgtgcctttatgataatatgaggatctagtttcattttattcataaataaatttttattggagccaatgaatttttctgatctaatttgtaccatttgcttcctgagcctgctacaagactgtcataccactgttgtcattatgcttcccatttaggtctaatatgtttgggtgttcttgactcttgctgtgttggagagagataaattgatttcttgcttgtgtgatagtatacttattttgctctcacacttgattgatagttcaggtaggtttaggttcaaactcatttttcttcattatcaaggtaccaatgagaaatttgataccagtctgaatcttattcctttgtagatggccatttttcctctttggaagcttttgaatgttttggtatgcatattttcctcattcatcatgctgaatatttactgtacccttttgatctggaaatttatttattcagcttttttctgttatattacttctttgatgattttcccctttagttttttctgttctttctttctagaccttcttaaagtcatagtttatatcttcttcctttatctgtactcctcaagataaatgctagaagttggttaagccaggacttaaacccagcttgtagctttataagctgggttttgaacctcagttttctagttagtaaagtgatcatgagaataacgacctcaaaggatatcatgaggattaaattagatttttttaaagtccttagcactatgcccagtacatacagcattcaataatgttaggaattgttgctgtcatgttcactattaatttatttaacaaatatttattgaatgctaatacaaatgtgccatgctcttctaggtgacccccagtaaggtagaggactaagaagacatgagatttatgtgaaaaagcatttttaaagaagaccattggcaatcacaaaataggcctttagtacactaaaccctaatgactctgcctgttctgagtctagccttagtttcagttctgagccttatgaactgctgttgtgtgagtcacaaggtcaactaccataatttaatcacttgctatcattttagctgaagacactataaccttggcttccccagagtattttactacaggttaatcttaaacttgatagtagcaaattgtccctagtgtccctaacctcccccttacttcaacactgccactgacattggcctgtcaatttaagcacttttaatgcccagctcttttttttttttttttttaagacgaaatctcactctgtcacctaggctggagtgcagtggcacgatcttggctcactgcaacctccgcctccctgattcaagagattctcatgcctcagcctcccaagcagctaggactatgagtatctgccacagcgcccagctaatttctgtatttttagtagagacggggtttcaccatgttggccaggctggtctcgaactcctgacttcaagtgatccacctgcctcagcctcccaaagtactgggattacaggcgtgacccgccgtgcctggccccaactcttatttcataagttcatttattaggaagtaatggaggaaatagtagcatcaccatctattttattctttttcccaccttggacctggtaggtcctgcaggtcctcactagggaaaactgaaaaatagaattaaatctcatctttatgggagttgtggtacccagctgtgaatggagttcaggctttctgcagtgctttctcctgttcctgttgtcagaaatcggagggagagagcagcttgtctttagtgtgccttttctgagggatgctacatcataagcaggggcttcctttcttcccaatcagtccatcactattaaggttgccacataagaacaaaagcttatttcttattttttaagttgcttctcagtaaaggaaaatacattttagcaagaacagaaccttccacatactcactactaagattcattcccatatttcctaagaaacaataatcaagcagaacttttaaagtaatagtatcagagtggggaacgtctctctgtatgaccaaactccagaatctgtaatagaaaatatctacaaatcggactgcatggaaatcaaaattttctacatggcaaaacgttacagttgacccttgaacaattcagggattggcgtacccacccactacgtgcagtcaaaaatatatatataacttttgactgcccgaaaactttactgattgcctgtctattgacctgaagccttactgataacataaacagtcaagtaacaaatattttgtatgttatatgtattatatactatgttaagttagagaaaacatgttattaagaaaatcataatgaagtggaagggaattcttgtataagtggacccatgcagttcacacccatattcaagggtcaactgagtaaaaaatgttaaaaagacaagtgtcaagttcagaaaattatatgcagcccaacaactgacaaagcactatcatttttaatatagaaaaggtcctacaaataagaaaaatcacagaaaaggaaatacaaatggtttataaacttgaacaaaatgtttaatctcactcatagtaagagaaatcaaattaaaaccagtgatacaccatttaaaaaaactagacatgaaaaagcaaaaagttgaattaaacacttaaattggtgatgatggtagcatacattggtataacatctcacaagggcagtaagttaaaaatttatatattctaggaatttcttttatataaatgagtgtatatgtattaaatgaggtataggtataaggctattcaatgcagcattgtttataataacaaaagattagaaaagccttaagtaccctccaactaagagttggttgtagtgtatccctacatagatttatgaatactagggaattcttggaatattatgtagctaacaaaaaaaatacctagtatagattgagcatcccaaatctggaaatagaaaattctccaaaatcctaaagtttttgagtaacatgatgctcaaaggaaatgctaattagagcatttttggatttgagatgcccaactggtaagtataatagaaatattccaaaatccaaaaacacttctagtcacaatcattttgaataagggatactcaacctgtgcctatttgtgttctgcaagatcgattttttttttttttttttttggaaaggagtccattgcccaggctggaatgcagtggtatgatctcagctcactgcagccttggcctcctgggctcaagtgattctcccagctcaacctcccaagtagctgggactacaggtatgcaccaccacacctggctagtttttgtatttttttgtagagatgggattttggggtttgggttttcatcatgttgcccaggctggtattgaactcctgagctcaagtgatccacctgcctcggcttccctaagtattggcattacaggcatgtgccaccacacctggcccccaggatcaatttttaagtgaaaaaaagttgcaggacaacatacactataataatatgctacaatttatatttaaaatgtacatataagtatgcacatatgtccttgtatttttatagaatagctctagaagtatacctaagaaaattataacagtggtagctctggcaaagagccacgtgaaaagagataaattatatactttttgtacctcttgagttttatccctgtaacactcttactgtgcatttatgtttataatgctcaggtatacagtttcttagtacagattgctatggagaacaccatcatttggtgttcagattccaaactaagaagtttttctccgtcataacttcctcttatttcaaaatgacagtatatttcttattattttggctgctgtgaagctgaaagccacatcagtgtccaaagtaatagcttcttatattctgggtttgttttctgggcatcattgctgcttttcttatttcctttactatactttttattcttatattaattttgagttttgttatatgtgtatcttttacctatcattatattcttagactataaatatgaagaaagcctttggtgaagtgtaagtattcttttaaggatgattaccagtttatttagaaaaaaagttctttttaatactctaattttaatgactgtaatattctaagtcctacctttaaaaattgaaatcaatgtaaattttttgagtaattcattattagcactttaggtagagaagtttgcaataacaactgatgtaagtattgctcttctgcagtctttattagcattgtttaaacgtacctttttttaaaaaaaaaaaaataggtcattgcttcttgctgatcttgacaaagaagaaaaggaaaaagactggtattacgctcaacttcagaatctcactaaaagaatagatagtcttcctttaactgaaaatgtaagtaacttggcagtacaacttatttgaaactttaataacttgatattttaaagtacctaggtaatccattaaaattcaggataactgaatttatagttatttgtaaattgcaatatgttttacccaactttaggcctgaatatataatagttaatgaatttttgttggtaaagatgataaaactttattgtgctcaaatgttttatttaaagctcttatttagaaaatctataaagtttgaattctagaggacctcagggttcaactaggcaactagttttttaactccgtgtattgaattgccaaacatactctatagaaatatttatcaccatctgcctattttttgtactgtgttgcaggaatcatgccaaatagtttttgcaataaaaatatctctgaaaatattctagatataaatgccaatagctatagcacggatattagcatttttgcaagcactaaagctggtttgttttgtccaccagtattcacaataaattaacagtatgcagttgaataacattctgatttactacaaagggttatttttcttggcctctgctgaaccagtaaaacatatactgaaaagatcgaacctgcatataatgaatgtgttggagtaaagaaaaaacatgcaagtcaatagtttagattacagaagtttgttcaccgatttatgacagcaggtcctaaactgccaacatctctaaccatctgattaggtttccatgagccaagtcttagatattccatgaatcataaccttttagtcagtgtaacacagggatttcaactttttgttaagaaatgactcaacatggtggaggcttatgcctgtaaccccagcactttgggaggctgagaaaggtggatcacttaaggccaggagttcgagaccagcctggtcaacatggtgaaactctgtctctactaaagtaaatacaaaaattagccagacatggtggtgcatgcctgtaatctcagctacttgggaggctgaggcaggaaaagcacttgaacctgggaggcagaggttgcaatgatccaagttcatgccactgcactccatccagcctgggtgacagagcaagactccatctcaaaacaaaaagaaaaaataaaaaaaaaaataaatgactcactagaggaatctttaagtgtccatttaactgtcttgtttagctaattaaaatacactaggatttgtctggtttcctcatctggatgttgctagcaatggtaacatttttcattttagaaattttgcaaaccattgcatttatagatatgaattctgatatggctgctttaaaattatccaatttaaattgtccaattaaaatcattcatttaacttgaaatgtatgacttaaggaaatttttcaatttaacttgaagtgatttatttttcttagattgttcagaatgatggcatttcagaaacattggattacctgtgatttttgttttggtaaatgtttaaaaacaataaaaaaggaaaacatttacgtgtgcattttctttatacacacacacacacgaaaaaaaaacaagtaagaaacccagaatggtccttaggcatatgagaacagaagttctgattgagtaatggctatggaaatttcccctaatatatttagaaaagctgttctctcatgcagtggatataatataccatggtatctaatttttctttctgatgaaggaagcaactacagaaagcttttatttatttgttcaaagtgaccagtgcaattaatgcaaaagaaaatccacagcaactctcccaatactactttcaaaacaaacataccaaacttgattttcattaaaatgtagttatttcttcacactagtaaatcaaaaaccaagacccatataaaacagggcgaacaattactgtgcttcatcttctggacaagaatgccaagttagtttctcttttataagcaattacattttgaggacccttcatatttgcctcttttgccagcagcaactctgcctaatctgaatccttccatttcatgagaaacagcagttctccactgctgtctgtggcaccaattactccttcaggatcaagacatctggcaaagccttttagtttgtcagcagcatcccttctcttctttgatttactgtcatcagattcactgtcagataaagattttctgtttgtgccatctttttcttgactagttttttgagaattaagaaatgcttcaattaaccctgaaccatctaaattttctttaggttcccaagtgttgtcaacatctgtaaatcccttccgcttaaggaaatatcccactttcctattcactacacgtcagtctagtacattttccatcacagattcttccggctctgcctcttcatcttttttactctttccattctgtttgtttcctattttttgcaatgtagttttattggaggccattttttattgcagacttgaggagctgatattcaccacctccaagctgctctgggttataggtctgcagtgttctgtaaaaaaaaaattctaatcctgtcagcctctccctctccatgtcaatgattttattcatgggatggcacatataagaatatttctcaaatacatttatagtggctgcgtcagcagcacatatcctaaaactggaatgaggcagaggagtttagcatggcccttgctcaaggatgacatggaaattgatgaagtattctatatttaaaaaaaaaaaaaaagaaaattatataatctcaaacaagactacatattttagctattatccataaatatttcacgtaacttattttttttttttttgagatggagtctcgctctgtcgcccaggctggaatgcagtggcgcaatctcagctcactgcaacctctgactcccaggttcaagcgattctcctgcctcagcctcccaagtagctgggactacagcatgccaccatgtccagctaattttttgtacttttagtagagacaaggttttgatgtgttagccaggatgttcttgatatcctgacctcgtgatccacccaccttggtctcccaaagtgttgggattacaggtgtgagccactgcgcccagccacatgtaattttttaaaagaaaatagactaattaaaatataacgtactctcttagcttagatttttcattttctactactactttgagagaccaaaatagacaaaaaggtaaaaactgaaagagagaaaaccgttttgaaaacatgtagctagccaggtttcctgagtggacgttggctgacaggaggtggaactggaagcttaagtgctcattctcctagaataatcattcagggttttgagagagaaaggatccctttttctgagagggcccttaacatgttaacacttaacagtgctcctgggaattaaggagcacagataatgagagaacagttattgttagcctgtgaggattaggaattttgggggatttgttgggactataacttatgaagaaaaataccaaagtgtagttttgcttaccgttaattttggtcattagagaatatacaaaaatccagaatcccactgtctacatgaagtcaggttcaggaaagagcttaaatgtacatgacaactcaagagtatttggttactatctgaaacaaagatcagttgtcaagttaattattctctactaatttattaagtagatcacatttatttaatatgatatataagacattatcaggcaccattggcaacatcagcaaatttaaactctgcttgtattttataagtattttttattttcacaaattttgcatttatgttgggaagccaagctaatgaacactttatgtggaaatacctacttatcaaaacattactgaaaacatcagatctaaaccacattattgcaacatactgtgtcatgttcaattttttttttttgcagagagggtttgggaagtggaggactaataagtggagttacaactggctcagtaggaataagaaataacatgcagactatttcatctctattgcaacccataatttgggtatgcctaagggaatgcattctgcatatgaatgtcatctgtatgttgcaaagggaaaagggtgagaactaatctaactacaactgacaacacaatttggagttcttggaccagaatgccattctgagtcagatatatgtcatatacagttttctaagggcacacagaaaatctataacattgcctgattcccttcatggcccattataagtctgttacctatcattttatttaatcagcttttattgccttttgggcatgggtttatatgtttcattaccttgtccttttaaaatcctgttgcatgcttggcagttatcacagtccttggaattttaattaaagggttaataaatttttgaatgagttattacccattctgaagaagtacctctttttgtttcaactttgctttacttttgaatttttaccaaagtctgtgttgactttatctactctatttatgattatctttcttacatgtaggctttttcttgtcccatattcctcatttgattaatgaaaaagttctctcaacttaatctgtatgtatatggtaatccttaccttaagttgaagtatgagcttaagaatgatggacttgtttcttgatatttctatgttgtccacgttaatatgctagtatttaataattaaaagtagtgcctcttcagtagagaagagtcataaggcaactgaatttaacctcactctaactggaccaattatatattttaagtgaaataggccaatctaattaaagccacttgtgactttggcaaataagtgtttgaattccacgtcacatcagggatccagattgagtctgacacctataatcaaatttaaacactccttggagtaaaaaataattttctcatgcaccatgactgacgtatttgcttattcattttctttattggttcttatatgcttttttgcttttactgattaacgtaaatacaagatattgatacttttttattatttgtggttttagttttccttacaaacagatatgaccagaaggcaattggaatatgaagcaaggcaaatcagagttgcgatggaagaacaactaggtacctgccaggatatggaaaaacgagcacaggtaagttacttgtttctaagtgataaaacagcgaagagctattaggaataaaatgaattacagctctgttaatattgattaaattttattaaagacataaggctgtgtttattttggctctatttcaaaataagatttatcatggctgctgagcaacataatcaatattcacatagttgtgtctttaccatattcatttcccctggtactgttctgttctgccttggaattataagggagagacagagttagatggtggtcttccggtagctaatgactagcttcagttctcctttgaaatttttacttcttgtaatcttagactgtataaaggcattcagaacatgtcactgctcttcaaattgtgcacttaaaaaaccctcattcaaggataataggaaggaaacaaagagaattttaggagagatgaagtaagttgtatggagaacattcccatatttctaccctcaatgtcaagaaagagtattagctagctttgctattaagtatttttatatattattgaatatagcctttttatattcaaacaagtttatgactgactaatgttttaaagccctgaagaggccttgccaattgccttatctgtttcaaaactagcgtgggttgttgttttcttttttaacttttgggacaaattgggaggaaaacatttaaagattttctttaagtaaatatagcaaataaaagcagagaccaacatttacatggtagtgatacacatacattttgtattctataaaacatattaaatagttttaaaatggctactgtaggatattttacattccttgaagtatagtctttattttttttgtgacacttcctaaacataatgatttttttttttttttcttgagtctcaccctgttgcccaggctgaagtgcaatggcatgatctcacctgcaacttccgcctcctgggctcaagcaatgctcctgcctcagccacctgagtagctgggattacaggcgtgcgccaccatgcccagctagtttttgtttcgccatgtttgccaggctggtcttgaactgctgacctcaagtgatccaccggcctcagcctcccaaagtgctaggatttagagtcatcatgcccagtgtattagtttgttttcaggcttctgataaatacatacccgagactgggcagtttacaaaagaaagaggtttaagggacttaacagttctacgtggctggggaatcctcacaatcatggtggaaggcaaggaggaacaagtcatgtcttacatgggtggcagcaggcaaagagagagagactgacagggaaactcccatttttaaaaccatcagatctcgtgagaattatttactatcacaagaacagcacaggagagacccacccccataatttaattatctcccactgggtccctcccacaacacatgggagctgcaagatgagatttgggtggggacacagccaaaccatatcacccagcctaaacataatgtatattctatctgttttggagtatggtggaaggctaaggtgctactaaaacaccagtaccatactacatttcatagtccatacatgttagtttcatagtgaaggttaagatcataatgaggttgggggcttaactagtgtttgtgtgcatgtgcatgtatgtgtacatgttagttataatacgtgtatatatcattttttcttaccttccctcttgcccctatcccagtcagaaagattcgtgacttaaatgtcaaaagtaaaactttaaacctttcagtagaaaatatacataagtatgtttctgatattagagtaggaaagtatttcttaagaaagacttaaaacgctaatgataaaagaccaataagtttactgtattaaaattaagaatttatcttcaacaggtacctgaaagaaagtgaaaagataacttacaaattgggagaagatatttattaccatataactggcaaagaactaaaatcaagaatatataaataacttctaaaaatacattgcattttacatttagatttaaattttagattttcatggaattattttaaaatgttaggtttatttgtttcaaaaaaacaagtattactttggtttatatgaatttgcatttttagaacatgaatatatgggatactgtagacataagttagtttttctgtgtctgttaatgtgagcttttttttagagagagagatcctaaaagaacaagatgtgatggtagttgtaaaaattcttgtgctatataaatataagtaggtgtattccagacattttatatccctgaggagaggttaacttgagttctttcttggccattttgttcacataagcgctgatactgtcattcttactttattctggaatgccgtatccttcattttggtagttaatattctaaggaaattttattctgtattttgagaaacatacgtgttcatttattctggaaatagttatatgaaggttaaggttaaagaaattgtaaacaagataaaaaggcaaataatggaaatgttggtagaatatataagagatttaatatccctactctacaaggatcacctacaaatcaattgaaaatggtcaaccatgccaggcatggtgattcacacctgtaattctagcactttgagaggctgaggcagaaggatcacttgagcccaggagttcgagaccagcctgagcaagatagcaagaccctgcctctaccaaaaaaaaaaaaaaaaaagctgagtatgatggtgcacatctgtagacctagttacttgggaggctgaggctgaggaggatcccttgagcccaggagttcaaggctgcagtgagctacaatctcaccactgcactcaaaaaaaaaaaaaaaaaaagagaaagaaaggaaagaaaagaaaagaaagaaaacagataaccaaatagcaaaatagtcagaagatgtgaatagttccatcagaaaattaagttcaagtgtctaataaacaattgtgaaaagatgcttaaacatcactacacatcagggaaatgtaatataaagtaaggtactattttttttttgcctatcagctgcccgaaactttataatttttgatgacatgcagtattagcaagggtgtgaaagtaaaaacatcatctacctttaaatcttttttgtttgctttgttttttctttttgagacacagtcttgctctgtcacacaggctggagtgcagtggtttgatttcgccttactgcaacccccacctcctggcttcaagcgattctcatgcctgagcctcctgagtagctgggactatagttgtgtgccaccacgcccagctaatttttgtatttttagtagaaacagggtttcaccatattggtcaggctggtcttgaactcttggcctcaagtgatctgcctgccttgacctcccaaagtgctgggattacaggcatgagccactgcacccagccaacattgtctgccctgttcttttaagaataaattgatacatttttggaggacaatttggcattatttgccaaaattaaaatgcctgtgctctatgaccgtgtgtttctataggacttctaggaatatgttgcgtacagaaatacttactttagggcagaatgtagatacatattttaaattattaaatgaatagtatgcaagctattataaaataccatactgagaatagtgggaatatggtagccaaagcactcctttccctcctaactccctgcttgggtgattcagcaagtgaaacaagaacggccctggaagaggagatctcaggagggtctgaggctatgagaaaaaatatgggatctcatttgcaaggggaaggagtaaataagaattccaaataaaataagaatagaatgaaagtttttaaacataagtattaccacaaaccagaagcaaaccttatattaagaaaatagtgactgagtgaaatagctcaggcctgtaatcccagcactttgggaggctgacgcaagaggatcacaagttagcagtagtgttggcacacaactgtaatcccagctgccttaaggaatgctgaggtggtaggattgcttgagcttaggaattagaggttgcagtgagctatgatcatgccactgcactccaacctgggtgaccgagcaagaccctgtcttgaaaaagaaaacagaaataatgaggtaatcattgttgctatcattaatatgtttgagtagcttgccgtcatcactattatttaactttgtttgacaggcttgactaatgcaagtagaaaaaacaaaataagtgttatgaatcctacactatttttgaactagaaaggaagagattaaataattatttgtaaatgatgtggtggtttgcctagaaaagctatacaaaatgaactaaaaagtatttaaactagtaagagaatttagtaaggtaactcaagttaagatacatacaaaaatcagcaataactaccagttaaaggtggaaatgggggtaggaggacctgttcacagtaacaggaaactttaaagtaactagaaaaagcctgcataaagaaaaacataaaattgttgaaggacactaaattttttggaacctagaaaaatgattataaagtttataatgcaagaatttccaaaaacatttatgaaagaacgcataattgaagatttaccttaccatttgttaaaatctattgtgaagatgttgtaataatcacagtatgataatagcacaggaataaatttaggcaaatgatagagactagaaagaggtacaggaatatttacaacctttatatgacagaagttacattataaattttggagaaattgataaattactcaataaattatataggtacaaccaatgacctgttcagaagatgagaaattaaacccttacctcacatcttaagaaaagttataggttgattagctattcaaatgtgaaaaataaatctaaaattaatagaataaaatacaggcaagagatcttcttaaatatgaatggaaactcaaaagcaataaagaggaaggaaagttgggatttatctcataacattttaaatcattcattgcacaaaagataaattagaaaaatacttataacacataaaggggaaaatggtaatatctctaaaatataagaattcctacaaatgaataagaaaaagacaaccctgtgtttttgttttgttcagagagggggttttgctggttgcccaggctgtagtgcagtggccattcacaggagcaatcataatacactacagcctcaaacggctctagcaaccctccttcctcagcctcccacatagttgggactttaggcgtgtacatcgcacctgcctaacccatgttttttaatggacagaggatgtaataaggcagttcattaaaaagatggcaaatgaccagtaaaacacagatgactagtaaataatttaggaaaactcaaaatccacttgtgcctacctatgtgagattgttagtctccaggtacctcttaactgcatggttatttatttactcttacttgttcagtgtgtatttggtcacctagtatggtggtacttacccttccataggcatgtaagcaaaggttggaaaagtgcacatcagtttgttaatagagcttactactgggatgtgggaattggtggggtgaaggtgtaagtacacctctatattgccataattgatgatactgtttaatgtagtttatctcctccctagttgatggacacttaagttgattctaatttttcagttaaaaacagcacatgtaccctaaaacttaaagtattaaaaaagaaaacagctctgataaacatacttattcatgtcttgtaaacaaacatgcaagagtttctctaggtgaggagtcagcaatctttttcttagaaggccacatagtaaatatttaggttttgtggaccatatggtctcttttgcaactactcaaccctgcctttttctttttctttttttttttttttttttgagtcagagtcttactctgtcacctaggctggagtacagtcatgcaattttgtctcactgcaacctccgcctctaaggttcaaacgattcttgtgcctcaggctcccaagtagctggaattacaggcatgtgccaccacgcctggctaatttttgtatttttagtagagacggggtttcactatgttgcccagtctggcctcgaactcctgacctcaggtgatccacctgcctcagcctcccaaaatgttgagattacaggcgtgagccaccactctcggcctcaaccgtgccttttaacaagaaagcaaccatagataatttatgaacacaaatgggcatggctgtgtttcagtaaaacttaatttataaaaacagatggcttagtaggccctagtttgctgactgttgccctagcatatatatctaaaagcataattactggtcataaggtatgagtgttttgaatgagtgtttgccaaattgctcttaaagtaatctttttagtttacattcctaatagtagtatgtgacaattcttgtttctgtatgtcttctccatcacttgtgagtcagaatttatcattaacaatcagtgggtagtgaaacattttgtcatcttaaactttgtattttcctgagctactgaagttgaatctcgaaaatatttattagattttggggttttctttctaagttacttcctcatatcccttgctcattccctactgttaaatgtcttgttttcatttgtttgagagatgttttaatatcctcttgataccaatcctttgtagataatatacatctcaattcctccccaccaaatctgttatctgtattagcctcataacaaaaataaacttttatgatagagctaaattagttatattgccagatttatacatcttttcctgtactgaagtcgtaaaggtaatcttctattagctccttaattcatcttgagtttgctattatgtatgttgtggaggcaggaatctaacttatatgtatattacttatatatgtgtgtatgtgtattatacatgcacatgatttatacatgtgtgtatatatagttatgtatagtcatacatacatatatttatgttgttaactgaatttctcattatcatgtattggataccgcactagttcctcatcgatgagtaatgtcatctcttatcacataacaagtttatatatgctggatatttctggactttcttctgttagtccactttagcttctccatgcctgcactgataccacattttttatttgctgcagttttataaatcttgatatccagttgggtgaatcgttctttgtttttaaaaatgtagtattctgccttattactcttgtcatgtaaactttaatgtcagcttctaattcagataaaagcttcatgggcttttgattagaattacattaaatttatagattaaggagaagtcagaccttcataatatttagtcttggttgaaaggatggactctggaaccagaccttctatattcaaatcccagacctgccacttagcaacaccatgatcctaggtaaattctctgcctcagttttcttgtcagtacaatacagatagtgataaactgtaaaatgtgaggattaaatgagttgatatatgtaaaagcactcagaacctggcacatagtaagcaaattattaggtattcttactaattttatatctctctattcatttaggctttattttatatccttcaataaggttttgtcaaattcttcacaggggtcttacatatcatttaaaaaagttattcctagatatgttacagtttttgttgctattataagtgagaatttctttaattatattactaaattacatttaagtgaaaagtatccagcagtcttcctgaaatattttattatatcatcgccggtttaagattctatacactgtcatattgttcgcaaataatgacagtttgtttatcctttccagtccttacagcgttttttcttttgttgtattgtgtaagaactctaatacatctttgaatggaaacaatgatagtggtcttctttttcttgtcttgactttaaagggaattcttctaaaatttcacagttaagtgtgttgtttacacagttaagtgtaccctttatcaagttaagggatttaccttctattctaatttgtggagagttatcctgaatctgtattactactgcagtttttaaaaatcacttttttctaaagtcatatcaagtccatactcctgaacagtttgttattaaatataacttcacaaatattcttgtcatatagaaaaaggaaagaaatacttagtggttaagcatcctaatccaaaaatccaaattgtgaagtgctgcagtgagcatttcctttgagcaccatgtgggtgctccaaaagtttcctgttttggagcattttgggttttggatttttgtattaggtatagggattaggaatactcaaggtgtagtggcttcttctattttcatattagaaacagaagcacaaggaatgtcatgtcagaaaccatccacctcactggacatcaagacatagacatgacctcagtatttagtgagatactggcaatatggaaatgtagtgtaaaacggagaggagtgggagatataatttcctattttcatcctctaaatattaaaaatttttatttaggcctatattgatggaagggagctaattatatagaaactgattatatagaaaaggaggaaacaatcaaatttagaaatccagtaattttatgtagcttggctatttctctaaagctaggaagtacttgccacctggttatggaaatgatcactcatctttgcaatatctttagaaaactagcaaaagtacaggtacttcttcagatggttttcatactgtgaattggacatggtaagatttgttacttaaagaatatttttttttttttctatttttttgagacagtctggctctgtctcccaggctggagggcagtggcacgatatcgctcactgcaacctccgcctcccaggctcaagccatcctccctcctcagcttcccaagtcactgggactacaggcgtatgccctcatgcctggctaatttttgtattttttgtagagacggggtttcaccatgttccctaggctggtctcaaactcctgagcttaagcagtctgcccaccttggcctcccagtgtgccgggattacaggcctgagccacggtgcctggcctgagaatatttttttaccttaagtttactactttcagaatcatgatagagactcagcttagttatattgttaaaaagaaagaaaagagggagaaaattaagatagattaatttgggactgtgagcacagcttcttgttttatttgggttttttttggggggtgggggttgtttttgtttttgttttgagacggagtctcactctcgcccaggctggagtgctgtagcatgatctcagctcactgcaacctctgcctcctgggttcgagcgattctcctgccttagcctcccgagtagctgggattacaggcacgcgtcacccatgcctggctaatttctttttgtatttttagtagagacggggtttcactgtgttggccagagtggtctcaatcttctgacctagtgatccatctgcctcggcctcctgaagtgctgggattgcaggcgtgagccaccgtgcccggcagcgaacacaacttgagttttctgttctttgtttatcataagactggatgatagcagtaaacatttttactatggtagtaagaaaagcatgaaggcattgtatttaagtaaaactagatgtgatcaaagagtaagttttataactgcatgtatttaaagctaattgccatagtacttttattatttatctgttgggggtgatatttgttccgaaatattttattgatggagaacataactgaaaaatgtttggaaatactccatctagcttctaacacacacacaccccttattgaaacagtttacttttataatataatttttgatttctcaatattaggatgtcaataactatagaattattacagaaaatggtacaacattgtcagtacttgtttttaaaacatatgtgtttgatttgtcataaactagctttatgagacatttgcaaagtctttattcataagtgagttgttttttccacttccactagtattcataaaagttaaaatgaagtctagcttaaaaaacacacacacacacacacaatatattccccacattgtttccattccatgtggttcaatctgtagttactgctttgtgaccagttgatggtctccatatagtggaaaagcaaaagctctatcctctttatgatcctagtgttggagaaaaaataatgtttagccacagttaggtacttggaaaggctgaaaaatactactaacttatgacagaagtaactttggggaagagttgggcctactgtttaaaccaggggtccccagcccccaggccacgagcaagcattaccacctgagccctgcctcctgccaccatcagtggctgcattaggagcatgaacccgcttgtgaactgcacatgtgagggatctaggttgcgggctccttatgagaatcttatctaatgcctgaggacctgaggtggagcagttttatcctgagacttcccctgccccagtcagtagacaaatttcttccacgaaaccagtccctggtgccaaaaaggttggggaccctgatatttattaaaacaaatcagatgttctttccctttactggtatactatgtttatataaatttattatattgtattaatgtctcgattaatataaaagattaaatgcaggtgtaattttctctttgttgaaatattttttgagaataaattttcacaatgtgtattgtgtcaattttcataattcatgcaacatacaatttgatatatgacttgtatttccagttttactaagcagatctagacatctgttgaataaagtccagtgtattacaaaaaattgaactgacccagggccgggcacagtggctcacgcctgtaagcccacagcactttgggaagccgaggcaggcggatcacaaggtcaggacttcgagaccagcctggccagtatggtgaaaccccatcgctactaaaaatacaaaaattagctgggcgtggtggtgcgcgcctgtagtcccagctactcgggagcctgaggcaaaagaatcacttgaacccggaaggcggaggttgcggtgagctgagattatgccactgcactccagccagggcaacagagcgagactctgtctcgaaaaaaaaagaaaaaaagaaaagaaaaattgaactgaccccaatttgttattaaagggtgaatatatttatatgtctagctttttaaatgagaatgatttgacataaccctgagcttttaagtggtagccatagtatgattatttctattaatattattaataaaaacataactaattaggtttcttgttttattttagcgaagaatagccagaattcagcaaatcgaaaaggacatacttcgtatacgacagcttttacagtcccaagcaacagaagcagaggttagtaaattgcctttcttgtttgtgggtataaaaataggtagttattctgagaaaagaaaacatgtataatttaatgtgacaccattgaaatatagatgttctttcagagaatttaaataccgtaatttttttcgtgaaattaaattatcaaagatttggactattttgattttatctaacttttaggcagttaaaatttataaaactgtaaatatagataccttactttagctgtcagtttacatataatcaaatagttaacttaatttggctactatccagtaagtaaacttttttatagataatccatagtaagaattgataatacacatttacctgtgtttactccagaaaccccattaaagtgatagtaaaaggatacaatgaaagaggcattaagaccagggaaggtgaccacagtaaaatccgtggagctggaaagcaggtaaacaagtgataacattctagcatatcagagagggttgacccataaggcagcaataggaatgaaaagtcatgaagcaactagatacctctgggtgtgagagtaaaaaagggttaaaagcaggaagatatttgaaaatctgttaagaagcagatggactttccagaacctccctacaaccctgtacagctaggtgactgctcctttccaatcccagcaaaagatgagagctttctcctctgaagaggtggagagggtaaacaaagggtctttggttaggggtcaaccttgtttaattgaacgtgagggtatcatacgaaacactgaattacatgaaaatttacctactgaatgctgaaacccccactggcatccaggcttataatctccaggcaagtttctggaaggaacttctataaggaatgtgactaaccctgattctgctgagagaacattaaaaagggagaaaaaaaatcagaagaatgtgactaacccaagaaaaaaaacttaaagagacttacatggaaaaattcacccaacaaaacaacccacctagatcaccctatagggtaatatagttgacaaaatccattcttcaggcatagagcttcatttaactttttcatagatagcccgctcttaaatatgagtggacactaactaccagacagtatagatcattctaggaaggttcaatatccaaataaaaggagttccaaaaagaaaatggagaaactggagacaggaaattagagaaataaatcaaaatttctcagaaattttaacaaggggcttagttttccaaaaaattggtctctccagtatctaacatcatgtataagaataatcctacactaagacacatcatgaggaaatttcaaatcactggggataaaaagaatattctaacaaccttctggagaaggaagagaaaacaaatttcacataaaggaacaggaatgcaaatgcctttacatttgtaaataacagcactggaaactgggaagtagggtaggcatttcttaaaacttttctttttttaagagacgtggaactaagtctcttaaaaaaaaaaaaaaggtaggatgatctagctgggttgttttgttggtgaatcctgccatgtaagtaagtctctttaaaaagtttctgtcacccaggctggagtgcagtggcgcaatctcggctcactgcaacctctgcttcctgggttcaagtgatcttcccacctcagcccccgagtagctcatgtgccaccatgcctgactaatttttgtattttttgtagagacgaggttttgccatgttgcccaggctggtctcgaactcctgagctcaagcaatctgcctgtcttggccttccaaagtgtgggattacaggcgtgagccactgcgcctgacccctgttaaaccttttaaaagaaaatatgtgcagctatgttttgaccccagttctttgacaccactgtatatcctccagttgggttcaattttgatcctaactacccagagttagagtcagctccacaagtaaaagacaaagtcagtcacaagactgtccacttcaaacgccagccacaagttttgggtgtccctaagccaccaggactgctgccaagctgtctataaattccaccccgtgtgcgtgtgctgtggtaccattccattctcacactaactacccagagttagcacagccccaacaggttaagagccgactccttcacaagactgctcccacctcagatgccagccacaaatgttgagtatctccaagccactcacatttctgcccagtgtgttacaaattccaggcttccacatccccttcacgttcagtaattcattagaatggctcacaactcactgaaagtgctatacttaggattaacagttttattataaggatacagatcaagaatggccaaatgaagagacatatggggcaaggcctaaggaaggggtgtaggaatggggatgggggtgcagagatttcatgctttctcctagtggaatctaggcatgtcactcttctagcacttcattgttttgtttttgtttttgtttgagacagagtctcgctctgtagcccaggctggagtgcagtggcgtgatcttggcacactgcaacctccgcctcctgggttcaagcgattctcctgcctcagcctccctagtagctgggattgtaggtgtctgccaccatgcctggctaatattttgtatttttagtagagatggggtttcaccatattggccaggctgggcttgaactcctgacctcatgatctgcccgcctcggcctcccaaagtgttaggattacaggcataagccaccgttcccagccttttccagcacttcagtgtattcaccaatcagaaagctgcactgagttttggtatccataatttttattgaaattttattctgtaggcatgattaattaaataattggccacatgaggattaaactcgatttccagcctccttctcttcctggaggtccgtctggcccaaagttctaactctcttatcacatggtgacagccacccatctttttgctatctggtggcctaccctgagttgcctcattagcataacacacacccctatcactcgagaaattccaagggtatttgaagctctctcaggtacaaatgaacaaagaccagctatattttttattataccattctagcctttaatcaaagtgttaaatttgagagtggaataaagacacttttagataggcaaagtgtcaaatacgtttttctcatgcacccttttctggaacctattaaaggatatactcaagtgaaatcgaaatgtaaagcaagaaaaatgaattttttcaactcaagacccaggggatataatacaagagaaagagatgagtgaaactacagagtaaagatgaagggacatcctgagataaatggtaaagaaagcaaccagtccatattgaaactattgagaggattccaggagagattaagtccaagaagatgaaatcagcagaatacctgcggtttctgaatgtattgaagggaaaggaaatttacacagtaggagagaagctgagcatcagtcatatgtacccagaaacccaaatgaacaaaaaataaagataacctttaactccatggacaacaggaagttgtaaaggaaggtgattatagtataccatctgccagctatgattagaatttcatagtcaaagtaatgtaaatagtggaaaatttgtgtaacaataaagtggaactgaaatgaagcattcaactgaaaaatgcagaactagccattgaagcaggttatttggagatcggagggggtgagtatccccccttccccaaaaactcagctgaaagagattagaaagaaagagttctttcaaaaaacattttcatccatgtctggcttttttaatatctgaggaactttggatttagtacatctgaatctgaaatatgtagaaacttatttgctaagtagacagtttaagtacaatgtgatagtcataatcctaaaagcagtttaacatgactgtcttaagcaaatataagtcaaatatttgcaatttaaagaatgtgttcatttttgcaatggactctttttttacctggcccttggaaagggccaggaaaaaaagcagtatttttttgctccttttcagttctgttggtattgatgtatgtagcattctacttattatgacctttttggctttctactgaagtttttatgtgtctttcatccttaagcaaatttgttttggtctattttttaaattatttttaaataggcagtgttttgtttttaattgaatagctttagttacagttagttctttcccccccatctttcttgtattctgattattactgttttgctgcatctaacaggttttgatatttctaaatcaatagtcacatttttttctagttgattgaatcttttatttatgtaatataaaatagccctctattttatttaatgctgttcaccttcaatttcattgtagtaccatttattaatagtaatcctcattttccagtactgttacaagtttcaggttggaaacttgtttgtgtttcttgtatctgttcaaaactttttattcatattattggatttagggcagactgtctgctactatgatccaacctcttattgcttccttttgttatgataatagttacatcagttgcattattctgatagtttgtaaatgtaagccaaaggaaggtgccatttcacatttaagaaagaacaaaaccactttttacaattttgccgtttgtggtttgtttattgcattattttattcttctaatgtaagttagagggagaagctagaagatggagaaaattggggattggacacttgcaaattagttcatagagcagtagatatgagaaagggaaaagcttctgccaaataatttctctatcatgaagcatatttcttatagcattttctttggctacctgtattataactctggtttaaggtctagatgctggacgtgatttaagtctactaattattacacatgattcaaaactcagaagttacataaaggtatgtgaggcaaccagtgctgtgactttcttgtgtgttcttccagacatagtttatttattaacaagcaagtacattgggtggaatgggagctgtgaggacaatgcagtgtgtcttaaaagataatagcaaatgaagaatacttactaaagtcacagtattcttgcaactcattaataaagataaatacaactcaccttttaagtgggcaaaagatttaaataggcatttcaccacagaaggtatatataggaatggcaaataagtacatgaaaatatgctcaatcattaaggaaatgcaaatcaaagcccaagtgagatactgcttcacacccattatgatggctttaatcataaaggcaataataagcattgacgaagatgtggagaagcaggatccctcattgctggtgggaatttaaatagtacagccaccattttaaaacagttgagtgattcctcaaaatattaaacatatagttatgtgactcagcaatcttactcctaggtatctggccaagagaaatgaaaatatatgtgtacacaaagacttagacttgtatgttcattcactagcagcattttttcataatagcctcaaaggagaagcagtgcaaatgtgtatcaactagtgaataaataaacaaaatttgttatatcccttcagtggaatattattcagcaattaaaagtaagttactgatgcagaatttataacatggatgaacctccagaacatgctaagtaaaataagccagagatataagtccatttatatcaaatgtccagaaaaggcaaaatttctaaagacaaaaagtacattagtggttgtctgactgtaagtggaaatgaggattaactgtaaatggacagcaggaattttattggaatgatgaaaatgttctaaaactggattacagctgtgcttgataaatctaaaagtcatttaattgaacacttaaaatggatggattttgtgatatttaaatacctcaccaaaattttttttcaagttctatcacctagagtagaaaaccttggagaagttgtaaagcaactatggaaatgaggaaactagttagaattaatctttcataatagtgaacaaccacttcttttgtcttcagtgtatcgaagcgtgcaggcaggcctgtagcctaggatcagtgaaagaataaaaaaaagtaattaggaaagaggagggaggaaagaaaatgaagatagtaaatgttaaatggtagtttgggttggaattgcctgggttggaattccagctctgactctgccatttactagatatgtgactgaaaacaagttacttatattctctgtgcctccatctctttatctataaaatggggataatggccgggcactgtggctcatgcctgtaatcccagcactttgggaaactgaggtgggcagatcacctgaggtcaggagttcaagaccaacctaaccaacatggtgaaaccctgtctctactaaaaatacaaaacataaccagcatggtggtgggcgcctgtaatcccagctacttgggaggctgaggcatgagaatcgtttgagccgagattgcgccattgcactccagcctgggtgacagggcgagactctgtctcaaaaaaaaaaaaaaaaaaaaaggcactttaatattactcaacatattcaaaacataattaatgatctgttcctcctaagccctctttactaccccaccttgcagcaaaaaaccttcatcctccctcagtattacctatctctgtgaggagtagcaccatcattattgaattgtgtgagctaaggaatgtaggagtaatactccacaccagacctcttcctccactccccatatcctgtcagcgaacccgatcagatttacctctatgtctccacttcttttatctctgtcactgcttccctagtgcatagtgccactgtctcacacttatattaatacattagcctcctaactggtctttcctatgtttcctccctacttagaccatttaaaatttgacttaaaaaataaaatttacttgcaactttatccattaatatattagtattaattatgtgggggcaatcatgcagtggcctcactgtaacttgcaagtagaaaaggcaagaatgccatctaagaatcgcagaaaaaggcattaaaatttaaatttttttatcatattctttttgttctactttcctccttatttttggtgcttcatccacaccatgattcgttgacacgctaaaacaagccacactccctcctaccctgggtcctctgcatgtgatctgttttacccagaacactcatcctctactcctcccctttgcctagttaactcctatttactcttcaagtctttactcaaacagcacttcccaagagagctcttccaaacctccagagtatatcatatctctctgttatatatatttacagcaccttgtacccttctttcatggcatttgtcaattttacctttattatttctgtcattatttgacagtgtccctgactaaactgtaaggtccaagagagcatagaacaatgtctagttttgctagcactgtattccccagcatctattgcaagtaactaacatagtagatggtcagtaattttctttaaatatgttgacatcttcacttacgttagtgtcaaatctttgtggtcttagattcattttgtctctaggttgactttatgtatgtatatctattcttgtggattccattaaattctatagcatgattttcagatggtactaattattcttatatttctggattactgagtgctacctcacttttgccagcatataactgatactagtttattgatggaaatgttgcatataaattaaatttttaagtcacattttttaaatgatctaggaaagcttgatgtttaaagaaattacgttaggaatcattttgtaatttaattatccactgttaggtcagatttttaatgtataatttttattttagatatttttttcctagaacaagcatataggtgtttctataaatgaccgtgagaaattcttttatttctttaattttgtggtggtatttttataaagtgactgctttgtgctagggataatctatcttgaaatgactgcttttactggatgtaatctgtcattttaatttcctgttaacagatggtggttgcattagaaaaggctttgggttttattcatatcagaagctaagagcctatcattttatttcacctaacttttattagaagatatacatatatatatatatattctatgtgaaaatatacctaagtagaagatatttgtaagcttaggtaatagtttaactgttgtatttgcagctccattaaatgtcagaatcatgtgtccttgcagaaaagatagttatttgttctacttgggttatgttcctgatagtaatgtgagcgcagctggtagaggatggcattcctgtgagtctcagaaaatcctttgtctcgtgcagctctaatgctcaagggacacacttcactttccccttaccgagatagtcgaccgccaatcgtactggaggttatgaagtgtaatacacagttccatgcctttatcagtctgtataattgatgcattcagagctttaaagcaaaaaaagaaaaaaagccttgggctaagaaagcctacaccatttttgcatgtactgatgttaactccatcttaacagaggtcatctcagaacaagcatgaaaccggctcacatgatgctgagcggcagaatgaaggtcaaggagtgggagaaatcaacatggcaacttctggtaatggtcaggtaaataaattattttatcatattttttaaaattatttaaatatcagaaaagtatgaagcaagatggttctaagaatgatctataaatcttacctattttcttagtcctgaatgcatatttccagaagcattcagtaccaatgtgctgtcatttctctttattatatcagcaataatgctgtaaggattttctagatctatttctatagctatagattgtgtgtttatgttttagtctaaaatgattgtgagtagttttttttaataactctaagctgcattttgattatgtatatgatttgacctagttatttttgcttgccttgaataggtttgctctttcactaagaccttcaatgtaaagacatttttatggttttttttaaagttataaaggctttatttcctgttgtacttaaagattatataaatctagaaatccaagtcttactgaaaaagataattgtaatgcacacaaaaaagtaaggcaacatggcctaattatgcttaatattaccacatcattttcagcaaaattatgaaagtaaactttttttttttacatacagaactgttatttgttatgctaccatccgttatcttattagatttttattgaaatacagtgcaataggacagaatttttctttagggtgttctgtattctccaaattttcttcaatgaatatttttagagtgtaaatgaatgactttttaaaaacagaatttcactaaattgttcttaaaggtaatttttctactgttgatacagaaaattttcttagtctctctaggttacttttgatagtattgtttttaagaatatgcttctattagttcattaaaatgtaaagcttaaaatgtcttattaagtatttaaatttattttactgagttaaaacaaacatacttcattcagtattactagttagcattatattggaaaacaagtggtaaattaggacaaaggcaatcatgtttaaacagcacatttgagttatgtatctgtcttttgtttagggaattagttgcaacatttatatattcctacacatatgtagaaggaagaaaaatttaatcctatatgacagaaaaaaatatttacataggaatagatctactcgtagtgctttgggtcatcttccaattattatgtactttggaaaccttacctatccagtaagctggctatgataaattggatccatattacacttactacatcaaaataaattctaagtagattagatttaatgtcaaaatgaaaatcattaaaaatataaaaagattagaagaaaatgtgggtagcgtttttataatcatgatgtaggtgggagacccataaagaaaggattgatagatttcacgttacagcatgagacttcagtatgccaggaaatcatagcgagattccaaaacaaacaaccaagatcacattatttgcaaacatttatgacgtgtaaaaagttaaaattcaagatgcaaaaaacagtatttatataccagctatttaaagagtatcttaaaatggttccaagccatcgtagaagtaaaaaaataaataataattttaaaaataaaattaaaatgggcaaaggatatgaacaggaaataaaagaagaaattaaaatgacttgtaaacatggaaagatggtcaactttactaatcatgatatataaatacaaattaaaactaaagtcagatttcgtgggggggccatttagttggcaaaaatcaataacactcagtaatggtgagcaaacaggcattctcatatgttgcttttaattgtatgacatgaaacaggctttctggagagcaattttgtcaaatgcatctagcattatttataatgtgcctgttgtgaagctcatcactacaacatctaagattttttgctaatgagataatcagtcaagagtgatcagacatgtttgaagagattcatcataatactaacaatagcaaaaagttagaaataacctaaatggacattgatcgtaaaatggttaaattattagtcagctgtagattagttaagtggctctggagtcaacaaacctgggaaatcacactccctcactaactagcttagtaacaaaaagtctctgagctttagtgtttcctctttagtaaaataagatgatgataaaacctctacctcatagaacagttgggagagttaaatgcaagatacccttaacacagtccctggcatattgtcagagcttagtaaaaggtaaccgattctgttgttaacaagtgttaataattatctttaaattaacaaatatgccagatactgtgttggactctagaattgataattgaaaaggacagacagtccttggcctcatggaacctatatggtgcatccatgcaaatattaaaaatgataaattacatctctatttatgtaaagatctaatttttagccttcaattgttgccttttctagtatatccttcatattataatcagttattcttctaaaacatgaatctgattatatcacttatttgtttaaacctttcagtggctactcacctcccatatattagaatccagattcttcatgttgcttactcttccaagagtatctcacaatatttgcccacatttctcaccactccctcaacttcaacttcttcagttccttgagtatgtccaggccttccacaggacattcctttggtctaaaactgtcttctgcttcagttcatattatatgttttactcatccttccccaccgtttaaatgtcacttcttcctggacattttccttgtctccacctacctggaataaataaagtactctttgatacgctgtattcctgctctcatagtgcttagcacaatttatcattggtttaattgtcttccttccttcttaaagtcctttaagccacacctgctcctcactgtatgccagccaactaatatgtacctggcagagagcatttatgttgaatattaataaatattattgacttaggtaattataactttttttttggagacagagtctcgctctgtcagcaggctggagtgcaatggtgggatctcagctcactataacctccacctcctaggttcaagcaattctgcctcagcctcccgagtagctgggactacaggtgtgtgccaccacaccaagctaatttttgtatttttagtagatacagggtctcattgtgttggccaggatagtctcaatctcttgacctcgtgatcctcccgcctcggcctcccaaattgctgggataacaggcgtgagccactgcgcccggccaattacaacttttttaatttaaaaatagcaagtatgctgggcatggtggctcacacctataatcccaacacttagggaggccaagcgggaaggattgcttcagggtagaagttcgagttcaacctgggcaacatagggagactttgcctctgcaaaaaaaaataaaaattagccgtgtgtggtagtcccagctacttgggaggccgtgtgggaggatcacttgagcctgggaggtcaaggctgcagtgggctatgatcatgccactgcattccagcctgggtaacaaggcaaaaaatattttttttaatttttattttttgtctaaaaaataaaaaaaaaaacttaaaagcaagtaagtatgatctcattatacatatgtataatgtgtgtatatgcatagagaaatgtgtgggagaatgttctttaaactgttatcaatagttatctctgagtgttgggatttttgtgggttttacttattcttttgtgtgtcgttttattttttgtaatgaacatgtattactataatttataacacccaaaacccattttcattttgggaaaatagaagaaagcactgtcttgatttccgttgtatggtagtttaggttgccatacttcagagtcctaccatgacatacatcatgtcatttatgtcagtatagggatggcagaggaaaagatctattgaaaatagtaaatcagggcccggtattcattcctcctttaagtgatgaactctgatagtgctgtgaattcagaggtaaacataagtatgtttgtttagcagtagcaatcatagacttgcccaccatattggtgtttgtatgacactaatgctgctaatactatctggttactttcagtcactgttttaaaacaatattgcagctattcccagatcctgatgtagatgtgtgacctgtatctgtgggactgtgatttgttattccaaaagtcctttcatctaaataggatctatacacatgatcgcctcttggggtttattagtttgttttgttttattatttgctcaaaagacaaaagccaccaacactagttgaaaatgaaaatcagtctctgactttctcaggatcacagtagcatgctctgccaaagttctgtcctagagtaattctcttcaccaccacgtgggaatgtattctaccgcttctctcacctggtttcctgcccacaatcattctctttgaaaaatccttcattggcttcccttgattcttagaaaaatgataaccatttattgtgacccaggtaacctggcccctacctatcttgtcagctttatgtcacatcttgctctcacacctccacactggccttctctcagtacctcatatttactgggccttctcctaccacagcctgtgcacatctatacctgttccatgtagtgtttgtttcatcccattttgctcagttaacaccagttcatgtgtgtctgagcttaagcaccagtttctcagagaggctcgaacagatcaaatctcactaccataggctgtcacagcatgttcctctcgtttgaagactactacatttgcagttttacattaatttgtgtgatgacttgattaatatttgtgtttcccccactagactgtaagctccagaaaggcagggattctatctagttttgttattttcatacccacacagtccctgataaatagtagataacaataaatatgtggtgtgtgtaatatccctgctaaagaaagggtttcttgatctgtttttaatctctcatggaagttaaatggaaggaaaagcttaggagtaaattatacaggccagatccctgcttgcttagcatataactatgtgtataatttatttattagttggttctcaactttatttatttatttatttatttatttatttatttatttattgagatagggtctcactctgtcactgtacaccactgcacagtggtgcaatctcggctcattgcaacctctgcctcccaggctcaagccattcttccactgtcattcttggatagttgggaccacaggtgcacaccactgtgcctggctaattttttaatttttttatagagataggatctcactatattgtccaggctggttttgaattcccaagctcaagcaatcctccagcattggcctcccaaagtgctacgattggctgggcatggtgctcacacatgtaatcccagcactttgggaggctgagatgagtggatcacttgaggtcaggagttcgagaccagcctggccaacatggtgaaaccccatctctactaaaaatacaaaaattagccaggcatggtggcgtgcatctgtaatcccagctacttgggaggctgaggcaggaaaatctcttgaacctaggaggctgaggttgcagtgagttgagattgtaccactgcactctagcctgggtgacagagcaagactctatctcaaggaaaaaaaaaaaaaaaacgtaaaaccaaagtgctggaactacaggcgtgcaccaccatgcccagcctgtggaaagtgttgaccaaatatcttctgtatatcagagtgtttctatggcaattacagtttgacagtttactgtggtaattgtattttagggagttctgggtttttgtaatttgttatttggggaatttaagaaattagtttttccagtaccctttattctttttatacgttacattgttacttgtgaatcagccatatataatttttatataaacaatatttttatactatacaacttactcttgtcatttaataatactttgagatatcttttcctatctatatgtggtttatagatatggaagtttttaatccatttttctttcactattttttctttttttcaagcaacctaagcttttctatttgaaatttagaaccaggtctctggtaatagccagtatataataataaagctcaattaaaagtgggaaaaagatggaatgatagaaaaacccactctactgccactggtttttaaaactttttcttatggaaaattttaaacatttacaaagacaataatgtagtgattcatatcgacatgtaacctattcaccttaacctcccattttattttttaagaagattccaggcatcatcatcacttcttccctgtttcactgtgtatttacaaaagataaaagtacttattaaaaatacataactggccaggtgtggtggctcacacctgtaatctcagcatttccagaggccggggtgagcggatcacttgaggtcaggagttcaagaccagcctggccaacatggtgaaaccctgtctctactgaaaatacaaaaattagccagatgtggtggcgcacacgtgtagtcccagctactcgggaagctgaggcaggagaatcacttgaatccaggaggcagaggttgcagggagccgagatcgcaccactgcactccaccctgggcaagagagcgagactctgcctcaaaaaaataaaaaaattaaaaaataaataactgcagtggcattattacatctccaaagactctaacagtaattgtttaatagcatcatttatccagtcagtattcaaacttgcagttgtttcataaatgtctttttcacagtttatttgcctcagggtccagataaggtccatgaataggaattagtatatctctgatatctgttctaatctgtatgttccttctttttgttttacggccatttagttattgaagaactaaagttgtttttcttttttctttatggttttctggggttttgtttttgtttttgtttttttagtcaggatctcactctcgcctggactagagtgcagtggcaaagctcactgcagccttgaactcctgggcttaagcgatcctctcgagtagctggtgctataggcactcaccaccatgccctaggcctccctctgttccccaggctggtcttgaactcaaactgatctcaagcagtcctcctgcctcagcctcctgagttgctgggattacaggtttgagccatcatgcctggcttccaaatgttttttttatagagtgtcccatactctagattttgctgatgactccccatgatatacttcaacatgtttctttatcatctgtatgtcctataaattggtagatttcagtatctgagaatattcaagaagtagaatcagtcaagcttagggattggatatgagtgtttagggggaaggagaagtcgagaattactcgcaggtttctgttaggcagctagaagggtagtgatgcaatttagtaataatgctagatgagaaggaggtttgtgagagaaaataatgagtctagttttggaaaaatgttaagtttaactttaaagatgttaggtctgagacatcaaagcagaaatgcacctgggtgcagtagctcatgcctgtaatcccagcactttgggaagcaaaggcaggtggatcacttgaacccaagagtttgagaccagtctcagcaacataaggagaccctgtctctacaaaaaatacaaaaaaaaaaaaaaattaggcgtggtggcatgtgcctgaggtcccagctacttgggaggttgaggtggctgaccctggaaggtcaagactgcagtaagctgaaatcatggcactgtactccagcctaggcaacagagtgagaccctgtctcaaaaaaataaaataaacacacaaagtagaaatgtgaggtaggctattagatttggaattgagaggaaaggtaaagaattggtaattaaaggtattaaagatttttacatccccaatgagtatacagtgagaagatgaatacctagcctaaaattccaaagcagtagaataatattgttacaacaaagagggaacagttaacagtttccaccattgccatgaggactaaaaaatcaccttgggtttcaccaaaaaaaaaaaaaaaaaagttcattgctgatcttgtcaaatgcaattccttgggccttctttcctactatattatattggagtgagttgaagttaaatggaaggttaaaaagtagaagagagcagtcaggcgtgatggctcacgcctgtaatccagcactttgggaggccgagatgggcggatcacgaggtcaggagcttaagaccatcctggccttggtgaaaccctgtctctactaaaaatacaaaaattagctgggcgtggcagcgcgtgcctgtaatcccagctactcgggaggctgaggcaggagaatcgcttgaacccaggagggagaggttgcagtgagctgagatccttccactgcactccagcctggtgacagagcaagactccgtctcaaaaaaaaaagtagaagagagcaattttagctaactgtaaagatgtctagatgtgaactgcccaagagagaaaagatcgttaactgatacagactataagtttgagagaaaatttatttctgtttttaagatagaaaagatgaggatgtttgaatgctgatgggaaggagccagtagagaagagagttgaagatccctaagatcaaagagaaatggagagagaaaggatccagagcacatctaaagggatggaccttagataggaggaggggaactctgatgtcacagcaaaaggtggcgatggatatatacgcaggtaattttaaggttctggttagcaagaagttgaggaaattttgtctgttggctattttttctataaagtagaaggtaaagttatatgcagtaagagaagaagagccacagttttatatgatacaaaatgaggcatatcaaaaatagccaaagaaaggagagctgacaagggaaacaaaaagatggcagttatagcacggagagtctaggtgtattggtgaccataaatgtatatcgacagcatcctaaagagttacgtaagtttctcacatgctcaaatttctctaatgctgcctggcacttcatgtcagggtgtagagaaaacagacagttggattcatctgtgattgcaatgtttccagacaaatggggtggaataagtgcagggcaaagctgttaaaagctagcaagagaattatgaaagtgataaccacaagaaatccaacctgaaatacatgctggatttgctagtcatttcaaggaagcagtatcttacttgcggtcaggagtttgagaccagcctggccaacatggtgaaaccctgtctctactaaaaatacaaaacttagccaggagtggtggcacatgcctgtaatcccagctactctggaggctgaagcaggagaatcacttgaacctgggagccagagttggtagtgagctgagatcacgccactgcactccagcctgggcaacacagcaaaactccatctcacacacacacacacaaaaaaagaaccaacatcttagagaaagttgaagaccaggaaataaaaggagcatgaagtaaaatgttgaggatgtatggatatttataaagcattgaatgtggatggtacaggaaagttggataggaaaaaggacagtgggaaatagtgtctcacacatttggacactgagtgtcaggaatgatacagcgagtgcttctatctttggacaatgagcaaagctgattcaagggatgtgcaatcatgactgacttagcaggtcttgaggttgtgagaaagttcatcacactcaagtttattcagaatttagttttgagttgggtgggaaacaattcttaggaagttattaatcatttcttgtggatagggagactctagtccctccgaaagaagttggctcaggtctagccttaataaaacgcccaagaaagactctcatggaccaagttctaggctcatagagaatacgagtatgtgtacctcttggtatctcctaataataaatacatctaaatttctactgagacagattggtgaatgaagagtgtctcaaaatccaggagctatataggaagataactaagactgaagcttagaaaagatttgttgtctacactgaaatgaatgtcagaaacatgttttattgtggaaacaggttttcccttgtttcataattaaacctcctgttttcttttgtttcaagtagtacattagttagctattgctgcataacaaattgcccccaaaacttaacagcattagtagacatttatatttgcttctatggatcagaaatcctggtgcagctgagctgcctgtctctggttcagggtctcccacaagacttaagggtattggctggggttgcagtcatctccacacataaccaggggaggatctgcttctaagttcacttacggctattgaaggcctcagatcctcattggatgtcagccagagagacatcagttccttgttacatgggcctcaccaagggcagttcacagcatagtaacgcttccctcagagggaacaagagaggtgcccaagatggaagacacgtctttgtaaccttatcttgagagtgcttctcatcacctctatagcattttattcactagaagcaagtcactaaatctagccaagactaaaggggaagggattacaaaaacgcgtgaataccaggaggcaaagatctatcttagaggctacctacaaacagtaaaaatatttagacatcttccaagattgtgtgtttgcttcagggtaaagactcatttcccttctatagaccaagaaaaaggttccttgtctgaatttactaaaaaagccccaactatcctccttagcctgagtctcagtccctcagatctatcctttattagttagaaccagagtaagctccttatgttcagatttatttgtagttctgcctccccttcctctccacacacacacaaacacaactataccatattcttctgacccttgcttatgcctctgcctttgcctgggctgccctgtggctaatccccctcattctttttattaactaaattactcctcatggttcaagtccaaattcagatgccactttttcaggaaccaagactgaattgtgtatcttcctgtgtgttcatatagtttctgtcaaagcacttacccacacgtattttcatgttcagctcctcatctagattgtgtgtgtagtgtgggtgagaatgtcttattcatttatattcctggtgactaatatactacctggaaagtagcaggggctcaggcaatatttgttgcttggttgcatgtggatttaaagaccattccagaagcagtcaatagctggtggcagtggaaagagatgtaagatgagtctttccttgatgcctcttttcccttccctaaggaggattactaattagttttgtcctagaagtgtccctagtcagcataaagagtccagacccacaaaggaagtagagactggaaaggggagccactctggactctgaactagtattctcagtccaaccccagacttccctatgcgagtatgaataagtggattatcttgcctttatatggggacacattttttaaaacctctcaagttaggattttttaaagatcacttttattgaagaaagattagtatgtgataaaatgtacccattttaagtgtacagttgaatgagttttgacaaatgtagttttctctttaaaatgctgatctaaaatagctaattattgtgaacgatgatctaaaatagttttgtgcactagtcaggaaaacctcaccttggcttataacatgacttatacagaagttctaagcagccctcataaaaattaactttggagtattacctatttaaggactttatgaaacaaatttataacaaatttgaacaaggaatttattacgaattcagaaatctctgtatgagcccttaattattgcttgattaaaatcctgacgaatcacttaggaatacattgttaacagttttctatgttgtctaccaaagtggaagttatctggcaaacagtttacgttgctagctaacagggaagaaaagtttctaatacgtcaccatagctgggctcattggctcgtgcctgtagtcccggctactctggaggctgaggtgagaggatcacttgagccaaagaattcagagccagcctgggcaacatagtgaaaccttgtctctaaaaaaaaaaaaagaaaaaagaaaaaaaaatcaccaaaagtgaaatttatgcacaaaaggaagttataaggtgtgttggttccagaattctccccttgtaccctctagagtaggaggtgccatctcacagtcctcaaaacctattactcccattgtggttttctctttaccttcttcaattagccagagcctgtatatctgaaagacaattcgaatgatgtcctgcatcttgacattcttacggattttactaatagctcctcatttatttataattcaacaaatattctgtggatacctactaagcttaagaccacccttggtactaagaatgcagcagcgaacagaataaagtttctgtcctcaaataacttacattttagctttccattctgcaaggttgagaactgcaaaagaatgcctgcaaatattgctgacactattcttacagtcatttccttaattattaatgaatggatttagctgtggcctatattttgataggtcccagttatttatctgcaaccccacctcctgtccagagttgcatcctttgttttcaggtgcccattggggattcttactggatgtcagattcaaagtgagctcagttcccccaatgaaagccatcatttatttctgggtttccgatatccattacgagcatcattacttacccatttatccaagcttgacacctccaagttgtcctcgactcccagcccctctttactcacatccagtcaagttactcaagccagttaatttgaccttcagttcaagccaattaatttgaatatccttcaagagcatccccacttctctattctcactgccttagtttgtgccctcagaaccactcaactgctgaaaataccctctccctcatttcctacctgtgatctctccgtgctgtttttaagacgtaattctgattgtaccattctcctgcctgaagtccagtgactccacagcttgacagcaacatctttgaaatgacatgagatacttaatgatttaacccaacctttatctctaaccatacaccttgtgttctgtccacattacattggaacactccacgctctccgtatttgtacctttgcacagtctcctccgtcagtctcctgtcacaaaatgcctaccttaaatgttactgattttatacagcctctaatagtccctatgcagtaatttctttcttcctgttttccctcagtgttttgttcattcttctactgcggtgtttatattatactgcactgcagtcatttattttttcatgtctttgtccagtaaaagttttaaacagccctttctaaactgtgagatcttagagaacttggactgtagcaaattcatacttagttttctggcaatttggagcatttcagaatttgaacattccttcaatgcttttcatcaatgaacttatctgaatgtggttttatttatttagatctatgaaaaattactaccctagaatttcttcagtctttggttaagtccattctgcagtttaatgctcatatgcaagaaactctcttttctttagtttttctctaaaacatacttagtaagcgtataggtaaaaaatattttgaacagttataatggtcatacttttatgatgtatttaattgtttatcatacagacacttcatttggagtaccttaacatgatgttatctgtatttacctatagtctaaattataccatctataatgtgcttaatttttagggttcaactacacgaatggaccatgaaacagccagtgttttgagttctagtagcacacactctgcacctcgaaggctgacaagtcatctgggaaccaaggtaacagaagattacaaaccctggtcactaatgccatgactactttgctaagacattcttggccaggtgcagtggctcacacctgtaatcccagcattttgggaggccaaggcaggtggatcacttgaggccaggagttcaagaccagcctgggcaacgtggcaaaaccccatctctactaaaaatacaaaaatttagccagtgtggtggcacacacctgtggtcccagctactcaggaggctgaggcatgagaatagttggaacccaggaggcagaggttgcagtgagctgagattacaccgctttctagtggagaattctgattcacagtctcttgaagaaattacatatttttatacaacgaagcataaacaagggaaaaatcaggtttataaaaagtgccagattagctaatttttaattctttttcagtctttacatccacttttctgcaagaatactgagttccagccaaactggctcacttcctgcttcctgaacattccctgtgactttccccctcccttccttgcctgcattggtggggaccaccataaatgtctgtcagaatcctagccagccttcaaaactcttcttgggctttgctttttcacaaaacattttctgattcccaaggtcctcttacctccccatgtgatccatctgcctcatttgaatcactaacaatttgcatgaacctgtcttttggaaatcaagaaatgtttttttacttatcttttgctgtgtctaacagagtgcctgcacatgagtaaatatgtattgaggtgaatggaaaaattgttgaagttgagtgttatttcatgctgataagtgagctttcttagagtatctttcttagatgttagcaaatattttaggatttgggaataatgtttgaaaagaaaatagttactttaagccggatgtggtggctcacacctgtaatcccagaaatttgggaggctgaggtgggtggatcacttgaggccaggagttcgaaaccagcctgaccaacatggtgaaaccccgtctctactaaaaatacaaaattagccaggcatggtggcacatggctgtaatcccagctactcgggaggctgaggcaggagaattgtttgaacctgggaggcggaggttgcagtgagctgagattgtgccattgcactccagcctgggcaacaagagcaaaactccatttcaaaagaaaaaaaaaagaggaaaatatagttactttattattttaaagtcagagatttgattttatttttattttatttatttatttattttttgagatggagtcttgctctgttgcccaggctgtagtgcagtggcacgatcttggctcactgcaacccccacctccagggtttaagtgattctcctgcctcagcctcccaagtagctgggattacaggtgcgtgccaccatgcccggctaattttttgtatttttagtagagatggggttttgccatgttggccaggctggtctcgaactcctgatctcaggtgatgcgctcatctctgcctcccaaagtgctgggattagaggcatgagtgaccacacccggcccatcagagattttaatattcactaagatgaaatgaaattctaatattactaaacgatgtattttcgattaactcgaattccattaattgttttcacagcatactctgtatactctttctttactgtaaataatataatagctcttgggaaaggtattactgaaataactaatgttgatttaagtaatgattttagaataatcaatgatattctcactatgaggcttaatcctgtttatacttcttgggacctcatatgccattcactgtgccaggagttgtatgtaccttatctctggtcctctccaaaattctatgaagtatccatatttctctaaatgagaaaactgaagcaaaaaaaattttaggcatggaaatttaattccagatctgtctaacctcaacatgtagtttttactataaagaaaatcttgaatattcaagagtaatattgtgtgaaaactggcaattagaatactgtttctttttgaagtaatttatgcatgataatattaagaccctagtatgtattttgaatgctagctactgtcctatacatgtattattttatttcaccttaatggagaaaaccttgttaggtaggtaaatttctccattttgcagctcagaaaactgaggctcagagaaatcaaatagcttaactataatagtatcacagcttgctcctaagaggtggagccaaaatttgaacctagctccgatgaaaacccatttatccgcagtcctatactgccttcctaaaactttcatatctaaaggtgtatgtgtatttacgcatctaaagcagcatttctaaacctcagcactattggctggataattctttgttgcattctagaatgtatagtaacgtccctggtctctccccactagattcccctaaaatacccatcctacaattgtgacaaccaaaaatgtctccaagatgttgtcaaatgtgtcccgatgggggcaaaattgcccccagttgagaaccattgacttatagagaatgatgcattctttatataatagcctctacttttatataataccctctagcgttaaaatgagtggaccatggcccaggataactgggtgccactttccggtttctaatctgcttctaactaaatacgtagaatttattgtcagagagtaattagtacttaccagttgctttttaaaaaactgactacaaatcctggctctcactctgtatgatcatggcattttcctttttatgacaaaatgtttttaaatttataatcgtataattttaataatattatcatctgacgagaattaatgattgctgagaattagtacttaaaattgttgcagaaatgttttctgtttattgcttataggtatagattaaaagaaataagataaagttttaaattatgtaaagatttagataaactacattctctatgtgtgtgaaatccgttgtttttcactgattatagtcagtggattagcaccaacttatctaggcaaacagcactaacagtttgttagtgagtatgcaaaaacctacttttgcttttaatactgtatattaccactcatactatttactcacataaacaaattggtgatgatacatagattttgaaataacactgattacttcatcctggaaaggttttccggttttttgttttttttttggcggggggggttgttttgtttttttagagttatagtaaatatcccattcatcacttaattggtttttggcttttggatattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaagtatgttctctatagtgtacatcgtagtgcatgtttcaaagcaaatgtgaaatttttaaacagaaaacatgtttagttaatatgctgtctttatgactaagaggagaaaattcatatcagccatttgtgctactcatatttaaaagattaagtctgtatttccctagaaaaatttagcaaaggaaaatgttatgtgcactactataagaacagtaagtcaagagaaatttatacaatcatagcatagtagggccttagtagagctagaaagaacttgagcaattatgttgcccatctttcacttcatagctgaagctcatttcatagatgaaagtgactttacgtaagttcctatagccattagtgtccaaaccataatcttttacatttgcatatcattatattcaggggatacagagcagcgttacatctgttatgttatttgctcctcacatcaacctactgaagtaggaagggaaggtattatcatctccattttacagatgaaaaaactgaggctcagaagagctaaaggacttaaccatggcctcacacctagtaagtggtagacccaggaacagagcccagatctcctgactctcagctcggtgctcttcctactgtaccatccagctgtagacagtgggcctcagttgctgggagtgataatccacccagctcttcactcaggaagggacccttagacctcagccccactcccgcaggagcagcatgggagttaggacctatggggatataacttatttcattcctgtagccaagaaccaaaagcagtaagtatgtaaggtaagaccttcctttcacctgataagaactgacacacacacacacacacacacacacacacacacgtgcactacaagtagatgattctactgtatcagcctattgatgtgaagaggagatgatacaaacatgacttatgaacctatagcagatttttttaagcttaggtatgaaggtgaatttatttgaaatctaaaaatgttcaaggataagaaaggccaggtgtggtggttcatgcctgtaatggcagcactttgggaggctgagacaggaggattgcttaagcccaggagttaaagaccagctgggcagcacagtgagacactatctcatttttaaaaaatttaaaaagcataagaaaaaagggattgcctttcatatctatttgtcctggggtgaggggaactagtaagattttactgggagaacattgccttcctggattgtttctttggctatccacagttacgtaatgacccacattttgtactcctgatatttgttctcaaaaaattaaatagaataaaatgatacttcttttgagaagttttttaaaaacttacgtcaaatgagttttgaaacctcgtgcatagtattgaatgtggaggtacattttcttagtcacccttttaaaaaatatctgtttactgtctagtatatctgtgtaactttttgtattagagatcacatttgtacatagccacatgctttttttctctgtttgtattgagacagggtctcacacaagcgcccagactgtaatgcagtggtgcgatcacagttcactgcagcctcaacctcccaggctcaagcactcctcctacctcagcctcctgagagtatctgggactacaagcatgtgccaccacaactgactaattttttttttttttttttttgagagacggggttttgccatgtttcccaggctggtcttgaactccttgggctcaaggatctgctcacttcagcctcccaaagtgctgggattactggtgtgagccactgcacctagcaccatgtgcttttaacccacactcatgatagtagtttaaatagaaattataaactgggctaagcacggtggctcgtgcctataattctagcactatgggaggcccgggcaggagcggcacttgaggccaggagtttgagactaccctgggcaacatagcaagaccctatctctacaaaaaattttaaaaattagctagggattgtggggtatgcctgtagtcctagctgctccggaagctgaggcaggaaggtcaattgagcccaggaatacaaggctgcggtgaaagctatgatcattccactcgagcctgggcaacagagcaagaccctgttttgttttttttttgttgtttttttaaagaaagaaagaaattataaacaaaattaaaccattttataccaaaatatttttattattttgtatactcaacataattttaagttattagctatatgagtaatagcataaacctcctagacttattctaagagacttagtcaagggcagatgagtggtaaacatttttatggaaacaaatccctttattcctattttttgttccacatttgtagtatttattcatcctttcagcaaatatttgttgatccactaaaattccgtgaattagggttatattagtgatccctgcatatttttaaagtacaataaacatcattgctcttcaaataacaaagcattatggtttatgttgattttatttttcagtgccagctcctgttgaacatcagatctgtcctgctgtgtgtgttctaatgaaactttcatttgatgaagagcatagacatgcaatgaatgaactaggtaagacaaaaatgttttttaatgacatagacaattactggtggatttttaaatcatggtagaaattcagtatagtaaataaagatttttaatcattgatgaattaggatataaggccaccaacttctgttatcagctgcttcctctgtgtagcaaaaaattgtaccctggtttccagcatagaaaggatcctgaatcacagaaactgctaccctgtcataagctaactttttcaaaatcgaagccggagattgaaaaaaaatgacaaaatgggtcactctttgtcccttttgccaaagtagactctatatgtgccagctgatgaggatggtaatttgaattattttgaaatgtggagctgctgtattgtgattgaactcagtcacttttgatgagcatcagagggaattattattaagattgtcatttatcttcatggttattggtactttacaggattttcatcataagcagcctggtatctttgaaattggttaatatagaaaagtattatgctttaagtcagaaacatttcattataactttggaatgattacttctttaggtatgtattttcacacactaagccttatataaccagcagtgcactccattttttatgtaatggtttttctttgatttctaggttcattttgtacatgtggtatttataaattgcatcatgctgaaccatctcatgtgaactggatctctctagtcatgccacaagcaagaaccatacgcttaattcccattttagtgtaattgtgcccttgctttttgtgccgtttatgttacattatgttccagccaccactttatattcctatcccctcatcgtttcattcgtcatttatcttaaaagtgatgaagtcatgagactcttacacagagaacctgaacagccaaaagtattgtctccttcagagtcatcactttgggaggctctgcaccttaagatttcaggcctgccctctggccatgctttccttcctagtggtgtagcaattggcctacctgattctctttcctccccctggtctcctgtggattctcagttaatcttatgaattctcccctcgttaatacaatctcagcatttgtgaacattttaaattttttaaaatgctaatcataacaggaaggggataaaaaataatgaataaacaggaaaacattcagttttaagatacctcaaaagttattctgtaaatgttcctgtattccaatggattgtagactaggactgagacattaatcatctggatttcaaaataaaacctagactcagtatttgttcctcttccttcttcaggtaggaaggctacccggggcatttcatcacaggagctagggcaggggctttcaggtgaggagcaggatggggcctctgggggtgtgactgctggggacatagccacaggggattaccttcttctcactcctcacctccagatttgcactggggcaaaaggaggattagggtgtgtggattgcggggagataatagtacaagacagcacaaggttttggcagtaagggataaggagaaaagaaatcccaaataggtaaaggggaattccttagttcagtcagctgggatggtcatttgtacatatatgaagattctacagctatcagtcatttaagtttgcacttattagtattagaagttttagaatataatttccatgatatatgtttattgattccctaatctaccccagaaactgtgctaggcactagatttttataatgattaagacctggtcctggctttcagggaactcacagtttatttgcattagtgtttcacaaaatacctaaatcataatgatcacccagaggcactcgtcaaactggattttctggcactgtagcaaacagaatctccaggggaagggcctaggaatcaatgtgataagtggcctggctgattcttatgttcgggaaattttgtgaaacaccagtagaatattcttgttgagcctgtgatatttattttagaacaaggcatttcatgctaatggtgactatctaaaccaaataaaacaaaagcaatatgctttttaaaattatcagtctttcttttgttcataagagtctaaattaaggattctgttgaatgtcacctgagtctgttggtgctctactatcggtagttttaccctattgggcaatagtccggtctatttagaccactgttttctaacaggcaccaagaaaattgtagaaggacatgttcatcatctttgcattaccatgaaacatcctgatttttcttagagcaaccagtttttaattgtatcaatccagtcatgaatttgcatattttagcaaatccatttataggtttaacctatgaattctattctgtgcctcaaaattctctgaaatcttttcatttgcctgaaatcaaaaagcacttcctcttttatctgatagtctaaatttttttgaatgttctttttttattagccatgttcttcctgaatctgttgatatctgccacattcttatttaatctttattttcagtatcaaatcctaagatttttagtttttccatacaagagtactcaactctttgatcatgtagtgccttcttggcatcttctttaggtgcattttatctttcttaagaaagtatcccagttattgtcacaccaggcaagattttatacagacaaaaggcatagtttgttttgttttggtattgatcctctgctttaaaatactcgacatcttggggatctcattagtataccaggccaagtcttaaggtcttccctgtcaatttcatgggtcaaaattctcagttcttttacaggctccttttcttttacccaagtgtaaaatggtggaattccttgaagctctgccctaggctcttttcctttctctctatgcttctgttatagtttttgtttttgttttcaaatttacagctcaatttgagttttttccctgagttttagacacattattgaactgactatgtgacatcttcccttaggtggtattttagacacttctaactcaactgtcacaaactgaattcgtaatctttcccatccctgaatctcttatcttttcccagtttccttttctcagaaattccaatccagttgctcaaatttcaaaatcttggaaatcattcacgatgccatccttatcccctgcaaatagcaactgactgctttaattctgctacttaaaagtatcttatgtcatcactcttctcttcatccccagtccaagccaccatcgtctctcctgttctacaatactttgtcttacttctcttcccatttccactcatagtcgattttgttcactgaaaccatagtaatctgtttagagtgtgcatctaattattcctttttctgcgtaaaatctttaatgtggcacataaagtcttatgtgatccggcatctacccatgtttatagcctcattttgtggccctctccttgctgttaaatatttcaggcccaggggccctttcacatgctgtttcctttgcttagaacgcatctttcttcttcctgccccacccttgttagatacgcattcatctggccagacctgatggctcatgcctgtaatcccagcactttgggaggccgaggcaggagaatcacttgaacctaggagttcgcaaccagctcgggcaacatagtggcaccctgtctctaccaaaataaaaataaaaagaaagatacacattcatcctttacgtttcaacttaaacattaaaagattatttcctcagcctttttcttatggagcctaatcccaggtctaagttaagtccacctattatatcaccctgtggttctacatagttcatctatctttgctccaatctgtacgctcttcataaagacagtgactgatttttgttcactgtctctgtattttgccactgttgcaggtgaatggaggaaaattttcctaaatatgatttggattttctttaaccaaattaattttcacttacctacattcaaacatgtctgtcattcctgctagtaataaagttttgcataaatcttcctacatttaaatcccttggcttggaattcttgacccacgacagaactttgttttacaaacttgcagattcttctgcatattgaacttcccagatcacttattaaaaatattaacgtactggctgtcttgcagatgaatgacctaattagacttgtagtatccaagaattgcctgtttatattcatctttttctttctgagtcccgtgatgattaatatttgatgaattatattttgaatagcctccacatgcatttttctcttttgttcacttcctcaccattttgcttcactttttttttaactgcttcctttgtgtctttcccattcctttacctttgttttctccttgacttcctattgttggccattgtgggcattgtttagcattttcagtggaaagaatcaggggaaagaaaatactaaatcttagtatagttaatatttgatattatcaacgagaagtaagaaatgttttgaaaaacacaaatcagtagttttatataacttaataaattgaacagatgatcattttttgtaaaaaaaaaaaaaaacaaaactttttagtttttcttcatgcacagtttcatttaaaggcatccgtattcctaagggtaattatttgccaaaaaaaaaaaattaaagtagttaggccacagtgtatgacaataaagagtgtttataaagccctaataataataataagttacctttttctgcttatgttcacgaagaactagtgttagaaaatagccttcttcactgttggcaaggtgcagtgtatatgcagtaaatagaaaataattatttcgctcagcaagataaggggctgggggtggagaaactggcataaaatggaataattgtcagttgtactttataaatatattatacagaagttctttataacagtttttgtagcttataattctaaaggcaaatttaaaccatatattctcattgattgagtttttttttcctagtatttaagttaccaacttggtaccagtttgttttattttagatgattgtctttttcctcttgccctttttaaattagggggactacaggccattgcagaattattgcaagtggactgtgaaatgtatgggcttactaatgaccactacagtattacactaagacgatatgctggaatggctttgacaaacttgacttttggagatgtagccaacaaggtatgtttttataacatgtatttcttaagatagctcaggtatgagttaatttactttcatacaaatacattttactgattttcttttttttcactctcctcattaaacaatgactgataaaaacctgtgcttcacattcgcttatctttactcatttgtttgtcttatgcctaaacaaaggcaaaggtacatctacagatggaacacagtagtgaatttatgtaattgcattaaaaacaccattcataagaatatacttgtagggatcatttctgtgatccattactagagaagtttaactgtgtagaattaaaaaataaaagataaaacacttcctaggaatgggattaaaaatctaaaaattcttaagaccaaggcaagtgttacacacacattgattccatccaaataagaggctttactctaaaacctgttgcttatcatttctcaccacttattcactttatttctctagtttgacaaaggaagaacagatagcaaagaattaggagaatatttgtcttttatttaggtaatcttattctagattttttatgagtgaagtatcagttatgattaaaacaaaataatgaaaactgaattagacatttagtagccaaaaataaagcttggcttcaagttgtctttttaatgatcctctattctgtatttaatttacaggctacgctatgctctatgaaaggctgcatgagagcacttgtggcccaactaaaatctgaaagtgaagacttacagcaggtactatttagaatttcacctgtttttcttttttctctttttctttgaggcagggtctcactctgtcacccaggcttagagggcagttgtgcaatctcagctcactgcaacctctgcctccagggttcaagcaatcctcccacttcagcctctcgaggctgggcctacaggtgcacaccaccatgccaaacgaatttttgtattttttatagagacggggtttcaccacacctgggctcaagcaatctgcccacctcagcatctcaaaatgctgggattacaggcgtgtgccaccacacccagctaatatcctgatttagattgttgctcagtatttagtatctcatgtataaaagatagttccattaacactagaaaaagaaaaataattatattgtggttagactgtaggaaatctttttggcactgtagtagcatttaggaggaatttaaaaaaaaaaaaaaaaacaggatctccctctcttgcccaggctggagtgcagtggtgcgattatggctcacagtaacctcaagctcctgggatcctcctgcttcagcctcccaagtagctagaactactgcaggcgcatgccaccatgcccagctaatttttaaaaagttttcatagagacagggtctcactgtgttacccagaaggtcttgaactcctggtctcaggagatcctcctgcctcagcctcccaaagtgataggattacaggcgtgagtcaccacggctagccagaatttctttcttaatagatttctattcttactgctagcattaaaaacaaaaaagcaactagtatgattttatgtataaattaatctaaaattgattaatttgcaggttattgcgagtgttttgaggaatttgtcttggcgagcagatgtaaatagtaaaaagacgttgcgagaagttggaagtgtgaaagcattgatggaatgtgctttagaagttaaaaaggtacctttgaaaacatttagtactataatatgaatttcatgtttggcttttttttgctgccttcttttagccatgagatttcctaatttcttacctgtgtattattcagtactataatatgaatttcatgtttagctttttttgctgccttcttttagccatgagattccctaatttcttttttgagatggggtctctttctctcgcccaggctggagtgcagtggtctgatcttggctcactgcaacctccgtctcccatgttcaagtgattctcctgcctcagcctcctgagtagctgggattacagtgcacgccaccactcccggctatttgtatttttagtagagatggggtttcaccatgttggtaaggctggtctcgaactactcctgactttgtgatctgcccaactcggcctcccaaagtgctgggattataggcgcaagccatcacgcccagcctagattccctaatttcttacctgtttatctcaccagtccatagttttagagtaccgcaaactcctaaagtactaaggtagaaaagattatataaggggatttaatgtatatcagggtttctctgcctcagcactatagacatttttgaccagataattcttcgttttgctggggctgacctgtgcactgtagattgtttagcagcatccctggcctttgccaactggctgccagtataccctccccctagttatgccgatcaaaattgtctccagatactgtcagatgtctgtgggagggaggaaggacaacgtcaccaccaattaagaatcactggtataagtgtacctttgtgctctccaaacctcaatcccctcaaattttgatggtcaacttatcaagaggtgatcagagccaagggtgaggaatcatcaaataataatttgtttacagaaggaaatatctccaggcagtccatctgcttcagaaactaggctaaatttaaaaagaaaaaaaaaagtaaacttgaaatctgagagggaccaagcaagttgtcttagctagtctaggtttcctttcacccagctagtcctcctatacccacagcctacatgttcttcttcaaaactttcctcttcagagaaggcaaaaggtttgtttttttttggtttagttatgcatttttggtaaagtatattattttgttcttggaaaacccttgaaaatttattagatagaaaagcattcagctaaattattagttataaagataatattcaaatatacttagcatctgcataaaaatacctgtatcactgttgaatggagagaagacatttaagaaaagaacatggccgataagcccttgaaaagatacttaatatcattaatcatcagggaatacaaattaaaactacaatgagataccattatgcatatcatattggttaaaatttaaaagattgaccatgcattttcaaggatgttgagcagctggaaatcatgtattctgctagtgggaatataaaatggtataatcactttggacaacatttggcagtgtttttaagttaaacatacacctgccatatgacccaaccattccacttctaagtatttacccaagaggagcaaaagtgctgacacgaagacttacacacaaacatccacaataatttatgatagtcaaaaactagaaataactatgtctgtcagcaggtgaatggtaagcaaattgtggaatatttgtacaaagtaataggattcggctgtgaaaaagaatgactattgatacatgcagtaatctgtaatgacagaaaacagattagtggtggcctggggttgggagtagaagagaaggggaggattatgagagggtaggaaacttttggggatgatataaatgtttgttatcttgattggactggcagttttatgggtgtatacatgtatgaaaaattatcaaattgtaaacttgaaatgtgtgcagtttactgttcttcaattatatttcaataaagttcaaaaaaattagtgcttgcacacttaagtactcctactctaataaccctgtgtagtttcagaaggatttaatgtgtgtgtgtattatgagaatttgcactgctgctaactggttcatgacttaattctctctcaaggacctaaactcttctataaattttttttttttttgagatggagtcttgctctgctgccaggctggagtgcagtggcaggatctcggctaactgcaacctccaactccctggttcaagcgattatcctgcctcagcctcccaagtagctgggattataggcatgcgccaccatgcccagctagtttttgtatttttagtagagacggggtttcaccatgttggccaggatggtcttcatctcctgacctcatgacccgcctgccttggccttccaaagtgctgggattacaggcatgatataatgcatggtcaatcttggaaaaactagctgtcagaaatttataatatccagttctgatttgggcctaattctggttagcagtattagaatttatttattttttccctctttttctacatttagtgcagcagtcatgaacattcttcttctctttttcattcaatatcaattccctctcaacttcagctactaatgagcaagagaatcagaactaccttctagctcccctgcatgttccacatcactttaactcactcagagctcttactctagagctttcctttaccagcactctgtactccgttcacttaaagctgttggtcccttactcttgtcttctacatattctctactggatccttcttttttatgtttcagttctctagaagaagcccaatgttttgaaaaacaaaaattttctgtggcttctattacagtgtttctcttttccagtaacaaccaaaaccctgaacaatggttttgaccaaatacctttgtgtatcagagtgtttctggggcagttacaatttgacagttgactttgacttgcttcatttctaaactggctgtactatcttgagttcctcctaattttgcttctgacacaacccttctccttgatcatagaatctagatttgtagatttatttaagtttttctattctaccttcacctgtattttatactttttggtcactcacttttgctgttactacttgtattaataacctctaattatttattttgtgtcttctaatttgaactataaaaacatttttgaaacaaaacctctggcccttgacatgtagccccacagagaggaacttttgtatttttctaccttcaactctcaactctgggccagttgcatcttaattcagtcctttaaattcttgctttttttgttctcaggatacttggagtgccccacctttatctcagtcacaatgtaattaaaattgggctcatcttgattgatgtgagaaggacaaaggcacttcttgcataaaagcactctatctgcctcctaccacttatgtgacaaattatgtctaaacctgctcctagattgttttgttcacttaatttcttgatgaagagagtaaagtagctatttattgggttagacccaaaatgtttgctgtgacattcaaggcctggcttttgtctctctggacttattttccactgttccccatcatggactgtgatctcctttgcatcttctttctgggtcatcagtactcccgcgctgattcccacttccctgcctttcctcattctacttcccctgccagcagcaactggattctcttctctgggaatgtacaggtctaatcctcctaaagagctgttctcctccatgaaatatttgattgatttgattaaattcagggtgtaatagttttttctttggagcactttgtttcatgtatatttttgtatctttttttccccccaaagcaaattgctaacaccttcaatcactggtatcagtttgctatgtttgcatcctctagagtgcctctcattgcaataggcacagagttgatttctaattaatgtttgtttcctgatggatatatagtaagaagacagattgacatcaccatcatgccaagttttgggtttgggttttttttttttgcttttgcttttgcttttgcttttttgagacagggtctcactctgccacacagccttgacctcctgggctcaagctagcctcccgcctcagcttctcaagtagctggacctataggtgtgcaccaccatgcctggctaattttttttttttttttttttgagaccgagtctcgctctgtcacctaggctggagtatagtggcgcaatctcggctcactgcaacctctgcctccctggttcaagcgattcccctgcctcagcctcccaagtagctaggattacaggtgcccaccaccacaccgggctaattttttgtattttagtagagacagggtttcaccatgttgatcaggatggtctcgatctcctgacctcgtgatccgtgcaccttggcccctcaaagtgctgggattacaggcatgagccattgcgcctggccgcctggctactttttatattttttgtagagattgggtattgctgtgttgcccaggctggtttttaactcctaggcttaagtgatccacccacctcagcctcccaaagtgctgggcctgaaggcatgagccaccacacccagcacatggcaagttttgaccaaatacctttaattgtgtatcagagtgtttctgtggccattacaatttgacagttgactttgataattgtatgttagggagttccaggttttcataatttgttatgtggggaattttaagaaattatagcttttctagtaccctttattgtttttataaattacattgttaattttgaatcaaccacttgtatataatgctttttatataaacagaatattgtatatactacactgcaacttgctcttgtcatttaataatacttccaagatatctttccatatctatgtatggtttacagaattttaaaaatctactttcttttttttttgagacagggtctcactgtcaaccaggcttgagtgcagtggcgcgatcatggcttactgcagccttgacctcccaggcgcaagtgatcctcccaagcagctgtgactgcaggcgcgtgccaccatacccagctcattttttttttattttttgtacagacgggatttcaccatgttgtccaggctggtctcaaattcctaaactcccagtcacgccagtcagccttccaaagtgctgggattacaggcatgagccaccacgttgcgccttttttttttttttttttttttaaaaagagtttcgctctgtcagccaggctagaatgcagtgttgcagtctcggctcactgcgacctctgcctcccaggttcaagcgattctcccacctcagcctcccaagtagctgggattacaggcacctgccatgaagcccggctaatttttttttgtatttttgtagagacggggttttaccacattggcgaggctggtcttgaactcctgacctcagatgatccacccgtcagcctcccaaagtgctgggattacaggcatgagccactgtgcccggccacatgccgggccttaatccacttcctgttcacttttttttttcttttttcaagcaaccccagcctgagaataacccacattctattctgaaaatgttttcttttcataatgcacatcagttgtgcctcatattctaagatgtgtgtactatctaaacacttagaataaagtttataaaagtcattagttaaatattgtgttctgcttgttttatagagatatcactgatataaatactatttggtattttatgaacatttttctaaatggaaagttcttaatttaccagtgagggacgggcaataggatagattaaaaaatagcttttattcaatatcagtaacatagaagttaatgagagacaaattccaactctaattagatgacccatattctgtttcttactaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggtatatatagagttttatattacttttaaagtacagaattcatactctcaaaaagacctaattgtaagcaatgttttatataatcatgaaagttttaagccaaaatatatttattactgtgaaaagataactactaactcttagtttaactcattagtgtacttaatgtaataacagtttatagtattatagaggagactaaattaagcaaattatagttgagaggtgtagcccataggtggaggaaaaaatagtcacaaatattgtaacaaaataatccatttctattagtatagtataaaagagtatgaaaacaaaatttagaacaagacaaaaactatgagcgtgatccagagaatataaaggttcacatttttctaatgatgtcttagtatccataataataattttttttttttttttttgagacagggtctcactctgtctcccagactggagggcagtgttgtgatcttggctcactgcaacctccacctcctgggttcaagcgattctcccacctcagcttcccaacaagctgggactacagatgcacgccacaacacccggctaatttttctattttttggtagagatggggtttcacaatgttgtccagctgctcttgaactcctggcctccagtgacccacctgtctcagcctccctaagtgctgggattacaggtgtgagccaccgcgcccggccaataatcataatattatttagctaacagccattcatccaatctgctagagttgtaaaacccaagagagtgcttcagatacagggcacacattttcagaactcggatgctgtattatatcaacaaaaatacaactgtcttttttttttttttttttttttttttcttgagatggagtcttgcactcttgcccgggctggagtacagtggcacaatctttgctcactgcaacctctgcctttggggttcaagcgattctcctgcctcagcctcccgagtagctgggattacaggtccccccccccccccgccaccgtgcccggctaatttttatatttttagtagagacggggcttcaccatgttggccaggctggccttgaactcctgaccttaggtgatccgcccacctcggcctcccaaagtgctgggattataggcatgggctactgcgcctagccaaaaatatggttgttttttatagcttattcattttttaagtctgtgatgcagaaactacaagcctagtctccctttctgctatacagagaagatttcttaagtccagtaactactggactgctaagagaagacgaccatgttaaagctcattatgtacccttgccattcagttttaaagcccactaaagctgaatatgctgtcattaatcttcagtttgcctgcgttaaacaagctgttgctctttcatgtccagagttcattatgctgattctcactccttgtttttatatgccttaaatgtttcaaaaactttaatttacttgattttttaaaaataataagcacacagtctgccaaagagcagtttttcttttcttttttttcttttttttgagatggagtctcactctgttgtccaggttggagtgcagtggtgtgatctcggctcactgcaacctctgcctcccaagtgattctcctggctcagcctcctgagtagctgggactacaggcatgcactaccatgcccggctaatttttgtatttttagtagagacagggtttcaccatgttggccaggctggtcttgatctcctaatctcaggtgatccgcctgcctcagcctcctaaagtgctgggattacaggcatgagccactgtgtctggccaagagcactcgtaagaaggatggcagtatcacaaaatcaagccagagatacagagattactctaaaaagtaagtgttctaatctaagagcttataatgtgcactgactgcagaaaaatcttcaatcaattctatctacctcttccaagataactcaatatcaatatcagagtggcacccaaccatagattaaattaccacaaagttcctattcaacataggatttcatgatatagtttttaaattgggaaactgttatatgaatagagtaaatgtatgtgccccaccccctgcaaatgttttaagctattgggtcagaataggaaatgtagaattgacaaaaaataacacctttactttttttagtgtgacagattagtactttaaaacattaaacattacatgaaattagaacaaaaggagatgtggaatacttggaatttataggataattggtacaatcatattatgccttttgtcttctatccttttatttgttgttactgcatacacattgtgaccttaattttgtgatctcttgattttatttcaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgcatataggtcatactggtttcctttcattttttgattttctatttctaattttctgaattactgcatgccagttgttgcaaaccacttcaagtacttctatggaaagagatggatgttagtcaattagataaacttgccttttaattcaaataaggaagaaaatataaatgctgaaaatgaacattccacatgccagaaaagtggaatttttgtaggcaacacttgagtggggggagacgggccagtctatactacccattgaagtaaagactgctggatgaggccctctgttagagatagtggttctgaattagtaaaggggcaaatctcaattctaattatagatgttcacagggtgctgctataatcgatagcaggccaaatattcccagtttatgcttgttaacaaatggcatactaagcccagcgttgggaattagtcaggagttacgatgcctgtttagagaggagtgggggagggagagttacctaacgtaaggcacttcaaaggagtgcgttgggatcaccaggagtgcttaacaagacatagctgggccatacccccagtttgattcaggatgtttggaatggggcctaagaacttgcatatctaacaagttcaaaggtgaggctaatgctgctggtctggagaccacactttttgagaattactgccctaagatcacagtgaagctccttgagtggttgccttcagctctagcgattcctcccaacaactggacccttaatctgacaaagtatagcaacagataaaagacttcccctaggcataaaagatttcaatattaagccatccaatttcataatgctcatctcaactcctgacagcagacaaacttagccagacatgaacaaacaagtaattctaaagacagtgattatatttgaaggatcagttaatgttccctttgagactgtcattataaaaagcagtaacttcagcaaagatctaatttgaattttcaataagattaaaagactatgaaaagggaactttgagatgagagaaggttgatttcagatgaaaatatccagttttttaatatacagtggaagtgatcaataattagcaaataagatatttgaggacaactttacagattaccagggtaatgaaaaggaagtaatcaaagataagccccataaggatcaaatagcactgtaagtacagtaaaatgtttcttgattaaaatatggatcatgttgccacaggttaattacatgaaagaatgaatctcttgcagaggatgggagccagttgcacaatatctgaatatatgttatcccagggtttcttggaatctaaggaaaaaagcagagcaccagaaatgcaaaaagtaaattgcccatagttaaaggaacatctgagtagtcagatcattaaaatttatgaaacaattatttttcacaagtcatggtggctgaaatagagtgtataatttttttcctttcaaataagcgtattttcctcatattacactgacttaaaatttaaaaattactttgtaatgttgaaacctatagactgtggctcctgtaaaccccaggtcattttcctgccattcttacaactctgtctaagatctataaaagtatattctgctttttgttaggccattcatgcttttttcaacctgtacattctatgtatataatattgttcttggtgctaaatacactttcttttatctgatattcaggataattctttctctacatttgtgactatccacttattttctcgaataattaaaaatattcaacataatgtatgttagtgaaggtgaccaatgaatataaagcagcattagtgaaaaataactattgaaaaaaatgccaaacattaacttccctacctacaccaccttttggaatccagacccttagcctcattcactggtcactgaactacgtacccagtctttctccctgaccttggctatttgtaccagagttgtatctgacctagaggagactcatcatcagctggtcagtgaccagagacttgtatagcactgcttggaaataaaaaaatgatcaggccaatcaatttgaaatagtaacaaaggacatttctggccgggtcttgagtgctggaactgaaagagcacgcacacagttaaggctcaaattactatgactggcatcatgaagcttaaactaagaggaagccacctagtggagaaagaggaaaagggaacagatactgggaggacacatagtgagagagagacaagaatcacaagctcaagaccagcctgggcaacaaagcgagaccctgtctctacaaaaaaaaaaaaaaaaaaaaaaatagggcctgatggtgcatacctgtagtcccagctacacagagtctgaggcggaaggatcgcttgaggctgtcagttcaagactgcagtgagctgtaagccctccagcctggatgacaaagcaagaccctgtctcttaaaaaaaagaaaaaaaaaatcctaggggtaacatagtgagacctcgtctctacaaaaaattagctgggcatggggctacacgcctgtagtcccagctactcaggaggctgaggtgagaggatcgttctcgccactgcactccagccttggtgacaaaataagaacctgtctcaaaaaaagagtccctagctcctggagtcactcagttcctgccatttttgagactttgttctacttttcccggtttggggagcacttgtgaacctctcacccctctttggtcctgaagtaactttaacagaaaaccatatttagacatacagtaagttttaaaatttccaagataagactataaaaacatcattggggccgggagcggtggctcacgcctgtaatcccaactcttcgggaggccgaggcaggtggataaggagatcaagagatcaagaccatcctggccagcatggtgaaaccctgtctctactgaaaataaaaaaattagtcgggtgtggtggcgcgcgcctgtagtcccacctagtcagaaggctgaggcaggagaatcacttgaacccgggaggcggcggaggttgcagtgagccaagatctcaccactgcactgcagcctgggtgacagagcgagggaaaaaataaataaataataaaaaaaattaaaaaaaaacaataggaagagaagaataggttgccttaaaagaaaaaagttggcatcaaatatctctgtaatactaaatgtcaaagaacaaaacaccacaaaaaatggaacacaatacatgcggcatttggagggaatagaaatattacctaagaattctgaaaccaaccatactaacatttcatttatcagcctttgggattcttgttatagttaaaaacaagacctctaaatgacaagatgtttatttaaagaatatgaggtagcccacaggatctgtatgaggactagaaaatcagccttagaaactgatttttctaagtggatattgtttcacagtggaaacaatatccaaaccatactgtgagactgcagtaaagacttagatgctacccctaaatgctggaatcctctgacaccatcgccataaaataagattacatgtggcactcacttcacgctgcttgcttctgaattgaagtcttgcttgggtggacgtgattggcagaggatgtattgacatgcctgtagcacctgggaaagttcacttttttgtttctccattgaggctggattcataaaaatgaatttctcaaatctatgagtgacactgcaaaagtgcttgggagccagaaaccatgacgtatttctactacagtattccagctgccccagtaattaagataaatggaaaggtattaagattgagcaatgaaatatttaaacttgaataaatgtataaataatgttgttaacctgataatgaatctcaatgtgaatgtttaaataactcacagagaaacaatgaaatgcttagtaatttaaatcatcttaaattcaagattattcaacccagacggggaaataagggttagaaggaaaggaagaggttaaaacacactgttttgaattttatgtaggcagtgtcaatagatactattttatttttaacttagaaaaaatacaaattcaatttttaagtttagtggtcatgtcaatgtttaaaaaaagtatactactttttccagtttggggaacacttgtgaacttctaacccctctttgttcctaaagtaacttgaaactaacagaaaatcttatttaagtaaaattttccctccaaatcactagctgaaagataacagctaaattagccacagtgaagcataaaatgacggaataagagtaataaatgtattaaacacataaaatagccactatcagattggataaaatgaaatctcccaactatatcccactaacaaaacagtctaaatgattcagaatggatacaataaaaagtacaaccaccttgcagaggcaaatgcaaagaaaacagtaaaggcaaatttatgacagtatagttctcgataaaaggcatcaaacatgaaacatgatgacaacatttggtactataaataataacttttccttttgttttgcacagactaattcatctgtaaagcactggcagcctcattgttaccatggtttttgttaatttctctttgcatttgtaatttgttgttgttgcccaaacaacagtctcactctgttgcccaggctagagtgcagtggtgggatctcagctcactgcaacctctgtctcccaggttcaagtgattctcctgcctcagcctcctgagtagctgggattacaggcatccaccaacacacccagctaatcttttgtatttttagtagagacagggttttaccattttggtcaggctggtctcaaactcctgagcttaggtgatccgcccaccttggcctcccaaagtgctgggattacaggcgtgagccactgcgcccggcctgtaattttgtttcatacatttgctaccaaggagcagttattatttaaaaactacaacttctgagctgggcatggtggctcatgcctgtaatcctagcatttagggaggccaaggcaggaggattgcttgagccgaggagttcaagaccagcttgggcaacatagtgagacccctgtctctattttaaaaataatagccaggcgcggtgactcacacctgtaatcccagcactttgggaggccgagggggacagatcacctgaggtcgggagttcaaggccagcctgaccaacacggagaaaccccgtctctcctaaaaatacaaaattagctgggcgtggtggcctatgcctgtaatcccagctactcgggaggctgaggcaggagaatcacttgaacccaggaggtggaggttgcagtgagccgagatcacatcattgcactccagcctgggcaacaagagtgacattcggtctcaaaaaaagtaaaataaaataaaaataataaaaccacaacttccttttaaaaaggtggattctgtgaaaggacgtttctcagaggatccttttctttagctgaggacctttatgagtttgaaatctgaaaagccaagcctggagtgagttgggaggagagttagagaaaatttaataggtttgcttaagagaggtgagaatctggaattcttggggtagtccaggaatgggaggctgaggaggagagatgggagagaacaaagggaaagaggagaaagcaaaatatggagaggtcaaggttctaggtgaagtaatatgcccatgatgcagtggctaaaatgattcaagaaagagaggtacattattttagttggaaccctaggttctttgcaaaatctctattccagtgttaacgtattcacttgtttttaattttcagggtcttttctttacaattgtaattagcttcaccatcatagtaactataattatttaaatctaagtataaattagatttcagtattcagcactgttctatattacatgactttgattttcttcaattctgtatgttaatttggcttagctggagtatttcctcaaatgattattatcttttcagaaaagctaaattagggtactgtctaaatccatactcgttttcaaattgttttattttgccctcacacaaggataatttgggtcacaattttggtcacaattctttttctcagaacttttagattttagcatttactactgctaagaagttccagtatcattctgggtttcttccaatatagataacttttatttcctacttgagtgtttatagggttttattttaagcccttcaataaagaaattttactagcgttaagtccagctgtttgtcttttttcccataactcttttaatcctgaatcttttcaatcttgagccttcaagcaaatgttcacatgttctttcttttactgttacttcccctccatcacttcttttctctcactttgctgcataagaaatcaagccataatataaggaatttggaccaggcgtgaggggtcacgcctgtaatcccagcactttagtaggccgaggcaggtggaacacgaggtcaggagatcaagaccatcctggccaacatggtgaaaccctgtctctactaaaaatacaaaaattagctgggtgtggtggcatatgcctgtagtcccagctacttgggaggctgaggcaggagaattgcttgaactggagagacagaggctgcagtgagctgagatcacgccactgccctgcagcctggatgacagagcgagactctgtctcaaaaaaaaaaaaaaaatgtagtggatactgggtccaaatcaactgtatccaccaaaatggcccttgttatcagaaactgggcagtgcctaagtggggactctactctcaggagttcttgatgtccagaagttgcactgcattcccctagatgtggcaagaacacctgtcctccactttggtattaacattttcccataagattaccaaaccagtactgtttgtgttcaaatgccttaaggtatttttaatgaaatagtttcattaaaacagattttaatgatagcctattctcctaactcaaaatatagatatgaatcctccagggtctggatatggaacacatacaaatcttagtgacaaacaccatgttgtgctctgacagttttcccccagatggtgacagttttgtcattgggtcaagctggtcttcataactcttagttgttctagggtaaattctgtgttctgtggaattgacttctgacagaatggtagaacatatttccaaaaatggcacactatctcccattccacgtgctttttttacagtacaaatctattgcccctcctttgaatctgagttggtcctgtgattgctttgaccaataggatgtggagaaaatgatcttctgggacttccaagaccaggcattaaaaaagcctagcagcttctactttgccatctgcaggaaacttgttaaaactgtaatgaagacttttctcaagactttggcaattggggtattgcaataggggaaagggattagcagctagagatttatagccaaaggggtaagtggatggaaaattgctaagggaagacatcaaggatagggtgatccttgctaacctgacttaacaggttcttgctgtaagcaggccaaagccttttacattaaaggtgggggatgagaaatctgattagatttcaagggtagggaaattctcactaaacttagcaggattcttgctaaaactaggttgggctagacaggtcaaagagaagactggggccaaggtcgagacctagttgagaagaggattcagaggagactgtttaatgtttggtcaaggagagagtctttatcaaagcccaatctaaccatatggagatgccacaccacatggagatagagatatccaaccagccttcagctgttcaagccatcccaactgaggcagacataaacataaagtcattgtggactttctagccccagcagatgccacataaaacagagacaagctggtcctgtttatctaccctacccaaactgcactttcatgagcaaataaatttttgttgttgttttaaagcagtaagttttagagtgctttgttacacagcaacagacaagtgagacaggcagccatccccattagctaaccaaatatgcccaagcgtgccatgaatttcccaatagactcaactcaagctcagtctggggtgatcctgctatggctgtatgcatatgagtctcactcttagacctgtgagcaacttgaactagattcttcatgttaggcttttgaaagtttaattataatgtgtcttaatgtgggtttttttttttagttaatcttacttggagttcactgagcttcctggatgtttatattaatatctttcaacaaatttgagaatttttcagccattatttcttcaaatattcttgctgtcctttctgtctctcttctccttctaaaactcccacaatgtgtatattggtccacttgatggtgttccaacaggtcccttagaatttgtttgcttttcttatttttttttcttttggttcctcagactcagtaatttccattatcttcaagtttgctcattcttctgtccgttcaaaactgcctctgactccctctagtgaatttttcattttagttgctgtattttttcaccttcagaatttcttttttgtcttctttttagattttctgtctctttattgttatttccattttgtaaatacatggtttcctcaactttctccacatcctcctttagttctttgagcctccttaagacagttgttttaaagtctctatctagtagatctaccatcagatctttttcagaaatagtttctgtcgatatcttttatttactttttctcttttcacccctactctgagatttaccaagattttttctctttgaatgagcctaattttcctgtttcttcgtatgccttgtgattttttgttgaaaactggacatttgaatccaatggcacttgttttcaaaccttattttttataaaaccatcttccttttcttcaaacacatgtgccactaaatccaacatattaaccttggttgaggctgctggctggagatggggttcacaaagacagagaagatcaaggtaagcaggagatgtggtaactctggaaatcaaattctccccttccctgggttttttgtttgtttaattgttataggctctctctgtgccaaggttcaacgtgaggtgtacactcgaggtcttctcaggtttttctgatcctagtgttttcctcggaatgcatagttactttctaattttcctcatatatgccattgtttttggatgtcctagtctttaatgcctgcctcccaaaagaaaaaaaaaagagagagagagaaaaattaaggaggaggggcaccagtcctttaaatcccctggaagtcacttcagctggagagaaggggtttgaaccaatgaggggaggtgcaaaatccatgaccatctgcctctttgtctgcacttatatgatcagaagcagcaatcaatgaccagtgtacagatgcccagtacttggaagacagggtgctttttgcccactctgggtcccataggctgttcctggaatgcgtatacagctgactatcacagggctggggatgggcatgggtaactgctactgtattaagaactgacactgaccaaaagtaactccaatttacttttaaattcttcccctggaagttgcaagccttcaataggctccatagtttctaaatagttacatgtcacagattctgctaatgtaatcattgttgtggtgggaagatggattcctggttctttctactccacaatgtgctcagaatactctctcaatttctactcaactaaggaaaatttctcttgtttaccttgatcttctctttctacctttgtgaaccctacctccagccagcagcctcaatcaaggttgataagttgaatttagtggcacatttg

SEQ ID NO: 264 - DNA, 48537 bp, Homo sapiens
aatagtggcttggaacacagggcaactgctaagagtcttttgtatttaacatgggagtcacaatcacattcttttttgctaccctttcagatcagatttcccaggttagagggttctctgttctgatgtgccttctcctttcacttgccctgacacaggcacctgtgcatcagtagtcacaatggaccctttgtcagattagggttggagccctgtcggccccatctccccaggaatgtcttttgcagggtgccctaggaatctgtgaaaatgaacgcggtgatgggaatagagtaatcctctcactcttccaagtgtgttcactgatgtcatagattcattagctatggtaattactgtttctgagtgtctggggaaaaacgcattctccccactgctgggagtgtgcagtgattcagacattttggaaagcacttcagtagtatcttacaaaataaatgtgcacctaccacatctattctttattgtgtatctgttatctattatataaactgttagatatgtaaacatatgatgttcactgcagcattacttataactacaaagctctgaaaacaaactaaatgtccatcgatatactttggaatccttcaaagcacttaaaaaagatgagaaaaattataaacagtcacatgcaaagagctccatactgttgaatgaaaaacaaaagctacgtgtagtggcacatgcctgtaatcccaacactttgggaagctgaggtgggaggatcacttgaccctaggagttcgagacccgcctgggcaaaatgatgagaccttgtctctacaaaaaaataaaaagaagcagcgcatggtggtgcattcctgtagccccagcaactcagaaggctgaggtgagaggactgcttgcccccaggatgttgaggctgcagtgagccatgattgtgccactgcattccagcctgggtgacagagtgagaccctttctcaaaacaaacagcccgggtgcagtggcttacgcctgtaatcttagcgctttgggaggctgaggtggatggatcacctgaggtcaggaattcaagaccaggctggccaacatggtgaaaccccatctctactaaaaatacaaaaattagttgggcgtggcggcaggtgcctgtaatctcagttacttgggaggctgaggcaagagaatcgcttgaactggggaggcggaggttgcaatgagcccagatcgtgccactgcactccagcctaggtgacagagtgagactccagcgtaggtgacaaagtgagactccatctcaaacacaaacaaacatgaacgcagagccaaacagagaatatgggtaagaggttacctctggggaggggagtggaatttcgaagagtgaagtaaaggggagacttctgtttgttaaatgttttatcaaaaaagataaatatattatttgcatattttaaagaaaattttaagataacctagctcagtggtttttaaatgattgtacctgatgagacagataaagtgtcaggtagctcagagataagatgagctgataaaaacagatctaatggaagcttaaggtgctatctctgcaaacaagtctaagtgaaatcctttattttgccgtacatggttcacataactttactagtcaaaatttaaaattactattaaataaagtttgtagcaatatctaaagcaaagcatgaaaagataagaaaatatttcttctaaataaatttgtcataggcacatagaccaaaggaatagaatagagaacccagaaataaactcaaatacttacagccaactgatcttcaacaaagcaaacaaaaacacagtggggaaaggacacccttttcaacaaatggtgctgggataattggctagccacatgtatgagaatgaaactggatcctcatctctcacctgatagaaaaatcaactcaagttggattaacgacttaaacctaaaacctgaaactataaaaattctagaagacaacattggaaaaacccttctcgacactggcttaggccaggatttcatgatcaaaaacccaaaaacaattgcaataaaaacaaagataaatagctgggacctaattaaactaaagagcttttgcacagcaaaaggaacagtcagcagagtaaacagacaacacacagagtgggagaaaatcttcacaatctatacatctgacagtggactaatatccagaatctccaaccaacccaaacaaatcagtaagaaaagaacaatcctgtcaaaaagtgggctaaggacatgaatagacaattctcaaaagaagatatacacacggccaacaaacatatgaaaaaatactcaacatcactaaagattagggaaatgcaaatcaaaaccacaatgcgataccaccttactcctgcaagaatggtcataatcaaagaatcaaaaatggtagatgttggcatggatgcagtgagcagaaaacacttctacactactggtgggaatgtaaactagtacagccactatggaaaacagtgtggagattccttaaagagctaaaagtagaaccaccatttgatccagcaatcccactactgggtatctactcagaggaaaagaagtcatattcgaaatagatacttgcacacacgtttatagcagcacatttcacaatcgcaaaatcgtggaaccaacccacatgcccatcaatcaacaattggataaagaaactgtggtatgtgtgtgtgtgtgtgtgtgtgtgtgtatatatatatatacacacacacacacacacacacacacatatgatggaatactactcagccataaaaatgaatgagttaacagcatttgcagtgacctggatgagattggagactattattctaagtgaagtaactcaggaatggaaaaccaaacatcatatgttctcgctgatatgtgatagctaagctatgaggatgcaaaggcataagaatgatacaatggactttggggacttggggggaagagtgggaggggggcgagggataagagacaacaaatacagtgcagtatatactgctcgggtgatgggtgcaccaatatctctcaattcaccactaaaaacttatgtaaccaaataccacctgtaccgcaataatttatggaaaaacaaaattaaaattaaaaaaaccttacacttgtattatcactattttggcacatctacagatattttaaaattttaaagtattttatacagaatgatacaccaaataacaattgctttggtcatgattctaataatccactttaatttttttattagcttgtgtatattttatttttttgagacacagtctcgctctgttgcccaggctggagtgcagtggcacaatcttggctcactgcaacctctgccacctgggttcaagcgattctcttgcctcagcctccccagtagctgggattacaggtgcccgccaccacgccaagctaatatttgtattttagtagacatggggtttctccgcgttgcccaggctggtctcgaactcctgagctcaggcgatccacctgcctcggcctgccaaagttaggattacaggcgtgagccaccatgcttggccgctcttgtatatttttaatgctagatttgtcactgttcttacgtagctaagttgaaaaaagaaatgcaagttaactaagcacctgtactcagcccttgaaatcttggatccagaagaacagtctatcaattatatgattaaaaaaaataagaactataataacttttcctaaacaaccacttaagatttttaaaaatccatcatattagcttttagcatattgagaacttaaggagatgatagggaaatatttttaatattattagattattttggctatagcagattttccacatggagaatgattttaaaaatattaatttttatctggtctataagacagtagtattattcaatacatattaatatgatcgctatagatttctatattcttttggttaaaaaacccagtcaaacaacaaagggctgtcaacttttcacagtcccttgtctttgacagccctaaaaattttgcagatatcaaagatctttcatagtgccttacttccttcacattttaaatataggaaaactgagtgccagagacaacaccagaacaagtctcaagttcatcttcccctatatacaccattgctcattggcaatgaatgtaataacttaaaaactactgcatatgtgtctttgacagagacatatacacacacacacatgaatatgtgtgtgtgtatatgtgtgtgtgtgtatatgtctatatattatgaagtcagtacccttgaaagcaaacaagtgaaaactttacacattgttcccacccagcaactgtaacaatcagaaacaaaaatgtaatgaaactcaactactgaaacttgattttctatagtaagacagtaaacttaattctttaataacagagccaatcactgggtgtttgctttaccaaggaatactttttctcagtaactaagatgaaaagtcttacttattccatttggtaatatgtatggtccattgtaccgagcaggtgaaaagcaagaactggtgtatgcatcaagtaatttccccttggttatggctccttggcataaggcgatttcactcacccacacacagccttggacatgcatagccttgcagttgacttcttagaactgctacttcttataatattttgaaataatgctatcaaccctgcctcattatttcatatccacaacatgggaagagcagaatttgtgtaggccactagactatcatagagcataatgtaaatgtctttttttttctttttaattgagacagaatcttgctctgtcacccaggcttgagtgcagtggcgcgatcacagctcaccgcagcctccatctcccaggctcaagtgctcctcccgcctcagcctcctgagtagctgggacacaggtgcatgctgcaaagcctagctagttattttttgatttttagtatacatcaagtctcactatgttgcccaggctggtctcaaacttctggcctcacgtgatgctcctgccttggcctcccaaagagctgggattacaggtgtgagccaccatgcacagccttactatgtttttctgacattcagtgagggttggcattgaactcaggtactatggtttcaaatttaaacatatttactgtaaatctgtgtgtgtgtgtacaaattatatatatatgtgtatatataaattgtatatatgtatgaaactccatctctactaaaatatacatcatattttgtatatgttatacatgtagaaactgtcatttgcagctcacaggccactttggaggcatcttggctacctgcccgtgactgcccaaactgcatgtgctttctgccaagtagagcatcattttgaaatacttgatatgaaagttttgactagatttcacccatgcatgtgtatgactaacaaagactacaatggttctgacgagtccaaccacacctgggtgtcggctgctactggattccctgcgcaactgagacacaatttaaatctagatttatcaagctagaggaatccttagagaaaattggatctaaaccctcattttacaaaggcagatatggggatgcaaggagttaagtcatgtgtcgctggtcacccaggctggtgatgaagcaatggaaacaatgtgagatttgttaccttttggcctgtttgtatgtcccagtacatactgaaaaggatagtgtttgtaaacgagaggggatatatggacttggtgaaaaattcattacattttctttatattaattatgaaatgtctaagtaatgaacagaagataaagcatcaggggagatattacacataaaaatgcaaaactatagacttttttttttttttttttggacagagtttcactttcttgcccaggctggagtggagtggcatgatcttggctcactgcaacttccgcctcctgggttcaagcaattctcgtgcctcagcctcctgagtagctgggattacggacgcccggcaccttgccaagctgattttttgtattttagtagagacagggtttcaccatgttacccaagcttgtcttgaactcccgagttcaggcaatccacccgtctctgcctcccaaagtgctaggattataggcgtgagtcacagagcccggccattttcttaacgtgtttttataacctattttctatttgaaattgttatacacaattcttggccgagactttatgatctcctcaaatttttgaaaaatcattaaggatcaatttgtatgcctaattgagtgataaatttaaagcagtgttgtacaagcattcaagaatttacagaaattggaattatatttgaaaactaatttttatttaactttcattgatacatgtactactaaattatcttgggaagagttttgaattcaatcaaaattgccatatcggccaagcatggtggctcacgcctgtaaccccagcactttgggaggctaaggcgggcggctcacttgaagtcaggagttcgagatcagcctggccaacacggtgaaactccgtctctactaaaaatacaaaatttagctgggcgtggtggtgggtacctgtaatcccagctactctggaggatgaagcaggagaattgcttgcacctgggaggtggaggctgccgtgaggcgagatggcgccactggaccactccagcctgggcaacagagcatgactctgtctcaaaaaaacaaaacaaaacaaaacaaaacaaaaaattccaatgaagtattttaaaataacaatgccctattttgcagaaagcacttgaattgttaacaacagtcataggcagccagctgagatgcctccaaattggcctgtcagctacaaatggacacagtaatcagatacatgtgaagtgaatgtttgggatgctgcctggagctgaatccaccaggagaccgcagtgcctatgcgcctccctcccacctctgcagcagggctgtgtgcggcattctgcgcacctggaacataaactccagttgtgccacaggccgcttgtctgtgagatctgcaggccagctgctattgctcaaccttgcaatgggagcaacaagttccaggtgttattgctgccactgacgaccgggacgaccaagccaagtttgggtcttggtgaaaaacaattgggggggcccccagtgagggctgaatggttaagtttccttatgaggattttgtatttgacagaggcaaaacctagttggcccaggtctcttctggtccacagggccagtgatttttactaactttctccataccttgcatgccccacacctcccttcccagcctgtgagaacacagagggatgcagtctatcccactctgtctgtattagtccgttttcgcactgctaagttataaagtaaagaggtttaatcgactcacagttccgcatggctggggaggcctcaggaaactgacaatcgtggcagaaggcaagagggcgggagacgacgccttcacaaggcaggagagaagcaagtcggagaaccaggaagcaccacactttaaaaccatcagctctcgtgagagctcactagctatcacgagaacagcatgggggaaaccacccccatgctccaatcaactccacctggtccctcccttgacaaatcgagatgagatttgggtgaggacacaggcccaaaccgtatcactgtcccagtctgcccttcaaggagccccagaggaagcccgggctgtgggaggcagcctggaggctggtatgcctagaccctgcccagctgccccaaagctgcggccctgtgaagggcctgagattttaccctgcttgcaagctaatgacctagcctgccacagcttcctggatgctggcagactcctgggccaaaggcaaaggactgtattgctctgggaatgccatttgccccccaccccaagtcccccaaggaggtgatgtgtgacaacccaatttatgatgtatcatctgtatcacagctgaggaaccccaagctcaggaaacccctcgagttataagatgggctgcttctccaatcaactcatccaacctttgccctacaggtagatgatgatctttattaccgtagtcaggaaacaaatctgtcctctgcctagacaagcatccttgaagatgtccagaactgccacagagaattgcccaacgcacaccagtctagcatcccctgtgccacctggctgggaaacccactttatcaacataagagggacagagtgccctagggaaaaagagaggactgattttcatgtgagctgagcaacctccccaagttgtgaaggttgaggagcccagccacacttccccaggcttgtagacggggccagcatgcagctcggtgtggtctggagcctgctggtcacatctgtcatatgtgaggctaagctggcaagtattttgtaaattgtcaccaataaacaaaaactatgcttcactttgtgagactaacttcaataatgactgtgtgaggttttatagtgactttttataaatttctgaactattcatatttttcacgtactcctgggtcacagccacagaaagactgaggagctcttaacgcattccccacaagctgagcacgattcagactcagggtagtcaaaaacaggtgacctgtcagctcctaacaccaaagggtttctgatccctatgggaacattaataattgacacagaacaagtagaaggcagtgacacagtggtgtccaggctcagcagggtggcctggtccatggcagcagaagtgtgggtctcataggacagagctgtttctcaatcctacttgtaaagtcaagaattcgggtgtcataagagcgcaggagttggacagacctggctaaaaccctggctctaagcccttctgttaatgcaactttcagcaagttacttccatggctggcaagtgtgattacaagtgataccggggtttgctgaggaggtaatctaggtcaagcaccttatcaatcacaaggcctggtacataaatggataagcaagagctctaattaagatgagtgactgaggagctcgatgtgtgaaggaatacaggtaggattcagccttccattcacaatcaaactcccgaaaacttggcagggaaattagatggagcccatggtttggatccaacctggaccttatttttttatagtatttctaaaaatagagtctcattaatgtccaatggctactaagttttgtcctctcaaaattaaaatagcacttgccattatccagtaggaactacagtcagcattttggttaatatcctcccagtcatcttttgatattctagatgtgtatctagttatgcataagtacatatataaagtgttatataaacaggctcatcctgtatatcctattttaaaactgctttaccactaaacaattacttcctaaaatcttaatacctgttatttcttgtaaactttgatttactccggagaaatcggtctgaaacaattagcatctcacctctttactatcaggcatatcaaaggttattacattaacaaaaaaatacatcaagttgacctgacttcatttatgtaagaggtagaaaatctgagtaaagtttttttttcattaattaaatcctattttaatgtaaatcctcttataattcctcgtttcactaaagtaatcttggaatcactaaagttttgtggaagcaccacctatctgggggaaaaactgcctttaaacacctgcaaattgggttgatagtatctggttaagaggtggtatcagtcatgtaagagtaagattgtgaccgtttagtcatatttaataacccacttacataacccttgttatttaattcagatacgatgttcagcttgtatttcttgataataacccccctcctccaaaccaacacagatgtacacacccaatcagcgtgcatgactgctgactggcactctttccagtgactgtttattgagtgtcaggaacacaactgtgattatacaaaatgaagtggacaaacggtcttgcacaaatgacgtacatttcacagttaatcgtgaaggttagaaaggttaacaagttctattagtacttttcataagcagtttgatttctgaaaaatacagtaacataattttagtaactactaaaatttctttaaaactccctatcaatctgaagaacaaactaaaaacctgtttattacatgaatgctacttatgagaatttaaaatatgggttcacttcctattttccacaagtctttgacttgtttatttactaaattaacagaacgtgggatgcagttttttaagttagcaacttccttagggttactgggaagtagagtaattatgaaaaagggaacacttcaattattgtataaaagattgctttgcatactgattacttcttgaaccccaaaaagtgctatttagaggcaagggcccattttgtgcccattaaaagaaatatacaggtgaatgtctgtctcatccctctaatcatatgtaataaaattatatcgctgtcaataacagcaaagataatgatatattaattttaacagcagttagaaccagaaggaaaaggctgttatacagaaaaacatacaaatatgtaggtagaagtgaaaaactgaagaatgtggagtgtttactgtcccgttactcacacagacgtgctggattcaacacccacgctgaatctccatttattccacggaggtggagttcaccatggttcgactgcccaccagatccccaaatgtcaaagtgaaacaaaactcagtgaattctagatgactgttttacttcccctaaagaagttatctgtaaataagaaaaatcaactgatagggggaaaaaaaaaagatctgtcatttgtcaacagatggacgaagacaagctattgactcaaagagaacctgccgcgagtcttagtctttggaaggtcagacagctgcagtgttcggtcacatggagatggtgtcttcatgtctcagaggccgcattctgtaggccagacgtgtgctcaccaacctatacaagggtcagggcagtcccgcaggtaagtttcgaattgacctttggtaacatctatcaaggttgtgtatacggtcagctgaaagaaaagttatttttactttaaggacgttttcaattcagagatgttctgatatatattagcatttctatacttgtagaatttgctttagaagttatttaatattaaataatataacttaatatatgcaaagcatgttatataatgtatatatttatattaatatagtataatcatataaaattagctaaagtctcaccaaataactaaagcaaacaacttcaacaggatcactgtttcaggtaatgaatataaacaggctcaggaaagaatctccagctccttataggagcttattcctgacagcacattgctccacccccaatgctttaagactgccttaaccctccttgacgcacagctggcagtcctgggagacctgccggtgtcctatggagtaaaaaccgtggagctttggctatccctatccttaaagcatttccaatacagtgggggaaactgcaggcacccagatcacaaggcacacacccaaacacaagtcacgagattgtgacttgctcaaagatggtataggcaaaacgcaagtatggcagggcccgtgaactgaaggcaggcttcctgtgagagccagggtgacctggatgctaaaggccggagggatttgtcctggcagggtaaaggcggcatgtttactttagggagagctgtggagaaggaccaagaaaagaaggaacaaatgggaaaattaggggggcatattcagaacgttcagggaatgattgttagcgagtggtgggatgataggaaactttttgcatttttttaaaactacagtgtagggaaaagataaacagatgtagtaaagtttaagggaaacccgaacccaccaagacacagagctctgtctgaaaatggactgcagactttgttttgttgacatttaggtgttagttatatagtgtgagatttttaatagataccaataagagtaaaatgctagccttaattcaaatgctatgtaaataaagctataaacaatattctgacctatcaagcctcagtgatcaatttctttcttgtattccaaaatacagttttagccacacaaaaacattttttaataaaaaatcagtcctaagctgaacacaccttttgtgctcaaactgatcaaagataacagagaaagataaaacatagggccaaattctttccctaaaaggcaaatatacatataacatttaaaataccttgttgaggacaggttttgttgacaggacatcatacatggtttcaaatgagatattctaaaacacaagaaaatagttttgttcagtaagttaaatacagaagccaacagccttatctacacacatgggccaccagaaaccaagacattctttaatcaacctcccctccatccccgcagtggagtttctgtgggagtcactgttagaaacacaggtaacagttttaatggattactttcctctctctccttccccttttttaaattcttgcctgtttgttattcaacttcagagtggtatccagcattagaaccagaaaaggaaagtacagcacaattttgctctttaagttaagaaaacgaaacaaaaaaatcagtggagagtggctagagatactatgaaaaataggacgtttataaattacttgaaggccaaagaaaaatgccagaaccaagggaatctttaatggcaacagtttctttctatagatgaccctgcaaaggtacctcttggctggtgcggttcagacacatctttgcaggcgttctgcgatcatcaaggaagaagggatgtttccaacggtcataatttgtttgtaccacataccatctaccctgcttagcatcgagtctagatacaaaaggagagattccctcttaggctacatgccttaaaactcaaagtatatcagtgtatgcttttgtttctacttcttttgctttaacaaacctacttactcatatacatccaatgattcctttctgtctcgtgtaatcacacaaccttccccagactggttgcctcccaggataaagtaggctggggccaatatcttggtcttggtcaataaattcttggcttcttcataactatatagaaacatttaaaaagaaaaatgaaacttttttttaattttagtaaataacttcatttatttttaaattttactttaagttctgggacacatgtgctgaacgtgcaggtttgttacataggtacacacgtgccatggtggtttgctgcacccatcaacccatcatctaagtttcaagccctacatgcattaggtatttgtcctaatgctctccctcccctttcaccccaccccctgacaggccctggtgcgtgatgttcccctccctgtgttcacgtgttctctttgttcagctctcacttatgagtgagaacatgcagtgttcggttttctgttcctgtgttagtttgctgaggatgatggtgggaaacatttttagatgacttagaacggaaatgtttagctctgtagaaactaaagaaaaacaagtatctaaggaatgtgttatttatttatttctatttttagagatgggctctcactctgttgcccaggctggtctcgaactccttggcacaagcgatactcttgccttcgcctcccaaagtactgggattacaggcatgagccaccatggccagccacaatgtgttttctaaaaaaggatggtgagcaatgcctctgggaaaagcaatccctgaccctgtatggtgaacactgagatgggaagcgggaatcttaggaagcccctctaatctgaaggagaaacaaagtggcctcaagagatcatcttccacccttactgtccatgcctttcactcaacaacagaacaaagggaaataatattacagtatgtaggacttagagaacagaaagtaaaccttcttgaaaattaggactattaaaaattgaagtgggttatcaaagaacactactaacattaaatcttattccctgggaagtattaaaaataggattgatgcccatttatttggacgcagtgctggctgaatgaaggaaaggcagttttgctattgtaagatttctataccaaggcaagatataacttacaggttaatatgtagtacattttgtatttatttattttgtttttttaagacagagtctcactctatcactcagggtgaagtgcagtggactgatcccagctcactgcagtctcgacctccttgggctcaggtgatcctcccacctcagcctcctgagtagctgggactacaggcaggcacgtgtcaccatgcctggctaatttttgtattttttatagagacggggtttcgccatgttgctcagactggtctcaaacccctgggtgcaagtcatctgtctatctcagccacccaaagcgtgaggattacaggcataagccactgtgcctggtctgtactaccatttaaatgaagattttactgtatgactgttcttttgtgtgtgggtcattttttttctgtacaccaaaaatattcataggtgcctttcataatgtcagtatccctagtgctttttaagtaattcatttatttgctataaaacacacagtctgcacgaagaaaacatgagtaattccacatgagtgtcagaggttcacctaagaaattctgcaatagttcctcaaaggattaagctggagcttgacaaatatttttattttttaatatgagtaatttaaaataaatatttaatagtaaagcaacgaaacactttaccttgtgctattttccagaactgttctagtgaggaaccctatccacatgacatctttctttcccagaatccattctagaatacctggaagagatgaacacaatgtcaggaaccggaagaggtgacactatgtaaccagtcaggacccggaagaggctggactatataaccagtcaggaaccagaagaggttagactttgtaaccagtcgggaaccggaagaggttggactttgtaaccagaaggcacagtccagccttcctcataaaaaagctctgagattcccatttcacttgagaatgctctacttacccagataaccaccatttatactgaaacgttcattcagtgtaagactgaacagtccctgagaaaaagacaaagcaacgaagtcagaaacatcaaccatgcgctttaaggccctgtcgctcactgtacttcagagtgggatataaaggcctagcttgggtaatggggaaggcaaaaataaatcaaaaccataaaaggctttttaaaaagttcaaagcatttttgattctagtatgtgagataagtaggtggggtatcactggcaacgctttttggacaggaaactgaagggcagagaatgaacgcctgacttgcctaagtgagcggaagacccaggactagaaatcagattgtgactcccagcccttgacacccagccacatgctctttatcccagaagaggctcagaaacctccgtttcctttctactcttctctaccacgagatctcatacctatgaagtgacaagaagtacaagggggtgaaatggggcttcatattccctttaggtcctcatattcttagatttcaacttttacataacggtaacaggacagaaggctacctgtataattatgtaacaacagactccttactggtttgaatcctgttaacatgcccacatagccagcaaagcttgaagccttgaagacagttttgttgtttctttggaaatccaaattcactgttaaaggttttagttgctcagttatgacccaggtatcattatttatgttccacctataaaagacatgtttcagtgacatttcagaaacacagtgatagtaatgatcaacatgatgatgagggccaggcattacactaggagctttatttaccgagtcaccacgatcaatcctaacaagacctttacaatatggtatatttattctgttttccaaatgataaaattgaggttcagagaagtcaggtaactctctcaatatcacacagcttataaatagtgagcctcagattcaaacatagaatgctaattacaatattcttattttttcagaaaggtcaagatggacacataaaatagaagagcatgtccctcttgtctcagcactcaagcaatccatttatcttcacttatgatcacattttgggtgtgacttgggacttacttatcatcaatataacacaacctactcttcctacagaccaaaacagttctgtgttcttttttttttttttttttttgagatggagtctggctctgtatcccaagctgcagtgcagtggcgcgatctcggctcactgcaacctccgcctcgcaggttcaaaaaagtctctgcctcaggctcccaagtagccgggattacagatgcccaccaccatgcctggctaatttttatgtttttagtagagacggggtttcaccatcttggccaggctggtcttgaactcctgacctcgtgatccacccgtgtcagcctcccaaaaagctgggattacaggcgtgaaccaccatgcctgaccctttgttctttacttacccaagaaatactccaaaatccatgtttctcccatgtattagatgacctatttgaaggtagacagaagagacgtgtaatagcagttaagattctaaatcaaagctggacaattaattttgattaattaatttatttttgagacagagtctcgttctgttggccagactggagtgcagtggtgcgatctcagctcactgcgacctctgcctcccaggttcaagcaattcttgtgcctcagccttccacgtagttgggattacagacatgtgcgaccgcacctggctactttttttttttttttgtatttttcttttagtagagaaggggttttaccatgttggccagtctggtgtcaaactcccaacctcagatgattcgcccgcctcggcctcgcaaagtgctggcattacaggtgtaagccactgtgcctggcctctaattttgattaatttttattcacaactgtttcttcaaacaataagaagtaagaaacatcctaatatcctaagccttcaccagatgggactgttgtcaccgtctatctgccagataaccccacaaaatctgagagcacgggtttccaggtaagatcagaatatgggaaaaggaatcaatggtcatgttttggttcactatcacatggttctaccaggacacagaaatcggagcctcaattactgtgattcatcaaatgtttcccttcaggcatcatcccctagagcaggacatctcaagggtaaggtacaggcagatttatacccagagtataggtcaaagatcagggtgagttagcgaagttgtcctgtgctttgtactctgggaaccagtcaggaaaaatatgggaaagtgaggctggtatccattgggttgcctggctgggaaaggatgggagaatgtgtgttctgggcctcaagaaaaggacagatgtcatgacatacacgaagataaggaagcacctcctgcgagcacttccatcaaagcatgtagatgggtagaagtaaactatgaggaagagaagaatgtttctagccctgcaacatttcttccaggttttttgcatgtctgaaatcaactttaataggcagtacagtagtctgaaaataaggaaaattttcagtacaatcacaaaattttaccaagaaataaaaagctgtatgcaacatacacagaatttacatagcaagcccaaatttcagaagttctaatttcatttagaagatttttctttatgtagtgcttcatgctgcccaccctccctcagcgcacaattaccttttttgtcttctgctactattgaagtacaaatggtaaataattcataaaaaatattgaatgaaataatctctcctatgagaaaagaaaattttgtgttaatatacagaaccatgacaatgggagaaaaatttgttttaagaaaaagtttcagtgttttcattgtgtgagtgtgtgctttggccagtggggctgtgctggaacggccggctggaggtggttttcttccccagcctggactctctagactcaagatgaaacaagtcaccaaggaggcagccttcgggcgagctgaacatctgggcaggttgcaattgttctccaacatcacatccaaaatgtttatcaacatgcttcattttgaattttcttttgggagcgtaaatatgatcatttaatacatctggctcttggctgtttgctggacatatattttgcccagatttttaaagtgtgactaaaatttctaaggtgaaaaaggagattcaagaactattaaaattagtacagagctgccaagaaactccattctagggtattttattttttgaatattttcccaaaatgtataatactgctatttagcatttaattcaaaagtaggcagcacattgtatttctgtcccatttaacattaacatgttaagctcaacatgtttttttcacccaaatccaatgtgtattttatttccattaaatttctaatttggtgaaattctagttattttattatacatttataataatttataataattatataaatttacaccacttatacatcatgttattcttcttaatccataaggtatttctatttggtattgagttgctagagttctttacataataaaggaattagacttgctttccataaaggcagcaagtacatatttccagtatgctatcttttaaatgagttttttaaagaagcagcacacaaaactagccacttttgttgataaatactactgattttcacaaattctcaatcatctcataaaatgaaggtactgttggctatttaaaataatgacactactgctttgctagcttaaagataaaacttttggggtcgtggggaaaatatttttcgttacatgccataaagcttaaattgaaattttaaaaatagcttcccaaaccatcaatatctaagaataattttaacgaatggcatgtgaggtcttctccctgaaaataaaagatactgctcagagaaatcagtaacttaaataaatattgagaaaaacaaagttggaagaattataccacctaatttgaagacttactataaagctttagtaactgaggtgaaatagtattgatataagggaagacaaaaagacaaatatgtaaatgaaacttaattccccaaacaaaacaacatatatacaatcacctgattgtatatacagatacacattgtgtgtgtgtgtgtgtgtgtgtgtgtgtatatatatatgtattgtatatttatatcaaagacaccactgcaatttgctgaggaaaggatagccttttgaattgatgctgtttaactaactggatataccacatgagaaaaacctgaagcttgacccataagtcatagcatatacaaaaataattcaaaatagatgataggcctaaatgtaaaaagtaaacattaaacatctagaagaaaatatataagcatatatatatgactttggggtaggccaagattccttaaatggatacaaaaggcactactcataaaagagaagactgagatattagacttcactaaaattaaaaatttctgttcatcaaaagacaaaagtaagagaataaaaatgaaggtcatagactgggagcagatattcagaatccatatatctgacaaagggcttatattcaaagtatgtaaaaaattccttcaatctaatttttaaaagggcaaaagaccttcacaagcccttctccaaaagaaacaaagaaaaccaaaaaaaaaaaaaaaaagtcaataaactgttcaatctcattaatcatcaaggaaatgcaaattgaaactaaaatgcgatactgcgacactcaacaaaaaggctcaaataaagattgacactaacaaaaaaaaaggaaaaaaaaagactgacactatcgagaggagaattatcaagaggagaaaactgaaactctcatactctgctgattgtcaactgctggaatcactttggaaaactgtttggcagaatctataaggctaaacacacaattactctataacacaacagttcacttcctaggtatatatccagaaaatgagtacccagacacccccaaaatgtactacaatatttataattcctttattgttaatatcacaaatctgaaaaccacccaaataccctgttgatacaatagcacaccacccataatgaaatacaagaaatcacacaggacagttcatattgttcagttctatttatacaaagttcacgaagaggcaaaactaatctatagtgacatcagaatagtgtttactggaggaggcagtattttctgcaaaggggcatgatggagcatcgtggagtgctgggctcttccgtatcttgatctgagtcatggctacatgcatgcatgcatttctgaagcttcactgagctgtatatctaagacctgtgcacctgtgctgtatatctaagacatacagcacctgtgctgtatgtatatcacacctcaatggaaacttgtaaaagaatttaattacttttttttttaaagcttctaagtgaactttacctaaaggtatatcagtaacagcggcaatacccttcatttcctcttcaaaagggccaggaaagttgccaagtaggccaggctggaaaacaaatatattaataaaagcatttaacataataacaataaaaaatatataatataatataaacaaatataataaaagcatgctttgaaatctagttcttggacatataattttttctagatactgctatcataataagtgataggaattattttttaaagcatttttacatcatgtagttataaaaagattctatgtaatactgaatattgggcccctatacagagaccagattctcagattgtttttcctgccttatttttccatcattctccagagaaggcaggaacgagagtaattccacttggatgacctaacctgacccacaccacaaaaacatcataacaagcactccttatctctctgcacgaattcaccctctagccactggcatataccgttcttaccatttccttcccacactcacagagataaacctgcactattctatccatagccctgtgtcatggttaatggctgatcttcagctaagatgaagtaactgcattcttttagcaaaccagagacattgagcaaattcagtggtggacatcatatatttattctcaatggcaactactaacatccagatcacaacttaagttcacggccttttgctgagataatctgcttaaaattcacgaatctcacttttttaaccaacttggtaattacatgtaatgtcacctaaacatattttttttctccctaggaactcaaagcattccccaagtggaatgttccagccatttaacaaacaaatgtgacgtaatgggtatttattaaacacttattacatccaagcactatgctttatacacagtatgtcatttaacccttacaaccaccatatgaaatatatattagtaattattattctccctgatgagaaaactgaggtttcataggttaagaaactttccctaggacacaaggctagtatgtgactgatccagccttaaaacccagtattgtccgattccaaggcgtggcacaaaaactctctgcaatgttgccctccctgataacattcagagtagaggggagattaaggcatacggggaacgtgggggcctcatcctcttttgctcctgccagcatttttttgttttgaggaagtccggtaagtatgaacataaaggatagcctgaaacaaaagctccgagagcatgcacgtgagggataatgggtttggtgcttggcaggtacaagtgtcatagggaggatgtggccacagcactcagccgctagggcaatgattctcgaccacgggagatttggtaacatctaaggacatttttggttgtcacaactgagggggtgttaccagcatccagtgggtaagggccagggacactgctaaacatcctgcaatgcacatgacagccccacaaaaaagagacacccaccccaggccgggcatcctgagctgctaaacatcctgcaatgcacatgacagccccacaaaaaagagacacccaccccaggccgggcatcctggaatgtagacaagcccacgacaaagaaatatccaacccaggccgggcatggcggttcacacctacgatcccaacactttgggagaacactttgggaggttgaggcgggaagatcgcctgagcccaggagttgggagaccagcctgggtgacacagcaagcctccgtctctactaaaaattcagaaaagtagctgggtgtggcggcacgtgactgtagtcccagctactcaggaggctgaggcagaaggatcccttgagcctgggagatcaaggcagctgtgagctatgatcatgccagtgcactccagcctgggctacagagtgagatgaggtctcaaaaaaaaaaaaaaaaaaaaagctgcccaaccccaaatgtcattaatgcccaaaatctgccatcaagagcaatgaggatccctttaacagttctaggggccaggccctaggtgtttcattggttctgcgtcaacaaaaacggggctgagaaatggagtcttcctgcatgatgaggatgaaaatgaaatggtttggtgattgcacagaaacactcagcccaaatgagtttcagggtcagagctactgaggaactctacagaataaggggccaggctgagtatgtcatttgctcatatctacaaaaaaaaaatctctggatgtccctgagacacttaagaaaaaaaaccaagtcttcaatagtgaactcactacataaagggaaggaaataccacactcccagatgaaatatggttatttgcccaatgtcgtaatgtagtcccatccccttttacgaaaccataatttgctatgctgtaaccctaatattaccaattccccaaatttaagtccctctgaagttctgacagtgagctagattcatgcagatttgcccaagtccctgcgaagaggttgctgaattatgcctttaaataaataacagcgcattttctatgtgcttaacatttattgtgagaaataatatctcttaccaatttttcatccaccacctgcataatttttccacttggcacgaatgtatttatcatattcttcagagaattcactataacctttagctgaaaaataaataaaatgcttactaaaagacataatgaaatgctgtcaagattaccttttggcttacccatatgtagctaaaagagagtgctatttgacaatttatatatatattttttaaaacagcatctcgctctgtcacccaggctggagtgcagtagcaccatctcggctcactgcaatctctgcctcccaggttcaagcgattctcctgcctcagcctcccaagtagctgagattacaagtgtgcatcaccattcccagctaatttttgtatttttttttttaagacggagttttgctcttgtcgcccaggccggagtgcaatggcacgatctctgctcaccgcaacctctgcctcccgggttcaagcgattctcttgcctcagcctcccaagtagctgggactacaggcatgcaccaccatgcctggctaatttttgtatttttagtagagacggggtttcaccatcttggccaggctggtctcgaactcctgacctcgtgatccacccgcctcggcctcccaaagtgctgggattacaggcatgagccaccgcgcctggcctaatttttgtatttttaatagagacagggtttcaccatgttggccaggctggtcttgaacttctgatctcaggtgatccgcctgcctcagcctcccaaagtactgggattgattacaggcatgagccaccgtgcctggcctcgattaatacattaatacagtaagtctaattttatctttaaagtgaatttgattcttaattatttacatgaagggagatgacataaagggaaagaaacaaaggtaaagtttacaaaaaagaacaaaggctacagaggaatgacctcttttcctctgctgtcacttaacgtatagggcagaaaggtatcaaaagcacaattttaaactattctgtgggtaatttcatgaagtgttcttttaaaaatacaataatatttaataaagttagaaataaaagatttaatatagaatctccacggtccttggggggaaaataaataaataaaataagaaatatggccgggcatggcggctcatgcctataatcccagcactttgggaggctgaggtgggaggatcactcgaggtcaggagtttgagatcagcttggacaacatggcaaaatcttgtctctactaaaaatacaaaaattagccggcatggtggcaggtgcctgtaattccagctactcgggaagctgaggcagggaaattgctagaacccaggaggcggaggttgcggcgagctgagatcgtgccactgcattccagcctgggtgacagagtgagactctgtctcaaaacaaaaaaaaaatcaatcaataaataaaaataaagaaataaaataaaaaataaaaataaagaaataaaagatttaagcatcatagcataccactggtgccttgtcaagcatcaattcatgccatcttttgtagggtggtaagtcaagatttatggtgtaccatggaactgcacctctgtacctgtaatgagaggtgtatcatcttgaaatgatgaaagggttttttgtgagggtcagttagatacatctataagaatatatgagaggcaaagtcttaacagcagtgtagaatttggttacccaaaccaaaatttggaaagaaagttcattctctacctagtgcttctaggttgagaacacaatcataagcggtcacagaaatcctggaatagaatgatctagtagggaaggttcatgtgaattggttttctatgaaaaaatcaactatggcttaagagctctaacctgattatcactgacgggaaatacctgccattttttttttctcctaaatatctgcaaagatttagtctgggctctagacaattctccaattggtttccagtttcagaattctctctcagagagtgtaacactattgccaaaccaatgtctccagtgttgccttcaggaagatcaccttttaagccccagatggcaacatgtattatcttcccacgatcagcttcaagaaccttcatgattctgtcagccatcctaatcttccctactatatacctcttctcttctcattttcctggacaaagtccaagcccaagctgtattctgtcatatcctccaacttcctactctttaacttacgtgcagcaatttctgaggatatagcaacatccagtcacttatcagtgaagctgggccatatttctggtggatgaattctacaactatttttgttgctataggaacattattttctggccctggttactaaactgaaatagcttttaagggtgtgccagttagtggtttatcagtataaacctatgcctaaaaataaccatcatctgttccactgatctgctcctgagactggcagggtgactctggtatgtgccacaatgataccagtctcctaaatagaaatgttatctagacttatgtccatagctggggatgggttattacctaagtcatgaactgtggttctatttatatttccactatcataaataattacttggttctctaaataatgctgtgtaacttggggccctggtatatgtatgaggttttatgaaactgttaactagcagacattcaggttgtgatttagacagaaaagtatattcgattttggaaatgtacatttaaacaaaatcatagtgaacgaattttgttcttctcaaagcattttcaagttccccattttcttaggagctgatatctacatgaaatgctacaatacttatattctagaaaaaaacttttcatcacaacaaattaattccatttctgacagaccataatttcacatgtaaaattttgtcccacaattcagtaagtaattattgttccccatattatgggcaggtattactagtctcccctctcccttcaactgtgcatttagatttctatgtctagtagcaaagataactcagtggcctgttggagatatgcatctcatccctatgaactccaatcagctgctcctcacctcataacatccaaccaatcccaaatcatgcctctatacccgccataaattcctgattctttttcagcctagagtcctgggtaggttcatggatctcagagacgcgatgagaggggatgaacacaacacaacggacaatgaagggattacaatgaagtggggatgatgagaccccacaaacctctctaccatcaaacctgcactaattagaatttgagagaactggttaatctaataaaccaaattattttaatgactaaagcttagccataattgcacattttacctctcgttaaacagttttctaaaacatttcagtatttaacttgtgcgcctccatttccccataagaataaaagagtatccaccttataacagcagggaagacactatatgaaaaatgcaaaaataaaaaaaacacttagcagcattggtattcaatcaacagtagtcatcacaatttattttcctacttcactgcaaacaagaaatatcatttcatcatttttgagacttagtgtttgcaatgtccatgccattcataatatcagcaacatcacctgaacccacatggctacctaggtggcatggaaactagtccaagtgacacaacacacacatatacaaataagagagcaagtgctaggcatcccgtgagcagtgggaaagaaatgctgaatgggactcagatggactcaggggtgatctggctatcagttcctttatcttcagcattgatttgactagtcatgctggccaaacaggttatctttttcttccctcatatctgcccatggatgctgcccaaatctacgcacttaattgaaaaggatgatctcaaaggaacagaacgtctgtttgtcattcaaaggtacataaataccacagttatctcctaaatctcaagatccattgatagagttgagagaagagaaggataagagcaaagccgaggctttttgtgtaggaaagcaggctagtgagataaaaagaaagctagcgaaaaaatgaaggcaaggaaagaaacatacaagttatgtccatgtatacacgtgtatgtgttttggagtacatatgtatgtatacatgtaggtatgtatgcacataggtagacacacactcacatgcacatggcaataagagtcagtaaaatgcctaatcaggaaaggtttatggtttgcagggcattcaatttatagacacatgtaaagtgcacctaaaagggagtagaaacggcctcaaacatggaaggcacctcattaaatgttcaatgaattggggcagtgagaccaacagagagacataatcaatcagtaaggcagacatgtcactgaaggccagaatgatgccagtgatgacagaaaggaagactttcagacagcaggccattgaagaaagagctggaatgaacactggccccaaacaacatccaaactggttacctctaaattgcttcctgccaaatactggcctctttctacataaaggcgagtaagtcaaaagaacttagtttattacagtttcacgctatctgggacagaggctatttaaaatacatcgtttagacaacaacagtacaacgtaagtaatttggaatgttgcacgaactgaaaatgtcatcttgatatcactagatagagttgtactgtttccccctacaaacagcaggctactttcagcgaaagggcagtgtaggagaaaaagatcaccaccccctatacctgttccttcttttctctgttctgtacactctgaggggtctgtgagctgttattatggctttctcacaggcccatttaaacactgaggatttggaaagaccaaaatctagactaaaaatattaatgttaaacacactgaatcatgacattggtcctcctcttaggtgttccaatcctgttttgtcctcgacagctttgttgtgccaaggtttattttgagaacgtttcacatatgagggcctatgcttttttgttacaatataatttggtggtttatatccaggcaccatagagaatcacaggtcatttcaaatacagcccttacatttgtcaaagatgagaaaaacccttcatggtagacaggagaattgagtggagaatgaaaatcctttcctttttttttttgagacagagtctcactctgtcgcccagactggagtgcagtggtgcgatctcggctcactgcaagctccgcctcccgggttcacgccattctcctgcctcagcctccagagtagctgggactacaggcgcccgccaccacgcctggctaattttttgtatttttagtagagacggggtttcactgttagccagcatggtctcgatctcctgaccttatgatttacccgcctcggcctcccaaagtgctgggattacaggcgtgagccaccgcgtctggctgaaaatccttttctttccgatgattttgatagtctagcgacgggcatttgaatcggaagatattttcatatttgtccaagatctcagccaaatgcataataaacaaatctgagaaacaaacctctgtctcggaatgggaaacatgacttaagattttattcactatcgttcgtttatgagcaattattacatacagaaaaaacttcacaaaggtcaaagggagttttgatcatctgatgtttactcacgttggtcctgaaggaggataggttgattttctgcagtcctctgtccactgaaaagcaaagaaaattaagtttcagaaaataacaaatgcttgccaacggaataagcaatttcaaaagtagttaatctgtgaagacaacatcaagtctgatattgctcttttatacgtttcaatgcctcttaaaataagtcttttctttccaagaaaacttctaaaatcctaaaccattaagtggattttcagtttcaattcaatttgtaaaagtgctaggtgttataatttggctctaatatttcaaatatattgagtaacgaacaaatgtaacaaagtagatggaaaatatttatgttagagaggctgacttagcactaaaagtaaatgacctgataggatgtattatctgcacttaccagccatgtgtgttgcaacctgtcctgggatttgcctcccaaaccagattttcagggcacacagcacagggcccttcatcatctttccatggtaacttaccatcccagcctcatctcctgacactccccttagtatttatagccatacgcaggcacttcctatcatctctcacccttccatgcctgtgtctgtgctattccctcttgctagaatgccttttccccacctggtgaactgctggttctaacttccaagattcagttcaagcattttctttcttgtgaagtcttcatctatcttccatatgaaaatattcataccctcctttcctcccacagcatttgtgcacactctcatcaacatgtttatgacactgctttataatcatctgtttgcgttccttgtcaataccagactctgcgctccttgaggtgaggacggcccccaacactgacgtcactgcctgagacaaggaatgaacagactcttttaggggaagttgtccaagcttagtggcaaaatggaaccttctcctaaacttatcaaaaaaagtccacacagatttatgattcttttgttactcattcaacatatcaagtgtctttatctcctttcctctggagaaccagttctgtgaaagtaaaataattgttttaaaaaagtacaaatccaaaataagataaagtagagtaggtaagaaaactcttggaactgtagcttgagctcagaaaactcttggaactgtagcttgagctcagaaaactcctggaactgtagcttgagctcagaaaactcctggaactgtagcttgagcacagaaaatgtatctgctggacagctgtgtaagaatggaggtctagcaccttgttttaacttttgataacatggggaatatataaagtaggttgacattacctgtgattcaaacattagctgtcaaatttgccttaccacactgtaagtttctcacatatgtctggctttgtctggtaattttgcgttgaattcattaagaaacaatatcaagtctgtagcaaaagctaatttccaaagccattcgtgttcagtaatagtggctgggggcagctcgtttagaaaaacttcagtctcaactgtgaactcaaagactgcaaaactttacagctagcaagctatctaatggctctgtcacaagagacatcaggatatccggcctctatttctgataattcacagaaatgatgacggttatatccacaagagcaaatgaagctcatggtttatattgccggttcaataacacatgtgagattccaatattttccacaaaatatctgaaaaggaatactataataaataaccatgagctttaaacacctcgcatgttcacaagttttgtgaatttgctcaactccgcctttttctactcacaaatatttttactactgtcaatttttatagatcttagcagattccattccaggttatactcaatcattattttctcagcttcttcgaaaacatcctcgcctgtagttgttttatacagatgattcagaggctaactcttcagtcacttcaaacttggcaatgatcatctaataaatatcaacaactgatcagttatcggtatgttgacagtcaagaaaaatcactcaaaaatcacatgctttgttctttaattgatattgatgttcttcccaaagtccaggacaagggttctcaatgacatgtaaaataatttcattttccctggacacaatacttctgctactacaatcgaatacaatttaggtaatccaccattggtaaatggctttccttattttgctaataaatgagctacttagagacttataggggttgcaacttaattttactttgtaaaatttgtaaataagttctgctgtgaggagatactccgctttacattttcttgtttatctgaccattgttttcctatgagttgggaatactgtgatgggtacttaacccaagtgcttaattttatgatcatgttgtggacttaagaccctgctccattagtgacttgtagaaagttacacagctggtgacagaatcagagtcaatggctttccctgttctatcaaacagcttcccacagagataataaaaccaatgcctcaatttaattcctaacagaataatctgcgcgtagttcagggcttctggtgatcactagaatcaactcggcaaattaagtgaaacgtaatgactcctatcccttcctaataatgacatttgcacgccctgggttccaaagccaaaataaacatcaaattacaggcacatttcttactagacaactgtgagcaaagttgaaaatgctctgtctagtattaggagagaatgtgacctgccccagaggtaagaactaaagagcaagctagcaacaatacatgtggagtgagtctgaggttgataacgactcttggtagcaataaacaaacgtgaaattggcatagaacctggctgcaaggaaataggataagtgtgacagaaaataagaaagttggcagctatgagactacagtatttcaggggctcacatggcatgaacgcctaagtcgtttatgcaaaaaggttagttttaggggtagggtggaaaaaagagctacttcctccccctcaaaaaagaattctacagggagacacagcttcaaaacccacgagtagccctaaaacagaattataatgaacttacttaatgttatttaaagttccttactatccccaagtttataaacagtttaataacagacaactctattaaggcaggtaaaaacttaaatagatgataggtaaagattagaaacagatgataagaagagagattatgtggtctggatggtatactatgtacaccctatcacaggaaacaaaatccaacttagaatcaattctctctaaccctctccccacagtacctctctttctctctctctccctgcccttccctacctttctccctgcccctcagtggtctcctaagagtgaagataagtggtaaaaatctgatatttcaatgcatttgaaactctctgggccaggcatggtggctcatgcctgtaattccagcaccttgggaggctgaggtgggtggatcacctgaggtcaggacttcaagaccagcctggccaacatggcgaaatccccgttactactaacaatgcaaaaattagctgggtggcatgtgcctgtaatcctaggtactcggaaggctgaggtaggagaattgcctgaagccgggaggtggaagttgcagtgagacgagatagtgtgactgcactccagcctgggagacagagcaagactccatctcagaaaaaaaaaaaaaacaaaaaactctctggaaagtgcttttaaaagactgtttgggtcagaaaattctctaatttttctggttatttgatagaaacttaagcctctttgaatgtcctccccattcattaagagaaattaattacagagctactgaacacaacattctaaaaaaaacacaaaaatataaagagaacattaaggtctcaatgaaagcgccatacccttaaaaaatggcataacttgtacagctccttaaaatatttgagcccgaaagaattaggagaccctcaatgaaataatgtatgcttctaatagtgaattttaaaagtccagaaagcccttgtgtgcttgtcttattgaaatactcagaaagagacaatgaaggataatctaaaattacatacctcatgtcagttttcatacccaccagaagccaaacaactctagccagacaatttttcattcattcaattcttgaattcatcaacaactattttgcagacaagtttttcctataatgtcctcttatgtacaactcagcagaaacactgaatacaaagaggcatgtttcctacgtgtacaagaattcacatgagcttgaaaatgttttcacttgtcttctgggctttgatgggatggcatcctattaagctactgatatttaggtcaaaggaatgtgaataaaccctccatgagaggaaggacctcatctatctcattggctgacgcattcccagcgtttaggagtctggcacatagtaggcaagcagtatttgttgaataagtgaatggattacacctgtgtgttccctctttgggagaagtagggaaaagcagatgaagtgcaataaattcctaggccagatggggtctatgagatttctggcaactgcgtgaaaatcattgctaaagctgattcaatagctaatgtcaacaatgttgacatacgctgttaactagtatgagaagctgatgcataaaaatgagtttacaagtttactttggcaattaattactaagccattacgtttcatcttcgcacatcttatgaagtgggtcagatttattacgcagagcagccatctctcccctctagttcctttcctgccaatcacacttagcctaccgcaagctgttttctgcccccaacactgctccagtcgaggtgaccaatgacctccagttgcccaacatcataataccactgacatctcaataatattcaacatagttaacctgtcccagtctcttccctgagcttcctgttccacttactctcctatttttttgtttttgttttctgtgacgaagtttcgctcattgtccaggctggagtgcaatggcaggatcttggctcactgcaacctctccctcccaggttcaagcaattctcccgcctcagcctcctgagtagctgggactacaggcgtgagccactatgcccagctaatttttgtatttttagtagagacagggtttctccatgttggccaggctagtctcaaactcctgacctcacgtgatctgcccaccttggcctcccaaagtgctgggattacaggcatgagccaccgcgcccggcctgtcctgttttaactttggcaatttctcctcttcttgacacatacatgtgcaagttacttagcctttgcctagttctcttttcttctctttctctatcctatttctaggtaagttcatctgctccaagggcttcaaatataatatcattatgccagtgactctcagtgtctctcttctgagtgccagtccgagtggcctgctggatgcctctctgccacctgaaatttaacatacaccccaaatgaaaacgatcctcattctttagcccccaagctttcccctccccatgtttcctggaacggatgccaccattcgcccagcgaagcacttcagcaatgtgcaggtcacgctgacacctcactccctcatcctcacccaacgattccttcagctcattcgccctcctgatttttttctagaacatctacttctctccctcacccctggcgccaccatccttcaacgcaccctgttttcttttctggactagtctcctcatatctacccttgctgacctccaatccagactcatctttttaaagtgaaaatgttatcttgtctaaaaccatctaatggcctcccattggctggttccagatcctcccattttttaggataaatttctgaatccttaataagagtctacagaaccctggatgatgtcatctggcgctatctctccagacatttcttgtgccactgtcttcaccatcatctcttaatagactcctaaaaaattcaataatgaagaataactcaggaggaccttcacataggaatattgtgaaaagcctcaaaaacaaacacacaaaaaatccttacagatgttctaaatcaaatgacttgtttccaatttaaagctgcttctcattattcatatttattgaaagtacttttgaaatatcttttgttaccatgaggctatagtttatcatataatgactccagttgaaaaactgcttattcttctcagagaatgaagtcactaaacttctgtaaggttctaaaggtccttcagtgcatggatcccaggattttccaggccagtaaaaaaaaattaatgaggccttggcacaggagggtccaaatttttattctgccaaatggagatgttaaaacaaaacaaattccatgcacataacatctacctctgccgttatttttaagaacacgtttgcaacaatgaaaacttgaagtccatacaatcagagtaaagattaacattctaaattaataattttagttttgcattcttatttttccagtttcattgaaaacctgtgaaaacagcttcccaaagtgacaccagtggccagactagactttgataatcgctgttctagataagaactattatatccattgagaggttgttaattcttcttctgaaaatagctatcaaaatacttttgctagaataaataaagctattgagaaagaagaaaaaacagcctccaacacctgaaactgctctgagtcccacagctatctctcaatattattacaagccgatctgacactcacagccaggtaagctctgttttcctcctggacatcaacaatcccacagatacctacgtcggataagattattctgagacatgacacaccaagacaaagcaatgccacttgaagattttctctaagaacagacaaaaacaagggcacctgcaacgcacaaaacaccaaacatccccttctcgtgctaaacagaatggctgttccttctttactcagtcagaattgccccaccttctaacagcattctatctacagcaaagcccggttcctcagtcttaccccaaatcatgcaaccgaagttcaaattctgtaatgggtttttttctataacctaccgtccgtcgctcatggtgtgtggtctcctttgcctcaaagaacactaaacccaatttgttcagcttatggtgtgttcctggtggtctttcaatgaagggccctgacagtatcaaagtatcaaagtctctcccaattcccataaaaccaactaccgtcaagcaaattaattccctacccacaatggagcaattttattttaaggcctttaatcgtgtccacatacatgttctgtgtattttcctattacaggaaaaactgtatatactattctggattctacttttatctgctgaacattatatcaattttaatggctaaatcatatcccaccatgattttaaagaatttctccttacaggtataaaagaagacaatgcacatcttgcttccactttcaataacctacctaaactattcaagaccatcaccatctagcctcaggccagatgcgccaggttcctacttatccgattctgttggcaaagacaaacgcagtctgattgctttataaagaaatgaattatgaaagagtactgggcgtcaagaggctcggacgttacgcatgttcagtaaacaacagtgtaacctctggctaaatattttctcactctaggtctacttcctcttctgtaaaatgaaagagtcacgctcgtccctcactgtctcttgcagttaggaagtccgtagccctgtgacttgctcgtgggaaagagccacgggacaggcgatcccatgacttgggtgcaaaaggccacagggggccctttggggcctgctctgggctgctcgcaccgcccaagcttgggaccactcagcgtttcccacggccctgcagtatcctgggctgaactcctgaacttcttcgggagaaagcacctgaccatcaggcagtctgtccttgattgagtaatgcacacaggtccaccggaacattttatttaaacacttcaaaatgcaagggcctggaactggttattcaagtacactcactcaaatctaagaatgtgcgaatcacacccaggtatcctgcagagactaggatttcctttaaaggagttctagttgcaggtagcaccgaatctaccgaggacggggttcgccagcccgctctgcacccacacccctgtgcacgaaaccacagacccccgtaaagaagctgcccagcacgaggtgttccttgtacccgctcgcgccgccacacctgcgcctccatccgcgcccgcacctgcacgcccctctctgcgcctcggctcaagctcactcaccggcggcgcgtgctgcgcgacggcacagctgacggcggcagccaggaggactaaggcgacgcaactccggcccggcatcgctctagcagccaacgccactccccggactccagcagaggcaaagaagagccggctgggccgggggcaggccacgccccctccgccgcgtgacccgcgacctgggaccgcaccattccaggcagtagggggaacgctcggaggaggcgggactgggaggagaggacggggcttttcagtgccacgaaaagggtggcgtagagaaagagagagagccttccaggctacctgcagaaggagagtcgcgatcgcctttggcgcgtggcgtgatccatccccctcccccaccgcgggcaatagtcggaccgagccggagccccgccccgtaggtggggccgggagcttcacccgtggcgcctcgatggggcgcctctagcaggcgggtgcagcctgtcccgcgtacccaggcgtcctcggtacccacgaaacggatccaaagagtctcaacactaatgtaacatcccaccctgacccatctttgccctctgagaaaagcggcccgaaatgagttgagttattcatccccaccgcggagtcagggacaaggagcagttgagtggccgaggagtgagagagaatcgaatccactcgggtcctccaagctgttggttacccacttgggctttcacagcaaagctgccaaatcccagaattgaggcctcggtgaaaagcgcgctgagacttgggtaggaggcccggtgggacccgcgagctttctctcccagcccgatgcagcagttcattaagcggctgtgtttcctcctaactggcgaaggactcaggtgggcggagcagagctcagcttgggaggaggcggacgcgagtagctcggcagggggactcgcttggctttcgtgccatccgtggacacagtcgcgcgggtaggtgaccgggttggatttcaaagtccagcaggaaatcctgccctctgggttgcacttcctggatgagcctctgacgtctcaagcagcattgttttaatgctttgatgaagctcagcacgctgccgaaatctcggcagtattttttcttttctttttgcatgtgagagaaaggacaacaaattgcagttttatccatttgtattatttctttagaaaactcaacactctttttgttggaggtggggaaatgagaaggtgatgttttgttttgctttttttcctattttttttttttaaaggaggagaagatgacagtgttctccctaaggatgaagtttgacttttgaaacatatcacatgcttaaagcacatttgagctcctgcatgaacagtaagctagcagatggtagaaatattctttattaattcaaaaaatatttactgcggacctacaatgtgccaagcatgtctcctgacactggggataagcagtgaacaacaacaaaaagacaaacttcttccaccctgaggcgtatgttctcggtgagaaatgggcaataaacataatacctaagaaaattatacgggatgttagtgacaaatgcagtggaggaaaagggaggccaggggcatcaagtgtggagatcagaagtggtagagttacaattttaaataagagggacagatagacatgattaaggaggtgaagtttgagcagacagttgagggagaccaggaagctagttttgtgtgtgcccaagtaagagtattctaggcagagacagcagctgttaaaaggctttaaatggagaatgtgcctggcatgttcaattacagcagacgtgtgtgggtctggcacagaaagaacaaggggaaaagaagaaagaagtattaatagacaaagtatttagttaaggagagcagggcaaattctgtaaggcattcagagccatttcactccggaaaaaaaatgtgtaatattgaatatacgtgttaaatgttgaatctatggaattaccttggagcttaaaatgagtgtgcgaagaagaggattcccatcttttagttgttattactaaatcaaatagctacttgattggaagatcattcatcttcagtactcttgagagcgatttaaacatgtcaccaagcatatttttttccctactggaggatgttaattggtgattaggtagtctagcaaaatcagattctttatggaaaaaatttgtcaattgacatactattcttaggcaccactttcgcagaactatgcgtctaactttcaaaggtctattatatattattaatactcttttcagataaaatataaatctagttccctaaaattaaaccatttcatgcatgtcttttttttcttacacatatatctttattttgcctacaccattctttaatactagaaatgtacagaaagtcaaggcaaggtgtgtgtaggagactttgcagtggtttttggcatactgatctgttcatagaaaatggtatttaaatgtgcaaatgcatgattatgtccacggaaagggtggttcatactgcacaaaagcatcaagtttaagacttggataacctgtttcgtgtgcaagagtcgggatatgtaatcagattgtttatggaatagctgaagttcttggcaagctgtggacttcctcatctcctacctaacattcctaggttcctgaggtggagccttgatttaaaagggttgcaacttagccaccccaccctaaatgaaacctatcatgtataacatcacattacctggaacaggtttgacttgatttagtaaaaccgaatatacaaaaacgtgtactaaaaggtcaagagatagagaaataatgtttcagtttgagaaataaacatttttttaactttaaatattgacttttttatgaataaggaagctttttattttacaggtctttgtgggaagaaacaaatcacaaaagcaattaagagagctcaaacaatgggtaagaaagagcacctcaacaactgtattgagctagctgaaattttgctcattatgctttgtcaagaactttaattatctctttacagggtttatgccagttacatacaaggatcctgcatatttcagggaccctaaagtttataacatcagatatccggaataaattccatcacattaccaccagtaaacttattttatagtaagtggttgtatgacgccaatactgactcaaaccaacctttggatagaaaagtgtttcaggagtgaggtaaagaatgacacttccccttcataccaatcagtgttcattaagcagatcgcttatttaaaatgttaacactcatcacattttacatatgttgaatgaaagtggttctgggtgatagtcatttatatctggtccacaaatagctcatacaatgtagtacaccattcaactgaatggagttaaaactgctcagaatggttttctaactagcaaatgtaagtatgcctggttaagagatcttccctttgtaggaatgttacactgggatgcatagtgatgctgtcacagcaggacaaaacattcctagacaactctatcctcaaaccagtagtgtcttttacataaaaagatgatttacacctaatagacagtgaatgtgatagacatgtatgtatatatgtatcagttctgagttccaccagcctatcccaaacacactggattaccaggcttgtactgtactcaaaattaaggatttgctaaatttcgtgcaaaggactctaaactaggggagagattattgtttgtgttgcgttatagttgtgtaataattaaggctgccagatttagcaagtacaaatgtaggacaaatttaaattttagatcatgttttgcaaaggtactgcgtgagatccagcattttatctggcaacactagctgtaatgtacttctaaaaaattatcacctaaggataattttaatgactcagataaatttcatataaatttctttccacattgtgaaaataaggctattctagcttttctaatactttttttttttttttaatagagatgggtctcactgtgttgcccaggctggtctctaactcctggcctcaatcattcctgccttgtcttccctaagtgctgggattacagctgtgagccactgtgcctggcctcacttttccaattctaaagaatgtgtgtaagcctttccctcaacaacttattgaaaggcgaaaaaaggtttggaaataaaaggatctgatgtttgaaaaagtactttgtaaaataaatgcactaagacttatctgtggattactgcaaagaggtgaatatagtaaaaacaaatgaacttacctgtattactgcaagtagctcaacctagtaaaaacaatggaaatgtttgactttacccatcagccaaattaaaaaaatctccttttaaggttaaaaggatcaaaatgtaggtgaccgtgaatattcaccaaaaccttcatcttttcaatctcttcatctgtttctgggctgctcattttggatgcttttttattggttactactatcagtatctgttttagatggtttgtcttgtgtgtctaacagccgtgaacactcttttttttttttttttttctcctgagtcgaagtattcctctgtagcccaggctggagtgcagtggcaggatctcagctcactgcaagctccgccttctgggttcacaccattctcctgcctcagcctcccaagcagctgggactacaggcacctgccaccacgccgggctaattttttgtattttaatagagacagggtttcaccatgttagccaggatggtctctgtctcctgacctcctgatccgcccaccttggcctcccaaagtgctgggattatagtcgtgagccaccgcgcccagccaatttttttgtattagagatggggtttcactgtgttagccaggatggtctcgatctcctgacctcgtgatccgtccgccgtcatctcttgaactgccatctgtcagctaagtctaaggttttatgcttaaccatttgtggtgtactagctggactagcttcaggaatgtcagtgttttctaccattaaggtcagattgtctactacatcgagatggtggtggttgttagagctacctttagaaacatgtctgtttttttaaagacataacacatgcatgaagaattcagaatctggaaaaaaggtccataatgtttgacaaagaaaaatgttctcctgagggtcttttttggatgctcttctctcgttctgctggaatctgggctcatctccttttttcaatttctcgttttaatctgtttacatcctttactagtttatctactgcttgttcactgtcttccacttttttgcatatactctttaatttctcttacaatgaagcatacatttcatttatcttatgtacctcctttaaggatccatcttcttcaaaaaatttagagctgtgtgtttgtactgctcggctaaaaccagtggacatacaggaacctgatacagttttataacctagttgttcagacatgcccagattggcaaccactgaaggtaccctgtgaaaaagtccttttcgaggtttatataaggcatgttccagtcgatgagtagagcggctttctgttattatacttggtgttcatagcagaaaaaccaggtcttggtttgaaaaatgctcctgcaagtttttgtgaagcagcctctctctaaatgtcatgatctgatctgaatgacgatggaatttgtaacaacctaccacattttttgtgaatttgataatattttcctcagtgcctgcttatttacttcacctgaagaattataaaaactaaaaaactgatagcatggaatatatttctgaatgtcaattgtataaacaacttcagcatcatctatttgggaatcagtaatgctattcttttttttttttttttgagatggagtctagctctgtcacccaagttggagtgaggtggcccgatcttggctcactgcaacctctgcctcccggattcaagcaattttcctgcctcagcctcccaagtagctgggattacaggcgcccaccaccatgcccagctaattttttgtatttttagtagagacgaggtttcaccatgtcagccaggctggtctcgaactcctgacctcaggtgatccacccgcctcagcctcccaaagtgctggggttacaggcgtgagccaccatgcttggccttgtcttctcccttctaatatgaaagaggaagctaggaatccccattgctgctggcatgcatgctataaacctgaagggagccacctaagatgaaattgatactgtggactacacagtagaaagatggaaagaaactgggtcattgatgacattgtcaagatgctagatcaaccaaccacagatcctgtccaacaactggactcttgatttacatcagccactactctgttattgaatcttggacaagttggtttgcttacaagttaaattattgtatctgagagcatcctaactgatacacacatgaaaatagacatttctcctttgttgagaaggatgtacaacaaatctatgaactttaagttttagtaccttcacttgctcatgccccttcccaaccttttactaaattttatgcttgtaattttgtattcttttccttaaggaggaccacttaaattgcataagattcaggtgtcaccaaacctggatctagcatcagatgttgttggaagaaaatgtccacctttctctgccgtctcctccattcatgtctccctagggaaggagagatgtatgatgtatctaatcagtaaatagttgaaaaggtcacagaacgtgcgtggcctggcctctcttctggcgctttcattcagatctgcctccccacagtagtagatatgcctgcccacactggtaattctactgcagcaagccttgaatgacaacagtggacgtgaaagtagttgctgcctttgaccacatcttcccaaagtggcacgtcaccaacagactttaaaatcatgacgttataacgtaatggctgtgaagatttggaagaaagcactctaaaatgagagctctgagagatgtagagagaaggcagtcaaggaatagcgcctataagcacctcctgcacatccggtccctgcgcctccatcctcaccctgccctcagctcactcccctcctgttagaaattggctgtgcccctgaaaagtcatttgcatttgcctaaagactgagtacacaagctcattccaaagtagaaggtgttgaagttccattttggcctcaggtcaaaattgttttctctatttcagcttaatgagcaagaaagcagaatctaatatgtgtatatttctaacgcctgtgtatatttctcaactgtttcccagctcagaaaggtgaggagtatgacagtcaccctgaaatgacaacagaagccaacaataacaattatagtaataatgtgtgtatagaaagtactaaatgaccattaaatgaagagcagattactaggtgctatggaagatacacatgcagtgaaatacaaattccagatctcagggagtttgcaaccgaaaaagaatataacactaatatatatacaaggggacttcaaaacgttcacctgcaccctccacctcccaggttcaaagatggagttaaaggataaaaagtataaactttatttctttttttttttttttttgtgagatggagtctccctctgtcgcccaggctggagtgcagtggtgcaatctcggctcactgcaagctccccctcccaggttcacgccattctcctgcctcagcctcctgtcataagcaccatcaaggtcaagacacttttgtcagggatgataccagccatttagtccatccttaaaaaaaagagggtcctgggaatttaaccatgtcaatgcagtctttattaactgaagaaaaatgggtgccctttacagattttttaagattaggaaacaaaaagaagtcagaaagatttcctgtggaagctcttgcaaaattgcccttgtttgatgagaggaatgggcaggagcattgtcatggtgaagaaggactctctggtgaatctcctgggcatttttctgataaggctttggctttctcaaaatactctaataataaggagatgttgtcattttttggccctccagaaaatcaacaagcgaaatgccttgagcatcaaaaagaaatgttgccatgatctttgctcttgactgctttgtttgtttgtttttggagacagagtcttgttctctcacccagactggagcgcagtggtgcaatctcggctcactgcacctgcaccctccacctcccaggttcaaacaattctcctgcctcagcctcccgagtagctgagattacagacatgcaccaccactcctgactaattttgtatatttatatttatatttttattttattgttatttcttggagacagagtctcgctctgtcacccaggttggagtgcagtggtgccatctcggctcactgcaacgtctgcctcccaggctcaagtgattctcatgcctcagcctccggagcagctgggattacaggtgcatgccgctacgcccggctaatttttgtatttttagtagagacaggctctcaccgtgttgaccaggagggtctcaaactcctgacctcaaacgatccacctgcctcggcctcccaaagtgctgagattacaggtatgagccatggcgcctggctttatttttgtatttttagtagagatgaggcttcaccatgttggccagactggtctcaaactcctggcctgaagtgacccacctgcactggcctcccaaagtgctgggattacaggtgtaagccaccgcgcctggcctggtctgcttttgctttgactggaccatttgcaattcttggaagccattgctttaatcgtgccttgtgttcaggatcctactggtaaagccatcctgttacagttcttcaaataaatgcttcagcatcctgatctcacttgtttaaaatgttcatttaaaaggtctactcttgactgcagctgatctggatgtaatggttttggcattcattgaggggaaggtttgctcaactataatttttcacttgtaattgtgtaagctgaacaagttgagatgtctatgctgttggctgttatttgtgctgttgttagtcctcttcaattagggcatgaagatgatgaatttttttctcacaacttgatgtaatgatctggcactgtgggtttcatcttcaatgttgtctcatcctttttaaattgacttgtttgtttgtaaactgctgatttctttggggcattgtccccataaactttttgtaaagcattagtgatttcactgttcttctacccaagctttaccataaacttgatattcttgcttcaattttacagaatttgtgttgcttatataggggcttttttctgactgacgatttatccttcctattacctccagctagatcctttgagacatactacagtaacatagtatgagtttattttggtgcaaacaaattttgaaatcatacgtagttattttatagcatgcattttccatggactttttgaagtccccttatatatatagacttataaaggcagctttaactgaagcatattttacacatgttctatttggttgaagatatgaaattaccatttttgtagataaaatgtatttgaatattaacactttcatatagccaacctaattgttaccaacacccgaaacattcacaattacttgacttggaaacttcaacattccagaacattcacaattacttaacttggaaacttcaaattccagaacattcacagttacttgacttggaaactccaacattccagaacattcagaattacttggcttggaaacttcaacattccagagcattcacaattacttgacttagaaatttcaacattccagaacattcacagttacttgacttgccatcacactgtagttatctgtagacctctggggtcccctgcttctcctcactctttgaaggttttgacacctgactcactgtcactcttttaaacctgactcttggcaacattcttggtgatttcaacatccacaaagacaatctttccaatattctggtttcctgacttctgaaaatgttcttggatgccattttacctcaaatacccagttccatggtcatatcttagacattggaatatttacatcattttgcttctggggtaccattctcttgattcttccattactcactggccacattttgaatagcatctgttggtttctcctcatcaactgatctctatatgtaggagtaccctagggcctggtcatcagacgttgtttcttatttatctatgcttaccacttaatgtgacctcattcactctcatgactttagttccatctgaatattgatgacagctatggtttaaatgtgtccctccaaaattcaggtgttgtcagtgtgctggtagtaagaggtgccttctttaaaaggtgataacctcatgagggttcctccctagtgaatggaattaaggcctttatcaaaaaggcctcgcggccgggcacggtggctcacgcctgtaatcccagcactttgggaggccgaggcaggcagatcgcaaggtcaggagttggagaccagcctgcccaatatggtgaaaccctgtctctaaaattacaaacattttgtctctaaaaatacaaaaattagctgggcatggtggcacacacctgtagtcccagctactcgggaggctggggctggagaatcgcttgaacctgggaggcgggagttgtagtgagccaagatcatgccactgcactccagcctgctaacagagcaagattccatctcaaaaaaaaaaaaaaaagaacaaggcttcgcagccatgattctcagcaaactaacacaggaagagaaaaccaaacactgtatgttctcactcataag

SEQ ID NO: 265 - DNA, 67069 bp, Homo sapiens
cacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccctgggggtccccgccgccagggggcgcccggccccggtagccgacgagacagtagaggtaatagaggccgtcctgcgggagcgccagcccctcggcgtccgagaactgcgtcccgctcgtcagaaacgcctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttctgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaactggaaccttcggattatttacactcttattcaggtcttggaggtccttacctatgaggtgggcagctgggagcccggggctgagatctgtttctggctcctcctctggcagcttctgaaaccctggaaggggcaaagagtccacgattgggggcagggcagccacccatgcaggctacccttgagagaacagggcgcagggatggggagcctggattcctagaggaagaggtatctggggacgcagcagggagctgggagcccctgagggtctgaagcggggaaggagagacagtctgctcttacccagtccttgctgggcctgtgccccggggtcggccgtctccgttacctggttgggtggggtcacagtgcccagagttcagattcagctcatgtcacccctacccctctgaaagtggacccaagctgcaggcctggggtttctcctaccagcaccatccccaacacacacctccttagaagggagaacaagcaaggcataggtacttgggcggagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcaagatacaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccctccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagagaaactgaggcccagggagggaaggtagcttgcaggaagccagtcagcagagctgaaatgagaacacagatctccaggtttccaatgtggtttgcattcttctataccctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacactttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctctcaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtctcgctatgtcacccagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaagtgctgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcgtggtggtaggcacctttaattccagctacttgggaggctgaggcaggagaatcacttgaacccaggaggcggaagttgcagtgagccgaaatcatgccattgcactccagcctgggtgacaagaacaagactctgtcttaaaaacaaaaacaaacaaacaaaacagtattaggccaggcgagatggctcacacctataatcccagcactttaggagaccaaggcaggtggatcacttgaggtcaagagtttgagaccagcctggccaacatggtgaaaccccttctccattaaaaatacaaaaattagctggatatggtggcacaaacctgtagtcccagctacttgggaggctgagacaggagaatcgcttgtacccagaaggcagaggttgcagtgagccaagatcacaccactggactccagcctgggcaacagagcaagactccgtctcaaaaaaaaaaaagagtactgacttgagatttgtatgtaaaatttgccttcctcaggccagaaaagaaatggggaaataaatactgaactccagtcaatgttaagcttctgaagggtttagatgtaaaatgtactgatatttgtaattttaaaagatatttaaaagtgagatggattgataaatatgtgataaagcaaataaaaaatgttaatagagccaggtgcagtggcccactcctgtaattccagcactttggaaggctaaggtggaaagattgcttgagaccaggagttcaaaatcagcctgggcaacatagtaagaccccatttctacaaagcctcatgtggtagctggtgtctgtagtcctagctactcagaaggctaaggtgggaggacctctgagcccaggaattcaaggctgcagtgagctatgatttcaccactgcacttcaggctgagtgacagagtgagaccccatctcaaaaacaaaacaaaacaaaaaatgttaatagtagcatctaggtggtaagaatatgttcactgtacaattattctcatttcaccctatgtttgcactttttaataataaaatgtaaaaaaaacaaaacaaacaaacaaaaaaccctgaatattattcagcatggggaacatggaggatggggagaagggtgggggaggaagtagaaggttcttgaatttggaaggggaaacgcaaattaatatggacccacccaggcaccacatctcctcctcaccccttgccttacaggcgctccccagtcttcaccctcctcaaggagtgggtgtgcaatcctccagcacccatctccttctccatcacagtgccactaagaagccttcacccaggtctctccagagagcctcaggccgctgcctttacttagttctgtgttcaatgccagaatgctgcctcctacaggaagtccacctgtattgcccacacctcctttcctgtcaccaacttgtcaccaactttctgtccttgatctatccacagggctcatgtagatctagtatggctgcctttaactctcatgtttgttaatcagacagccaagcagcctgctgcatagagctgcagaacaccaagtgggtcaccagaacaccaaatatgccagagctcccagtctgaactggagcagggtacatgtgtccacagacatatgccaagatcaagaggtctcaacagatgcagtgtaagaggtaatagagaagagttaatcaaggaagacacctgaaggtggtgggtgtttgctgactagtggcaggatcagtgaaatgactggagctgaggcagattatggccctagctacaggcccagaagtttgaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctgggtaagctgggaatgggcagggaccttggtggaaggatggtcacaccccagagtggggtgaagctaagatgaggggagggagagtatgggtttgagtttccctgggccgtcgaggaatcctctgagtctctgctccccaaagaaattaaagacaattcatttctgtgcccacggcccttatggcctccacctgcacttctgctccccaccccccagaattcctcttaaacccagaagggtcccagtttccagaccctagtcagtatatctggctctggggtgaagagaacggccccctcttcaccctcaaacaggaaccagtggttggaggggaggaagtgcctgaggggaagttatggggccccagatactcctccatgccccacttcagccctagcagcatctgcctgtgggaagcagctctccacaccagccaagggggcccccacactcccgcgctgctctgcggctcagggagcagcccacctgctgggtgtgctgatatcaccctcccttcttccccccagtgcccacacccacccaggcccaggctccttcccctccatcatccccttaccagcacctagaaccatccagggctgaaaagtcccctccaaaccacgtggtcagcccagggcagaggaaagggctgggctctggagttgggcagagctggccttaaaccccagctccacctttctgggatgggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggtaagtaaagtgtctcttgcatctgcatagagagagtcctgggagcttaggaagtgatggggaacagtgatgtatgcagctcatgactaggtggacaggcctctggggacagctggtacaggagggaaagggacctcacgggaggcccagaaacctggtaagaggtgaggtattaaggtctgggatggagaagctctgagggtatatttttctgcctctaaaactgttggagagggaatctgagaaagctgcaaccaaccaggaggctggggtacgctggagaaggaatgggcttcctaaccttgagccctcttccctgaagatatatgtatctacgggggcctggggctgggcgggctcctgcttctggcagtggtccttctgtccgcctgcctgtgttggctgcatcgaagaggtgagcgctgcactccctccctccccctgcagcagtgccccctgtgcccccacccccacacgctttcccactgctttcccagaacactgcctggccctggagccactgggaagccaacaggggagtccacgcctgctggtggggggagcccgggagggcccgggagaagcacaaagggtgggctgtgttgagcttcttcttttcttccagtaaagaggctggagaggagctgggtgagtctggggacagggaagggggagggcaagagagatcctgagtgggtgagtggggagaagcatggctgagcgctgagaggagggttggggacgggagacaaggagagagaaagtaggagcatgagagaggcagagaaaatcgaggcaaaagagaaagagaaaatgagacagaaaccaagagaaaaagtgagacagaggataggagagacagggagaaaatgagagtgagagagacacaaagagaagagcaatgaaagagagagagagagagaggctccagaaccaggcacagtggctcacgtctgtcattccagctatcgcaaggctgaggcaggaagatagcttgagctcaggggttgaagacaatcctggacaacatagtgggactctgtctccaaagaaaaaagagagagagagagagagagagagagagggagagagagagagagagagggagagaagtaagaaaggctggaggtgggagcagaactcacagggaaggatctgacggcatcgcctcccatcagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccacccactctggggtcaaatagtaatttattgggtgaatgacagtgttcagggacccaagctcccctaacagccagaagagggtatgtgtgggcctggcaggaaagggcagttgccaaggaggagtcatatctgatccttcccatttctcaggacaatcaggctcagcctcctgggactgggggaagcagatgtgctgagctcccacatggtggtgggaggggcgctgggaccacagccggcagctgccttcttggacctttccaggtcagacctggtggaagggaaagttcagagttgggggaatccggagagagtagatttggcatctggagaatggagaagaaaacacttgagactcatgaggagttagtggtggggcagatttattggggtcttttgaagaggactagggacatctgggctctggaatcactcctcggggcccatctgaggagtggcagtgtgttcccatgtgacagtggcctggtcagagagaggacaggagctgctcagtgttgcagtcccgaggctctcctcttcctggtctctgtcctccctcctcccactctcttactgcccctcccatcccgtccactattgcccctggctccattactcacatttgccctggtaatagacggtgctgcccacggccacagagagaaagctgacagcatagaatccagcccgaaggaggaggactgtaccagcccctagctgaggatgttctgcatggggcaatggagacgggggttggggaagaagtgcacacaggctcagggagggaaggggcctcagaggagcatccctgcctcccaaggacattgcctcttggggcctccagccaggaggagacaccacctcccagcatctcacctttctccaccaccagccgagtcccattccctgtcccgacaccaaggcccagcacctccactctgcacacgtagatgctggcgtcatggcctcgcacgtcccggatgtgcagctcagcctggtggtcatggaggaaacgggaagaagcaagtggggccaggcggcccctgaactctggggttccattcctcacctccttccctggaaccacctcatctcggaaccacgtgacggagccaatggccagtctcccttggctggcattgaaggagcagggcaggaaggcagaggatccttccagggtacgaatctcagggggctgggacacccagagagcacaggatcctgggggcagaaggaagacccagagaaacacctccccagttattccaaagagaaaagacaacagagcttggagtagaacatcccagctttctccaggcatagggtgcatgggaatagatactttgggtgcctcattaaacccttccctcttaaccaatctgatttcttaacattgcttattaaatcatttttcggctgggtgcagtggctcacgcctgtaatcccagcactttgggaggccgaggtgggcggatcaccaggtcaggagatcgagaccatcctggccaacatggtgaaaccccgtctctactaaaaaaatacaaaaattagccgggcatggtggtgtgcacctgtaatcccagctactcgggaggctgaggcaggagaatcgcttgaacccgggaggcagaggttgcagtgagccaagattgcgccattgcactccagcctgggcgacaaagcaagactccatctcaaaaaataaaaaataaaaatcatttttcaaattcttcctataccaactctcactctcaccctctgccatcattctccagccagttcagtagtaacttgtctagctgaaatgtaaaccatcatggtgaaattaagctcattaatgaatgcagctgcctagttaactaatatcactcattatattatccaggtattattttagtacaaatggcattgtacagtaagccatccttcctctttttcttttttctttttttgagatggggtcttgctctgttgcccaggctggaatgcagtggtgcaatcttggctcactgcaaactccgtcccctgggttcaagcgatcctggtgcctcagcctcccaagtagctgggactacaggcacccaccaccacgactggctaatttttgtattttcagtcgagacagggtttcaccatctggtctcaaactcctgacctcaagtgatccacccacctcggaccaggctggtctcaaactcctgatctcaagtgatccacctgcctcggcctcccaaagtgcacccagccactcttggttttcgttaaagaaagtaactaattaaatctccaggtgaagacgtggccttaattggttgagattcctatttaacccgtccatgttgatgaattaaaccaaatattaaaatccctgattaaattatctacttagggaaatttacaagtcattctatttcagtggttctcaaacttgagtgtgtatggaaattacctggagcatctgctagaacagattcctgggcctaccccccgagtttttgactcagtaggtctggagtggggcctaagaatttgttctaggttcccagaaatccacattttgagaactcctgcatttagttaataatatgcctgatagttaaggtctctcagttcattaaaaacagtttcggccgggtgcagtggctcacgcctataatcccaacactttggaaggccaaggcgagtggatcacctgaggtcaggagtttgagaccagcctggccaacatggtgaaacctcgtctctactaaaaatacacaagttagccagcagtaatggcatgcacctgtaatcctagctacttgggaggctgagacaggagaatcatttttacccaggaggtggaggctgcagtgagctgagataccgccactgtactctagactggacaacagaatgaaactgtctcaaaaaaaaagtttcaccaccaggcgggcgcagtggctcatgcctataattccagtaatttgggagaccgaggcaggcagatcacttgagatcaggagtttgagaccaacctggccaacatagcaaaaccccatctctactaaaaatacaaaaatggctgggcgcagtggctcaggcctgtaatccccgcactttaggaggccgaggcaggcagatcacctgaggtcaggagttcaagaccagcccggccaacatggtaaaaccctgtctctactaaaaatacaaaaattagttgggtgtggtggtgcgcgcttgtaatcccagctacctaggaggctgaggcaggagaattgcttgaatctaggaggcagaggttgcagtgagccaagatcatgccactgcactccagcctaggtgacagagcaagactccgtctcaaaaaaaaaaaaaattagccaggtgtggtcgtgcgtgcgtgtagtcccagctactcaggaggctgaggcaggagaatcacctgaacatgggaggcagaggttgcagtgagccaaaatcgcaccacggcactccagccaggcgacagagcgagactcagtctcaaaaaaaaaaaaaaaaaagtttcaccaagaaatttatcatagatttacttggatctctcaaactaaaaagcctcacagtgggtgacacagagagactgtgaattgggggagtccactgagtgtcacctttggagcagtcccactcctccctcagagccgtgtgtttcagcccccaccaagcccgttccctatagcatctagtccagcctcctggatctccctcctcccacccacactccttggggtcctgagcgcacgccctgtcacctggatggaccatgatcaagatgagcaacagcatccaggccatgtcggaagatgtcccagttggcgaaggggatctgagcagtgaggtctgggtggaggaggaaggactcactacttgtagccaggcctttggtcaccagatggggatggggagcttcctatgacacacgggactcacacatcacttgccaaggaccacaactgccagggacctcgagcatcaaatgcttgcctccctgaggagagaggacagatgctgctggaggagatgtcagggtctctaggaggccaaggggccagcttgtggcaggctagctaagcgtgtgagggggagggtggggcttagatggctgctaacccaagggtgagtgggcggttgggcgggtgagaccaggatgtgggttcccccaccttccgaggttcaaggagaccagcttttacccagaacaagcctccaggagccctccttggcccagaagctaacctacttaccctccctgctgctcaccagtacccagacccatcccacccattcccttcctggaatctggcctcactgcaccccagggctactccaagatttctatgagggattaggagaagcaagctgattggtgaagctatatttaatttgcatagcaatcaccttgtgtgtgtgtgtgtgtgtgtgtgtgtgtgtgtgtgtgtgtgtgtgtgtgtgtttggttgggtttttttgttttttgttttttttttgagctggagtctcactctgttgcccaggctggaatgcagtggcacaatctcggctcactgcaacctctgcctcctgggttcaagcaattctcttgcctcagcctcccaagtagctgggattacaggcgcacatcaccaagcccagctaaattttgtattttttgtagagacagggttttaccatgttggccaggctggtctccaactcctgatctcaagtgatccaccagcctcgccctcccaaagtgctgggattcctgttttggttttttgagacagggtctggctctgtctcacccaggctggagttcagtggcgccatcacggctcactgcagcctcaacctccagggctcagttgatcctcccacttcagtctcctgagtagctgggactgcaggcgcacaccaccacaccaggctaatttttgtattttttgtagagatggggtctccctgtgttgcccaggccggtatccaactcctgggctcaaacaatccatccacttaggcctcccaaagtgcatgagtcaccatgcctggcgaaatgtatttcttaaataatgagacttgaaagtctaaattactccttaaaccatggactacaggatggatgttatgttagcaggcaggaaaacaacattcagctgggcgtggtggctcatgcctgtaatcccagcactttgggaggctgaggtgggaggatcacctgaggtcaggagtccgagaccagtctgatcaacatagagaaaccccgtctctactaaaaatacaaaattagccgggtgtggtggggcgcacctgtaatcccagctactcgggaggctgaggcaggagaatcacttgaacccaggaggcggaagttgcagtgagctgatatcgcaccattgcactccagcctgggcaacaagagcgaaactccgtctcaaaaaaaaaaaaaaagaaaaagaaaacaacattcgtctctttggacatctccatcagagctcttggataactatgtacattgtcaatgagcagtaatcattttaaagaaatcttgtttttcggagcagtagacctcaacagtaggcttaaaatattcagtaaaccagcggggcatagtggcttacacttgtaatcccagcactttgggaggccaaggtgagaggacggcttgaggccaggggtttgagaccagcctgggcaacatggcaagaccctgtctctacaaaaaaatttaaacttagctggacatagtggcacacacctatagtaccagctactcaggaagttgaggaaggaggattccttgagcccaggagtttcaaggatgcagtgagctatgattttgccactgcatttcagcctgagcaatggagggagaccttgtctctaaataaaatacaatttaaattgggaatagtagtaaatggagtttaaaaaaaaataattttggctaggtatggtgggtcacacctgtaatcccagtactttgggaagcccaggagggcagatcacttgagttaaagagttggaggccaggccaggcatggtggctcatgcctgtaatcccagcactttgggaggctgaggcgggcggatcacgagttcaggagatcgagaccatcctggctaacacggtgaaaccccatctctactaaaaatacaaaaaattagctgggtgtggtggcatctgcctgtagtcccagctactcaggaggctgaggcaggagaatcacttgaaccttggaggcagaggttgcagttagccgagattgcgccactgcactccagcctgggtgacagagcaagactttgtctcaaaaaaaaaaaaaaaaaaaaaagagttggagatcagcctggacaacctgacgaaaccctatctctacaaaaaatacaaaaattagctgagcatagtggctcatgtctgtggtcccaactactcaggaggctgaggtaggaggatcatttgactctggaaggcagaggtttcaatgagttgagatcatgctgctgtactacagcctgggcaacatattgagaccgtgtctcaaaaaaaaacaaacaaacaaaaaaaagaaaaattttaaaatcagtaaaccacgttgtaaacagatgtactatcatctaggcttttatttatttatttatttatttatatatttttttgagatggagtcttgctctgtcacccaggctggagtgcagtggtgcaattttagctcactgcaacctccgccctctgggttcaagtgattttcctgcctcagcctccctagtatctgggattacaggtgactgccaccacacccggctaatttttgtatttttagtagagacagggtttgaccatcttggccaggctggtcttgaactcctgacctcaggtgatccgcccacctcagcttcccaaagtgctgggattataggcatgagccaccacatccagccatctaggctttattgttccatttacacagcgtggcagagtaaatttagctaattcttgccaagtgcagtggtatgtgcctatgtctctgctactcagaaggctgaggtggaaggatcacttgaggacagaagttcaagactgcagtatgctacgattttgcttgtgaaagccatggctccatggcactccagcctgggcaacagagcaagaccttctctctctctctctctttttgagacaaggtctcactctgttgcctaggctagagtgcagtggcacaatcacggctcactgcagcttcaacctcatgggctcacaccatcttcccacctcagcctcctgagtagctgccacacaccaccatgcctagataatttttgtattttttgtagagacagggtcttaccatgttgtccaggctggtctcaaactcctgggctcaagtgatttgcccactcgacctctcaaagtactgggattacaagcatgagccactgcgcttggccaacctcagctctacaaaaaagaaaaaaaaagtccaggcacagtggctgactcctgtcatcccagcactttgggaggccaaggagggcagatcacttgaggtcgttagttcaagaccaacctgaccaacatggagaaaccccgtctctactaaaaatacaaaattagtcgggcgtggtggcgcatgccggtaatcccagctactcgggaggcggaggcaggagaatcactgggagacggaggtagtggtgaactgggatcgtgccattgtactccagcttgggcaacaagaacaaaactctgcctaaataaataaatagataaaattagccaggtgtgctggtgtgttccagtagtcttagctacttgggaggctgaagcaggagaatcacttgagcccaggatttcgaggctgcagtgagctatgatcttgccactgcactccagcctgaatgacagggtgagaccctgtctcaaaaaaaaaaaatcactactgacagatcataacagataaaataatcaagaaaaagtttgaaatattgcaagaattaccaaaatgtgccactgagacacaaagtgagcacaggctattggaaaagtggcacctacagacttgctcaacacagggttgccacaaacttcaatatataaaaaaatgcacatctgtggaacacaataaaacaaggtaatacctctacagggattggtacaagagtatgccagacactcttgtatgtgtatcacacagctacaggagataatacagcacatagaagtgaaggatgacatgtaatatgccatgtgtccaccccttaccgcatgcccccttctggctccttttactattacattttttagagacaagggtctcactctatcactcaagcaggaatacagtggtgtgatcattgctcactgcagcctcgatctcctggactcaagcaatcctcctgcctcagcctcccaagtagcttggaatactggtatgtgccatcacacctgactttttacttttatttatttttgaaagacagcatcttgctatgttgtccaggtctcaaactcctggtctggctccttttatttattttatttatttatttattttgagatggagtcttgttcttgttgcccaggctggagtgcaatggctcaatctcagctcactgcaacctctgcctcccgggttcaagcgattctcctgcctccgcctcccgagtagctgggagtacagacgtgcgccaccacacccagctaatttttgtatttttagtagagactgagtttcaccatgttggccaggctggtctcaaactcctgaccttgtgatccgcccgccttggcctcccaaagtgctgggattacaggcgtgagccaccgcgcccagcctggctcattttatatgaatacatgttgttgttgttgctgttgttgttgtgagacagtctcgttcagtcgcccaggctggagtgcagtggcacaatcttggctcattgcaacctctgcttcccaggctcaagcgattcacgtgcctcagcctcccgagtatctgggttcacaggcgtgtgccaccacactcggctaatttttgtgtttttagtactgacggagttttgccatgttggccaggctggtcttaaacacctggccttaagtgatccacccgccttggcctcccaaagtgctgggattacaggtgtgagccaccacacctgacctaatatatgttttttcctttgtatctgtgtttctagctctgtgtcacagtacttttgtagactgtccagttcccacccatcactgaagtaattcagagctttcttttggagaagcagtcatctcatggttaagaatgctggtttggaatgagtctaggttcaaatgtcagctcccccgcaatccccacaattatgttatacaacctttttttttttgagacagggtctcactctgtcaaccattctggagtgcagcggtgtgatcatatgatcatagctccccgtggccttgaactttgaactcctgagctcaagtgaccctcccacgtcagcctccagagtatttgggactacagacacacatcatcacgtttggctcacttatttttattttttgtacagacagagtctcaccgtgttgcccaggctgatctaaaactcctggcctaaagcaatcctcccacttcggcctcccaaagtgctgggattacaggtgtgagccactgtgcccagtctaatcttgaacaaattattttacctccctaagctaccggaacaaccacacatgccacacaacctgggaaggaccaactcagccattctccagcagcgaagtggctgccaccccagggatatctaactagaggatgtgggatggaggcgtcatggcaaggcaaggcctgccccctggtggtcagagagcatgggaggcccgagctaccaatggtggcttttctcaactgggccttgattccagcttctgcccgatcccctaccttgcttgcctccttctatcaacaccccattcacaccccaaaggatcaatataggaaaaattgtctctactatctcagctgtaagaagcccacggtttggggagggagaagaggtcaccaccagtggggacgtggaataagtaactggctggggataaaactccactcttccggccgggagcagtggcccacgcctgtaatcccagcactttgggtggccgaggtgggcagatcacctgaggtcgggagttcgagaccagtctggccaacatggtgaatccccatctctactaaaaatacaaaacttagccagacgtggtggtgcgtgcctgtaatcccagctacttgggtggctgaggcacgagaatcacttgaatccaggaggcggaggttgcagtgagccaacattgtgccactgcactccagcctgggcaacgagcaaaactccgtctcaaaaaaaaaaaaaaacaaactccactcttccacagtgtacactcaatcacatggttctactccacgtcccaaggcaatgtggcttagaagacaaatcagcctaggttggagtcctggtgccactactgtaaactgggggtaccacctgtaaacttccagaccccattgccctaggtgttcaatgtgtggttcttctccagtgcttcccccgtcctgtgcaagggtggcagtgccattgctacacctggactcaagggcatcctgctctcccagctcttttctatatctaagacttctaaacatttgtcatagctaaaaatgttccagattccaaagacagtatgtggggtttttttttcagtccatctagaataaatcctgatatgtgtgtacattcaagggaccccttttaataactctgagaacctctagggaaggctaacctgcaagacaggaactgctgcgctaatcagcacagtgggcacaagaatggaactttttttttcttttttttttcttgagacagagtcttgttctgttacccaggctagagtgcagtggtgcgatctcggctcactgcaacctccgcctcccgggttcaagagattctcctgcctcagcctcctgagtagccaggattacaggcacccactaccatgcccagctaattttcatatttttagtagagacggggtttcactatcttggccaggctggtcttgaactcctgacctcgtgatccacccacgtcggcctcccaaagtgctgggattacaggcgtgagccactgcatccatcctggccaaggatggaacttttctaaagaaattattcccaggcactcaagaggaaaggcaacaaataaaacagtgttgaagtggatgtgcactggtctctgtttttgtgtgtgttttttttgtttttttttttttgagagggagtctcgctctgtcgcccaggctggagtgcagtggtgtgatttccgctcactgcaacctctgcctcccgggttcaagcgattctcctgcctcagcctcccaagtagctgggactacagcgcctgtcaccatgcctggctaacttttttgtatttttactagagacagggtttcaccatgttggccaggctggttttgaactcctgacctcaagtgatccacctgcttcagcctcccaaagtgctaggattacaggcgtgagccgccgcacccagtctctggtctgacttctttaacaacaagctgtgggctggctggatgtagttgaggccaataaactcccaactcagaccatgaaaacaggtgaaaacacaaaagtccacaatccagcacaggtgatctcatctttcccccacccccaccagggttcctctacgtgctggcaggggtgagattgggtgacttctctggccaagtcttatcaatatttttcaactaatgaatggctcccaggtgatgatactttcagcttctgagaacagcttctcctctgaggctcatagcatctgacctcacgaccttcaatctctccttggtgtcgtccactcgccctcacattcatcaagagcccatccctgactctgcagcctcttctctatttattttttctttcttttttcttttttctttttttttttttttgagacagagttttgctgttgttgctggagtgcaatggcgtgatcttggttcaccgcaacctctgcctcccaggttcaagcgattctcctgccccagcctccagagtagctgggattacaggcacctgccaccatgccaggctaatttttgtatttttagtagagaaaaggtttcaccatgttagccaggctggtctcgaactccagaccttgtgatccgcccacctcggcctcccaaagtgctgggattataggcgtgagccaccatgcccagcccacttcctctctatttcaacctctgccaactccttaatggacttaatgtccatatgaatgactttttttttttttttttttgagagagagtcttgctctgtcacccaggctggagtgcagtggcgtgatctcggctccctgcaagctccacctcctgggttcacgccattctcctgcctcagcctccctagtagctgggactacaggcaccagccaccatacctggctaatttttttgtattttttagtagagacagggtttcaccatgttagccaggatggtctcaatctcctgacctcgtgatccacctgcctcggcctcccaaagtgctgggattacaggcgtgagccaccgtgcccagccataaatgacatttttaaacattgatatataatttcatacagtaaaatgcacagatcttaatgtacagtttgatgacctttggccaatatgtacacccatgcaaccacactgtaatagagatatagataattctcattatcctggaaaattcctccatgcccctttttggtaaatccctttcccctcctagatgcaaccattttaccatttttaacctctgtagacttttttcttgggacagagtcttgctctgttacccaggttggaatgcagtagtgcaattatagttcactgctgccttgacctcctgggctcaagccatcctcccacctcagtctcctgagtagctacgactacaggcatatgccaccgcacccagctaattttttaacagtttttttgtaggctgggtgcagtggtttaggcctataatcctagcactttgggaggccgaggcagggggatcacaaggtcaggagctcaagaccatgctggctaacacagtgaaaccccgtctctactaaaaatacaaaaaaaaaaaaaaaaatcagccgggcgtggtggcacatgcctatagtcccagctactcgggaggctgaggcaggagaattgcttgaacctgggaggcagaggttgcagtgagccgagatcgcgtcattgcactccagcccgggtgacagagcaagactctgtctcaaaaaaaaaaaaaaaatttttttttgtagagacgaggtccttctatgttgcccagactggattctaactcctgggctcaagtgatcctcctgccttgacctctctaagtgttgggattacaggcctgagccactgcgctcggcctctatagattagtctgttcttgaacatcatattaatggagtcatatagtacatactcttgtatctggctcctttcattctgcttaatgtctgtgagattcgcccacgctgttgtatgtatcagtgtttcattccttttttttgctgagtggtaatcctttatatgatgtagcacagcttgttgatctattcacctgatgaagtacaattgggttgtttctattttttgtttttcttattatggctcaatctgctatgaaacttcttgtacccatctcgcaaatgccttttcaataccctaagtgtgcaacttcacagttatttcaccttgtccactccaatcatcaccttgactctccatgacctacatctcagatcctgtcaccatggaagctgtttcactttgaaatctcacctcctctttcccaaggacataaaagccatccaacctgagtcccccagactcctgtaccctaaacgtgtgcttttataccactgtcctgttggaaaatttttgggttgtttctcccacttttttttttttttttttttgagacagaattttgctcttgttgcccaggctggagtgcaatggtgcgatctcggctcactgcaacctccgcctcctgcgttcaagtgattcttctgccttagcctcccaagtagctgggattacaggcatgtgccaccacacccagctaattttgtatttttggtagagatggggtttcaccatgtcggtcaggctggtctcgaactcctgacctcaagtgatccgcctgcctcggcctcccaaagtgctgggattataggcatgagctagcacccctggccccactttctttttaaaaagtgttattatatattttttattatatatatttttgagatgagatctcactatgttgcccaggctagtctcaaagtcctgactccgggctttaggtgttcctccgacctcagcctttcacgtagctgggattataggcatgcacctggcttcccactttcattcaataaattttgcgcatctaccatggctttcctaggcaatcctgtcatagccacagttgtcactactgcttattctctgtcaagtccccaatctacatctccccctcaggcctctttcttgagacctaagtccacactatctaactgctctctaggcggcttaccctgaatactccacaggcatttcaaagtcatcagtgtccactcagaccaggtcagcctcctgtcatccctgtcccagtgaatggaaacacaaagccccagtcacttaaggcaaacacctgggattcatcctactctgccttctccctcagttcccccatccaaaagatctccaggccctgtccattttgcttctgaaagatcgcaggtgtctttcccttgctcttcattccactggttgctaaatccctcatcaactcaaggggaaacgagcagagttgcttctctgatgggtagtgtggtttctgcacagcatccccttcatcccaccactgctgggcattgaggttcattcatctattcagcattgctcttcacgagggccttccatgggccagacaccctatcttcatctctcttaatcgctcttttcagtatctctctccttatctctcatatttcccacagctctgtccacaactctttctgtctcaccatgttattcatattacttgtttcttcccccgtgtccactcaaacgccacatctctacacacccctacccctctgcctctctgtcacatgcatacacacttctgcttattcactcattcaacaaatattcagcgagcaccttccacgtgagacattctattttttttctttttttttttttgcgctctcagctcactgtaacctccacctcccaggttcaaatgattctcctgccccagcctccagagtagctgggattacaggcacatgccaccacccctggctaatttttgtatttttagtagagatggggttttgccatgttggccaggctggtcttgaactcctggcctcaagtgatccacctgcctcagcctcccaaagtgctgggattacaggtgtgagctgccgtgtctggtctgcctctccgtctttctctctctctgtcttcctccatctctcttcgcatcgctttctgcctccccatcattctccatgttttcccttcccatctctccccatctacataccttattcttttactccatttctcttccttccccatttctctctgggtgagagaatgaaggaaggctagtgactagtcacctcttccctttaggggccagagttcaggcctgcctcagctctgccaggctggttggcactactcttgtttgcccttggagtctctgcacaaggatgcttaaaaaaaaaagtttaggccaggcacagtggctaccgcttgtaatcccaacactttgggaggccgaggagggtgcatcacgaggtcaggagttcgagaccagcctgaccaatatggtgaaactccgtctctactaaaaatacaaaaagtagccaggcgtggtagcatgcacctgtaatcccagctactcaagagaagaatcgcttgaacccaggaggcagaggttgcagtgggccaaaatcacgccactgcactccagtctgggcgacagagtgagactccatctcaaaaaaaaaaaaaaatttgtgcagcagcgacagaaaagtaacctacaatattagaggaagactcacatctctcagaaactatatattaagcaggcaaaaaaattattaaagacaacgggtgcggtggctcatgcctgtaatcgcagcactttgggaggctgaggagggtggatcacgaggtcaggaggtcaaggctatcctggctaacacggtgaagccccatctctactgaaaatacaaaaaattagccaggcgtggtggcatgcatctgtagtcccagctactagggaggctgaggcaggagaatcgcttgaacctgggaggtggaggttgcactgagctgacatcacttcactgcactccagcctgggtgacagagcgagactccatcccaaaaacaaaacaaaacaaacaaaacacacgcacacacaaaggtgggagtgttatgtaagagaactgcaggggatatttccactcccaggctcaaaggggtgaggggagagagaggttacagcagtggttcttagttattttgtgccacagatccctttggcattctagtaaagcataaaatttaaaaaatatacatacaaaaacaaatcggccaggcgcagtggctcacgcctgtaatcccaacactttgggaggccgaggcaggtggatcacccgaggtcaggagttcgagagcagcctggccaacatgacaaaaccctgtctctactaaaaacaaaaaattagctaggcatggtggtcggcgcctgtaatcttaactacctgggaggctgaggcaggagaattgctggaaccgggaggcggaggttgcagtgagccgagatcacgccattgcactccagtctgggtgacagagcaagactccgtctcaaaaaaaaaaaattgcatcgaaatcaaattccagttatcaaaatattaataaaaactttcaatagagtaaattgaaactgtcccaagattgacaagaattgcatgctgggatctgggcagaaatatagttataattaagcataaaccaggctgcactttggctcactgctctattcctgcaagtctccagatcctgaccatctgcatccccgttgtgctaacattaggatgagaatgtctctatattatgatccattgtctctatatttaaaaaaaaaaaaaaaaagaagccaggcacggtgacttacgcctgtaatcctgacactttgggaggctgaggagggcggatcacgaggtcaagaaatccagaccatcctggccaacatggcaaaaccctgtctctactaaacatacaaaaaaattagctgggcttggtggcgcgcatctgtagtcccagctactcaggaggctgaggcgggagaatctcttgaacccatgaggcagaggttgcagtgagccaagatcatgccactgcactccagcctgggtgacaaagcaagactctatctaaaaaaaaaaaaaaaaaagaccagcactgtggctcacgcctgtaatcccagcactttgggaggccaaggtgggcagatcacgaggtcaagagtttgagaccagcctgggcaacatagtgaaaccccatctctactaaaaatacaaaaaaataatggcatgaacccaggaagtggagcttgcagtaagctgagatcctgtcactgcacaccagcctgggcgacagagcgagactccgtctcaaaaaaaaaaaaaaattgctggacgtggtggcgggtgcctgcaatcctagctacttgggaggctgaggcaggggtatcacttgaatccggaaggtggaggttgcagtgagccgagatcgcgctactgcacaccagcccgggcgacagtgtgagactctgtctcaaaaaaaaaaaaaaaaagataattagtcaccatggctgggtgcagtggctcatgtctgtaatcccagcactttaggagggcaaggcaggtggatcacctgaggtcaggagttcgagatcagccagagccaacatgatgaaactccttctctcctaaaaaatacaaaacttagctgggcgtggtggcgggcgcctgtaaccccagctactccggaggctgaggcaggagaattgcttgaacccaggaggaggaggttgcagtgagctgagatcatgtcactgcactccagcctgggtgacagagagagactccatctcaaaaaaaaaaaaaaaaaaaacctaaggcgtggtggcacatgcctgtcgtcccagctactcaggaggctagggtgggaggatcacttgagcctggaggttgaggctgcagtgagccatgaccatgccactgcactccaggctgggcaacagaacaagacgctgactcaaaaggaagaaaagaaagagaagaaaagtctatctgggtatgatgatgactcctaatatcttctctctggtggttgatctggtcatttgataagatctctaggcaggaggtcttaagacaattgcacttcttttgcaaagaagttttttcagtcagataaggaaattccagaaagtgtggtaggacaattctaaggcagcttctaaggcctctcagcatttcaaagcaccagtctttggggtatcactttctgagccccagcatcttcttgcatgtctattcttttcccctcatctctgtttccttctcagaaggccctgagtttccttctccacccgcttgtcttcctatatacccttcagtattcactttttttggtgggggggatggagtttcgcttattgcccaggctggagtgcaatggcgtgatctcggctcactgcaatctccacctcccaggttcaagcgattctcctgcctcagccacccaagtagctgggattacaggcatgcgccaccatgcctggctaattttgtacatttagtagaaacggggtttctccatgtttgtcgggctgatctcaaactcctgacctcaggtgatctgcctgcctcggcctcccaaagtgctgggattacaggagtgagccaccgcgccaggcctagtcttcatttttgtcccacagtcagagcagctgtcattctctctatcccaggcagtttttctgagcatctaagcactgtctcaccccagtagtctgtcaagccattctcaatggaaagaccagtctgggaggcagtctcactcagaataaaagccagagtctttacaaggccctacccaagctgacctcctcctcacctggcttcagcagcacaggcctccctgctactccatgaacactccagatatccacactgctctcacatcagggcctttgaacttgctgttccctccacctgaaatgttcttctcccattgtgatattgttataataaaaatatatatttttgggcccgggtgtggtggctcacacctgtaatcccagcactttgggaggccgaggggggcagatcacgaggtcaggagatcaagaccatcctggctaacatggtgaaacctcgtctctactaaaaatacaaaaaaaaattagccgggtgtgggggcaggcacctgtagtcccagctactcgggaggctgaggcaggagaatggcgtgaaaccaggaggcggagcttgcagtgagccgagatcgccactgcactccagcctgggcgacagagcgagactccatccccccacaaaaaaaaaggccaggcgcggtggctcatacctgtaatcccaacactttgggaggccaaggcggtcagatcacaaggtcaggagatcgagaccatcctggctaacatggtgaaaccccgtctctactaaaaacacaaaaaattagccgggcgtggtggcaggcgcctgtagtcccagctactcaggaggctgaggcaggagaatggcgtgaacctgggaggtggagcttgcagtgagcggagatcgcgccactgcactctaacctgggcaacagagcaagactccatctcggggaaaaaataaataaatatgtatatatatgggttgggtgtggtggttaacacatgtaatcccagcactctagaaggctgagaccagaggatcacttgagcccaggagttcaagaccagcctgggcaacctggcgagacttcatctctacaaaaaattttaaaatgagccaggcatggtggtgcgggtcccagctgcttgggaggctgagatggaaggattgcttgagcccaagaagttgaggctgcagtgagctatgatggtgccactgcactccaacctggatgacagaacaagaaactgtctcaaaaaaaaaaaaataaaaaaaaaaaaaaggtcaggcacggtggctcaggcctgtaatcccagcactttgggaggccaaggtgggaggattacttgagcccaggcagtcaagaccagcctgggcaacacaaggagaccctgtctctaaaaaaaattttaaaaattagccaggtgtggtggcacatgcctgtagtcccagttactcaggaggctgacaagggaggatcgcttgagcctgggaggtcaaagctgcagtagccatgtttgtgccactgcactccagcctggataacagaacgagaccctgtctccctgtctcaaaatattaatgtgtgtgtgcgtgcgtgtgtgtgtgtgtgtgtgtgtgtgtgttttggtctccatcctggctcctggccagacctcctaaagcccttgtaatttcctaaatgataaagtgaagggagcttttgttattcataacaagctcttttcaaccacaactgagtttatgttagtaagttgacttttagaaagcccctaaggttggggtttgttgccaaggtaggcaactgtgtgattagagagttagaacttttagctccaaccctctgacctccaactaatggctattgaatcaagtatgcctgcataatgaagcctccataaaaaaaaacaaaaaagatgagggttggagagctgccaggttgatgaacacatggaggtgcagggaggtgcccagagaggacaagaaaactccaaatcccccttccccgatactttgtccggagcaactcttccatctgactgttcctaagttttatccttcataataaactagctaacataagtaaagtgtttacctgagttctgcgtgctattccagcgaattactgagccagaagagggagtcataaaaacagttaggaggcctggacttgtttgtgattggtatctggagtgggggcagccttgtagaactgagcccttcaacttggggattagataactggtaattatgggtagagtgtcagaactgaattaaactgcaggactcccagttaatatctaccaagaactgaagaattgattggtgtgggagaagtctccacatgattggtgtaagaagtggtgttcttggccaggcgcagtggctcacgcctgtaatcccagcactttgggaggccgaggcgggccgatcatgaggtcaggagattgagaccatcctggctaacatggtgaaaccctgtctctactaaaaatacaaaaaattagccaggcatggtggcgggtgcctgtagtcccagctactcgggaggctgaggcaggagaatcacttgaacctgggaggtggaggttgcagtgagcagagactgcaccactgcactccagcctggccaacagagcaagactccatctcaaaacaaaataaaacaaacaaacaaaaaaaactgagattctttgcaaagagcctggaataacttccttttagtcctggactataatgatgatgataaatatacctcgatgtaaccctgagatcccaagattcactagcccttgaataaaaaaaaggaaaaagaaaaaaacagtatattttttcgttttgcaaatcacagttcccttattaagatggaattgctgccaattacagagaagctatttgcctaagccaaaaatccatgaggttcacatggacttatagttacacaaattagaaacaaatgttatatttaaaaccatagagaaatgcccaggtgatgaaagctggggtgaaggagtctgcacattcatttcaaactgttaaaggatttgtgggccatgcaatggtcccttgcattagagaagtcaaagagctttgtgcaatcctctcctgtctgtgatctggaagacacgtgctcatcacagagctccagctgctccgagactttactcctttcttcagctgcacgcactgctctctcgcttttgttaggaattgactaattcctcctcttcctcttcctcctcctccttgccatctctaggcccagtcagcatctcttgttcatcctctgatcccatgtccagctatggttctggattcaacactagcagcaacagtggcgctgactccactttaggatcaataaatatttttctggctaggcgcagtggctcacatctataatctcagtactttgggaggccaaggtgggtggatcacaaggtcaagagatcgagaccatcttggccaacatggtgaaacctcgtctccactaaaattacaaaaattagttgaacatggtggtgcgcacctgtagtcccagctacttgggaggctgaggcaggagagtcgcttgaacccaggatgtggaggttgaagtgagccaagatcgcgccactgcactccagtctagcgacagatggagactctgtctcaaaaaaaaaaaaataagtatttttctttctagccgtatatccaccttacatggtccctcaactccccaagcccactctgcctgccccatctcctccttccacatcctctcctcaacctagcacttggttggcaatgccttcctcgatcctctgccaaagaccctctagccagtgcttaccctgtctgttctctctctttacccaaagaaatacataaagtttgaccagaatggaaacagagatatcagtgaaaaaaggtgatttggggaagtgtgcaggcctaggaagacagaggcttgttcctttgcttgcttaaaatctttgatcaaacggccaggcgtggtggctcacacctgtaatcccagcactttgggagggcgaggtgggcgaatcatgagatcaggagttcaagaccagcctggccaacatagtaaaaccccgtctcactaaaaatacaaaaaattagccagctgggcgtggtggcaggtgcctgtaatcccagctactctggaggctgaggcaggagaatcacttgaacccgggaggtggaggttgcagtgagtggagattgcaccactgcactctagcctgagtgacagagtgagactccatctcaaaaaaaagaaaagaaatctttgctcaaatatcactttttcagagaacgcttctctaaccactctatttattttattattttattgtattttttgagacagggtctcactctgttgcccagactggagtgtaatggcacggtcatggctcactgcagccttgatctcctgggctcaagcgatcctctcacttcagcctcccaagtggctaggaccacaggcgtaagccaccgtgtctggccagaccaccatatttaaaactggggacaagtcaggctcacacctgtaatcccagcactttgggaggccaaggtgggaggatcacaaggttaggagttcaagaccagcctggccaacttggtgaaaccccatctctactaaaaatacaaaaattagccgggtatagtggtgatcgcctgtaatcccagctattcgttaggctgaggcaggagaatcgcttgaacccgggaggcagaggttgcagtgagctgagattgtgccactgcactccagcctgggcaacagagcgagattctgtctcaacaaaaaaagctgggtgcagtggctcacgcctgtaatcctagcactttgggagtccgaggtgggtagatcacctaaggtcaggagttcaagaccagcctggtcaacatggtgaaaccccgcctctacaaaaatacaaaaattagctaggtatgatggcaggtggctgtaatcccagctactcggaaggctgaggcaggagaatcgcttgaacccaggaggcggaggttacagtgagctgagatcaagccattgcactctagcctgggcgacagagtgagactccgtttaaaaaaaaaacaaaaaacaaaaaacaaaaaactggggaccattggcaataatactcctatgtcccctcttccctactttgttttcctccataggcacctggcgccttttttttttttttttttttttttttgagacggagtctcactctgttgcccaggctggagtgcaatggcgcgatctcagctcactgcaacctctgcctcccgggtttaagcgattcgcctgcgtcagcctcctgagcagctgggattacaggcacgcaccaccaggccctgctaatttttgtatttttagtagagatggggtttcaccatgttggtcaggctggtctccaactcctgaccttgtgatccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactcccagctacagaaaaggaaatatgttggggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgtgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcggcattagatcggaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggtcaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttccgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttcttttttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattaatttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggtgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtaaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctagttctggttttcctgagatacttatttccattctttctgtctgtctcttcaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgataagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacatcaggctgggcgcggtggcccacgcctgtaattccagcactttgggaggccaaggcgggtggatcacaaggtcaggagttcgagaccagcctggccaatatggtgaaaccctgtctctactaaaaatacaaaaattagccgggcgtcgtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttaaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgcagtcgtttttgtatatcagaccggagctaaagagaaaaagtaagcaggttggagaaacgctggccaagtccccatgatcccagcaagcacacaaggccatccctcagaagctaacatttccccccccaagcacactgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggatagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagtggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccacttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgccttgaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaacacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggctgtcagaaagcagtgacactaattactatactttctttttctaaacctcattttcttcatctttaaaatgaaaggttcagagtcaatgaattcccagggccccttcccctaacatgtcactaggggctcttacccagtggttatataatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagaccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccattgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccggcgccctgctggatagagagcaagggagaatttcagacctgcccttccatgcaccaccacaggagtctctccctagactgttacgcactagaactccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccactcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccacatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctcgggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaattgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccaatctcagatgatccgcccaccttggcctcccaaagtgctgggattacaggcgtgagccactgcacctggccctgttgcaatgtttttccagggagggaaagagttatctgcatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgtttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccgtagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgatgtttgagagctcaaggctactgg

SEQ ID NO: 266 - DNA, 44816 bp, Homo sapiens
tgtgttttgccaggggatcctggcactggggtgagtgtgaggattagctcttgtcgaaggctctttccaactttgattctaggattaatcgaattaacactgcatttccatggtactagaggggaacagcagttgagctagtgaactgatggaaatacttacacactaattggtatggggaaggtggaataactagaagccctttaaggtatcttccaactctgagattcttattttgtgattccagattctgaaagggagccactgtagagctactggcagatctacacagctgacaagatgcagctcacccctctgtctcaggtctcaggacaacacctggtgtgtgcacgtgggtggggggtgggtgtgggaagcagagatgagggcaggaaaagatagacatctgcagggccagagcttgggcacacacacacacacacacacacacacacacacacacacggtggagatccagagttggacccttcccttagctgctggccacagtcatctattgttggggacacagctgcctctacctcctctcccaaaaccagtgcaggcttgaggcaacctaagacaccaaacctcagaaccaaagtccatttgccaaagcataggtgccccctcaaaagctgggggacagaagatggtgctgagcacagaagctactgccagcatgaccagaaggtatcacttaaagtggcatccttcagccatctctgtgtgctctgagactgtggataagagtcctctagtcacccactacctggcatccccctctcactcccctccctgtccccagagctcctgctctctgcttccctccctttaatgcagggtggataggcagagaacacaggacgcttcctgccctgggccctgctcagacctcagtggttcaaacacagccctccccacagagttctcactacctgctccccattatgaccacagcctctctgcatcacccacaggtaacatggcccttggcagactgctttctccatcccacaggactcccacacacctcaccccactctgcctcctccactttatactggccaaaaacgtgactttcttaacaagccaaaaagctgctcatcctctcccaatatcccacccttgaactttgaaggctgagtcaagagttttacttctgtcaaaacacagccagtgcagagggccaaccttcttccctcccactgaggaactggaggggcttcctcaaggtctcatggacacagccttgcagctttggaagcagagagagaacaaaacccctgactcaattctcttcctcttttgctcctagagactgttctttttcctgccccttaggagacacagacaccgtagcaaccgcactaagcccagcggtaatgtgttttcctatatggagttccacccacctatgcaggagtccaccactgactatcttcatcataagccaccctgcccccaaccagcactatgctcaaaggcaaaagaaacaaccaaacaaacatgaaatgctggtgaaaactgcttttgaaattccacatgcccttaaatgttaaatgcagagaactcctcacccctccccacccccaccactagttcttatgtccccagcttcaaataaattcaaactgggtcctgtctggacaccaccaccagcacccacctctcccctgacaaggggcaatgggtaatagaaggctaccatgagacaggcaagaatcactggaacaagccaatcacttctcccccgcctctagacaccccctctccaggggacagaagatccccacctgtttgactactcttcttcaaatagtacatccctcaatcccacccagcaagagacactggctctccaaacacagccagagaactgtgaccctggtgttcaggtaaagccaggaataagacaagagaaggatcaacagagactgggacatgtgccactgaggcagcagacatgctctttaagtatctattttaagaaactatttattaagcacctactacatgccagacactatgctagataactttatttcagatcctctcaataaccagaaagggaggtattaccctgattttacaaataaggaaattgtgtggccaggtgcagtggctcacgcctgtaatcccagcactttgggaggccaaggtgggtggatcacctgaggtcaggagttcgagaccagcctggccaacatggtgaaaccccgtctctattaaaaatacaaaaattagccgggcatggtggcaggagcctgtaatcccagctactcaggaggctgaggcaggagaatcacttgaacccgggaggcggaggttgcagtgagctgagattgcgccactgcactccagcctgagggacaagagcgagactctgtatcaaaaaaaaaaacaaaaaataaataaataaggaaactgtggctcagagaagttaagtaacttgataggaggtaacatggactactttttgatgacctctcactctaggagactgaccaccactgacttcccctactaagcccaattaatgaagggaaggtcagaaggaccccccctcgccccccctcaaccccccacaaactgaacttcccactggggggagcagcagaagggagctgcttttcagcagttggaagcccaggaggaaatagccccaggagatgttaaataccacctgaagccccttggcatggctccatcctgcagcattatttttaccccgggcagcaaacatatccagcatgtgcagaaggaaactgcccccggctggcagcccactacttaatctgcatgaagagctgagctggccaaagcaggagacggccatcctggctggcaacagcactgtcaaatttgatggggacacagtgaccagggtaaagtgcccaagctctctgtcaacaagtaatcagcatgaaggtcctataacttcaggatgtatgggggaaaacaaggaagagtttatcctgctgggatatcccaaccccccttttcttgggagacccagaaatgtggctctccctaatctacaaccattcacagactgatctctccctgacaacagaggtaatgtaagtacgcactgaacatacacgtttgacacacagtaagtacttaatgaaagagagcaattaaaacaataatttttttcccagacaggcattcctctcttcccagaggtcttgtctaccacctcccaagcccctggcaaaaagagacaaggggccaggcgcagtggctcacgcctataatcccaacactttgggaggcaaggtgggcggatcacctgagatcaggagtttgagaccagcctgaccaacatggtgaaacccggtctctactgaaaatacaaaaatcagctgggtgtggtggcgcacatctgtaatcccagctactggggaggctgaggcagaagaattgcctgaacccaggaggcagaggttacagtgagctgagatcgcgccactgtactccagcctgggtgacagaatgaaactgtctcaaaacacacacacacacacacacacacacacacacacacgagtcaagggcacgtgcccctctaacacacttggttaggatcttcaaagccgagttccaaactgaaactaccagcaagcagttcttccaggactggggaactcagcttcaagtacactaggacctccttgcagaggctatgagaacccctggtaagaactgctctggacaggaaacagtcccttggactgccccctcacctcttaccttgctactggagtgaagataggtgggggtgacaactgcagggagaggaatctgttgtttaaattctgactctttcccaactcagagcgattttgagcaagttaacctctctgcacaattgcttcctctcctactaaaaggaaaataaagaaaacaggccctgtttactaagcactagagattgcatttttacgtgtgacaggataaagtcacacactttgtaattccttagctgacagagggcgctggatgtgatatgcggagggaaagactgactcctttttcagcagactgctctctgtcccctcccaagggggtgggttcacaggtactgcctgagtatcaacctaccaccaagatcgcccacgtgcccttgttttctgaaagggtgaagctgtataaggccaagatcaacaccatcaagtttgaatcattcaggagagataaaggagagactgagtcattccagtctattactacgtctattactactattatattctatctgagccagagtgtctgctcagtgattcttcttttttgttgtttttacattttttaaattttatttatttcattgagatggggtctcattgtccaggctggtcctgaactcctgtgcttaagtgatcctcccacttgacctcttgagtagctggaattacaggaatgcactaccattcccggcctgttttaatatttttaaattcagatataattatcataccataaagttcacccttttaaaatgtacaattcagaggtttttcacattgctcatggcttcttaagtctaaacttgaaagtggaggaggcgcaagaaaggagatttgattaaaaggaaaaaaaaaatcttccacgtagagaaaggtttccaaagcccaagtaagggagattctggtcaaaacctaaatactaggtctctctcttgaaaatcttttccatattggaaacaggattatgttctagatctaaggcctactattattaagtgtgtatagacccagggctccgctttcgccagtctagaaaaggcatatcacactgccctctagtagacagcctaggaaatgacagtcagctagggactggacaggcttgcgatctctgccctacaagatgtgctgtgttctcacacttacaggcagagaaattggagggggtggagtttttaaatgttcactaatgcctactaaataaacatagagctcacctgaaacagaatctaactgctttccctacaccttaatctctgcttaaaaataaataatacattcctgcgcatgcctgtaatctcagctactcggaagactgaggcagaattgcttgaacccaggaggtggaggtcgcagtgagccgagatcgtgccactgcactccagcctaagcgacagagcgagactcggtctcaaaaaaataaaaaatgaataaataaataaataatacattcctttgttaagggaaaaaaagtgatttcagatttctaaagcctctgagcctcttaagagtgaggtgttcctaagaaacagcgtgagggtcccacaaaaatgaagttaaaacccgaacccatacagaaacaaaacctagctgtgcagaaggggtgtgacaatgagctaggagttgaatgcctcctctgccaccttgggaaggcgagacagtaggatcacagcccacaagtttcaagcatgccatagcactccagcctgggcaacacagcaagatctgagctgtaaaaataaataaagtacttccatctcataaatgctgattctcgacacaattccagtttacattttatctccctacctaagcccttctctgacaatcactggccagagttagggaagagacatccctaacttggtagtgaccccaactgatactcccttcgggattttcaggtctcaaaactatttaaaaatctatgtatgtctcaaatggctgggggatggacagcctttctttacaagtctgagaagtatataatgtggcaaagataatatgttatgtgtccaacaacatccatttatcccttcttcctgatgcatattatatgcctcgggctcctttgcattaagagggagccttgtgactaggttcttaccaacagaatatgagtagaagtgtgtgccgcttctagagctagccggtaacatctgccaagcaatccttcacgttctgctcaactcactaaaatggtaatgcccaacacaaccttggaagccatagtgaagctggcatcagcctgatccctaaacaacttcatagagtatctcactcctactttctcaacctgaaacgacctgcatgttacacgagtgagcaggggggaaacacatgtctatttggagtctgctttagcagtttagtctaccctaactaatatgggtactaaatgtcaattccatgaaaccagaccttgcttctggagctgcacttagggcttcaggtgcacagaactgagttatcacaggcctgagttcatgatacacgatcactttcatccatgcaaagccctctttgcttccctttccccgcttcattctccattctagtctcattctgttccctcccacaaacctattctactgattaaggtgtatatcctccttataaaataatatcacttcatgtgtttatatagctgatttttgctttaaatttcactgttccttattttttcacttgaagtctaccatttcacgaaattcctaacagcttgcatttgacttaaaaaaaaaactccattatatgcatataccacattttacttatcaatttccttagtgatggacatctaagttttttccaaattcttgccacccaaactatacatagaaaaacatccttgtatctactcctcaaggatttatgcaaatttctccgaaggatatagccaggagtggaactactttgaagtatgtacataaagtattagttatctgttgctgtataacaattgttatggttataactgtaactgctgttgcttacctaccctaaatgcaaacttccttccctaaatgcttgagcagcttaaaacaataacaacccatagaatgagaaaagtatttgcaaatcatgtatctagtaaaggacttataaccaagatatatataaagaaccctttacgtaagagagtgcctgtgtatgtgtatatataaccaataacccaaatgaaaaatgggcaaaggatttgaataaagatttctccaaaagatatataaagatgctcaacatcactagccaccaggaaaatgcaaatcaaaaccataatgatataccacctcccacccatcaggatggctataatcaaaaagacaaataataagtgttggcaagcatgtggagaaattggaacgcgcatacatttctttggaataagtttggcagttcctcaaaaagttaaacatggagttacatatgacccagcaatttcactcctaggaatatatccacccctaggaatataaaaaagaaaatatacatccatacaaaaacttatacatgaattgttcacagcagcattattcataatacccaaacagtggaaacaactcgaatgcccatcaaatgatgcataaataaaatgtggtatatccgcacaagggaatattattcagccttaaaaaggaatgtagggctgatacatattacaacatggatgaaccttgaaaacattatgctaagcacaaaaagccagacacaaaaggccaaatattatatgacagtctcactcatatcttattaatatatgaaagtccagaacgggcaaactatacaggcagaaagtagattagtgtttgcctaaggctggagaagttaggggaaagtggggagtgactgctaatgggtacaaggtttcttgtacccacaagatgataaaaatgttttaaaattaaatgtggtgatggttgcataactctgtgatatattacaagccactgaatcatacaccttaagtgggtgaattgtgtagtatgtaaattatatctcaataaagcagtttttaaaaaatactaaacatggccaggcgcagtggctcatgcctgtaatcccagcactttgggaggccgaggtgggcagatcacgaggtcaggagttcaagaccagcctggccaacatagtgaaaccccacctctactaaaaatacaaaaattagctgggcatgggcacctgtagtcccagctactcgggtggctgaggcaggagaattgcttgaacccgggaggcagaggttgtggtgagccaagatcacaccactgcactccagcctgggaaacagagtaagactccacctcaaataaataaataaatactaaacatttattatctcagagtttctttggttcaagaatctggagctggatgttctgggtcaggatctctcacgaggtcgatcagggctgcaagcctgagggagggcttgagtagagctggcggatgcacttccaaggtgattcactcctacagaaggcaatttggtgctggctgttggtgagaggcctcagagcttctctacctgggcctctccagagggctgcttgagtgtcctcatgatatggaagctggcatcctccagagcaaggatccaagatagcacaaggcagatattttaataccttttatgacctaccttcgtaagtcacacatttctagtacatcctattggttacacaggtcaaccttatttattgtgggaggggactatacaagggtttatataccagagggcagagatcattaggggccatcgtggaagctggctgccctacttgatgataatgatgacaatgataataataacagctaataattctgtgacactactgtgtgccaggcattgttctaagcttacaataaacctatgaggtaggtactattatgtctatttcacagacgaaaaaactaaggcatagagaagttaactggcttaccaaaggttacacagctagcaaacgacatagctgggattcaaattcaggcagtatagctccagagccacactattaaaaactgcaatatcgctccctaggtattacttgatttcagtaagtttcattcatttgttctccaaaatgaatacaccagctgaaatattccatgtagccgggcacagtggttcatgcctgtaaccccagcactttgggaggacaaggcgggcggatcacctgaggtcaggagtacgagatcagcctggccaacatggtgaaaccccatctctactaaaaaaacaaaaattgtgtagcgcatgcctacagtcctggctactcaggaggctgaggtgggaggattgcttgaacctgggaggcagaggcaccactgcactccagcctggatgacagagtaagactctgtctttttaaaaaaaaaaaaaaaaagaaagaaaggaaaagagaaaagaaaagaagagaaaatattccatgagttctgattccccatcagatcagtctcttgcttatttttgccaaactaagatgtaaggtagaaactcagtgttttaattagcgtatctgtaattactagtgaggtaatatacttatgagccactctggttttctctttagattttacctattcatatttttgcatatttttatttcatctgtctttttcttcatgatttgcagaagctctttctatattctatcccttgtatatgcaatccttgtcagttttagacactgcaaatattttctcctaatccgtatccatctttagctttgactatgggatgctttgctaaatagaaacctttaattacaaagtaatcaaagctatcaaatcttatgcattgtgctttgggatcttatttaagaaatttatctttaccccaaggcacaaaaacatttgccatttgttcctactagctgtatatcacgttatctttcatttaggtctttaatcactttgggatttttgttttatatggtatgagggttcaactttatttttgtccatataataagccaattttctgagcactattatccatctcttccctactaacttgtgacactatctttatcatacaccatgtctccaaatatctgtgtgtctattcctgagtctagtttagtactaattcctgttttctcagaggaaggatctatcactaagaaagtttttactcacactgctttctagattagtgaaaaattcaaccaccaccccccaaatccccacaggttcaatattagcctgtattcttcccaaaacagaatacccagttaagaagataattttaaaaaaataaatacatgtttatttaaaaaagaaaaagaaaaaccctaccaagaacaaaccctggtcaatgagaaatcaatgcttcctctgaaagccagcaacagccggtgctgtcacacccaagaagtacaggtacctcagtccaaacatcaggtctcgaatattcttctgtggtcaaaactggcattcaacaagttgctggtctgtgtgggctccaattattagcacagacaactgttaccactggatatctcgctgcctatgcccactaccacagcccagccacccccacagcctcaggaaagttacatatcctcaacactccatttgtaggcaagttcctccactgccttcttgctggcaagcctggcaaagcgcttctgttcaaatccattggatctgcaatcaaaagagacatactattcagctagaaccctgaaaggggcatttgtttcaaaagaaagggaagagttcacaatataatgaaaaggggggaaagtaaggagtcatatgaaaatattttaggcatggccgggcacggcggctcacgcctgtaatcccagcactttgggaggccaaggcgggtagatcacgaggtcaggcattcaagaccagcctgcctaatatggtgaaaccctgtctctactaacaatacaaaaattagccaggtgcagtggcaggtgcctgtaatccagctattcgggaggctgacgcaggagaatcgcttgaacctggacagcagaggttgcagtgagcggagatcgtgccactgcactccagcctgggtgacagagactctgtctcaaaaaaaaaaaaaaaaaaaaagaaagaaagaaacaaaaaagaaaagaaaatatttaaggcatatgcaatagaatcaaagggacaaaatatatcattcatccttttcttagtccttgttcacacccttcccccactctgacagctatttcaaacgtttgccactctaaaagcctggttctctctcagctgatgtccacatcttatattttatccattcattacacaaacatttattgaattttcattatatactaggtaccatggtagacactacatgaaaatgagtatgacacagcacctgtcctgatgaactcccagactagtggaagagagagacatttaaacaaataaattaaaagaacagcataaactctggtagaaatacgcatggggtgtcatggaaacagaatgggtatcttaatcagcttgggggaggtatgataaaaaggtgacatgagggttgggcaagaatgatcagtaaaggctctgtgttaactacagcactggggatggaagggccagaaagggtctggaggtcatttcagaacagaatgagcaacaagaacaaaggcacggaaataagaagtggcctggtatgtgcagcaaaccaaaggcaaactggtatggctggaacctgaagtatgacaaagggaacagccatgagtcaaagttggaaaggcgcagaggccaatgcataatgagctgcgtaggccatggtaaaaagcttagatttcatccagaaacgatgggtttaaagcaagaacttaaactgcatttcaaagagatcactctggaggggatctggggcaggaaaatcactgcaatggtccaggcaacagatgatgaaggcaatgataaagagggacggaagagagaagacacaggaggcaaaattagtaagactaattagcagcactaattgattaggtacacaaggacaaagaaggaggaggcaagttagagagcacaagagtaggagcaggcttacagtagaagctgatgagttcagctttgaatacaatgcatttgaaatctctcaagtctaaatcaatagagaaatccaacaaacagctaaatacaccagaccaagatgcaaatactgatttggaaatcatgtacatataggtcatagttgaaaacatgactaggtaagaatcagccagagggagcacatagagtgagaacagctaaaaattatggatggagccctgggaaagacttaagaggtgcacagaggaagaggagtttgcaaaggtggccaagaatgatcagagaaaagaaccaggagtagggtgtcatggaaaacaatacaggggtgaatttcaaggaggtagtgagtggacctcaaatccctttaattaccatgcattctcttggtcttcttatctaaacttcttaaaaagcctgtattcactatttgtttcctcacttttcattcactccttaatacattagaacctggccattgtttcactacacaacggaactagccctttcaggtcatcactgacattccttgttgccaaatccaatgactcctccttcctcttccccaaatcagcaaacaggtcccaccagctcacccctgaccacatccccacttcctattctcttactaaccatccttactaccactgcctgcaagtcgtagttcagacactcattactttcagcctgagctactgcaaaagccttgtatctgttctacttccaatcttgtacctttcaaatccttcatattactgctataatggatttgtctatctaaaatgcagagctgtttttaatccttccgtgtctcccctttacctctagggtgaagaccaagctcctcagataggcttccagggccttctgtgatcacggtctgccaacctctctcatccatctcacgctttatgctatccaacaacagcaaattacttagggacccccaccacctggtaacaccatggtgtctcatagccttatgactctgcacatataggaccctcttcctttaatatccttcctttccttcttatcttggctggttaccaacatcccttaaaactcagctcccacatttcatccgttaggaagcacttcctgatcactcacatcctcctaaggctcaacttactcttcctttgtgctcccaaaacatcttgaaaatcttctatagtaacactaaccaaacagcgttgaaactgtctgtcttctattctagattgaaagtgagctcctgggctcaggggctatctctctttaatcatggaatccctagtacctactacctagctgcttacacttataacatgtatgctaagactttcccttaagggatgagtggagtgagtaacagagggctttaagaagggaagcttggccggacatggtggctcacgcctgtaatcccagcactttgggaggccgaggcaggtgaatcacctgagatgagaagttcgagaccagcctggccaacatggtgaaaccctgtctctactaaaaatacaaaaattagctgggcgtggtgctcacgcctgtaatcccagctactcgggaggctgaggcaagagaattgcttgaacctaggaggcggaggttccagtgagccaagatcgtgccattttgcactccagcctgagcaacaagagcgaaattccgtctcaaaaaaaaaagaagggaagcttattataaatggcatcctctccaaccttagaagcatggatggtattccaaagcaccaaggaaaccactgttttttaccttggaaataaggtcttaagagagttacactaatatgataatacaaaggacatatgaataacaaacaccaaatcctaagcagaatcagaaaacaaattgcaggagaactcacagtggaaagagctttggaccagagaatcaggaacgcagagttctaattccagctttctcagggaaattgcatgactctaggcaaactgcttatttattgggcctcagtttctcttttttttgagacggagtcttgctctgttgcccaggctggagtgcagtggcacgatctcggctcactgcaagctccgcttcccgggttcacgccattctcctgcctcagccttccgagcagctgggactacaggcgcccgccaccacgcccagctaattttttgtattttttttagtagagacgaggtttcaccatgttagccaggatggtctcaatctcctgacctcgtgatctgcccgcctcggcctcccaaagtgctgagattataggcatgagccaccgcacccggccccgtttctctttcaattaagagaggctgggtaattatcttatgggtttttccaacagatactatatatctgttccggaaatattcccttgcagcaggccgaaaagagacaaaactagaaaagatgatgaaagatgaataacaaaaagaaagcaagggtgacaaagggaaataagagaagaaatctaggataaaatcagaacaagaagtggaaaaaagcaactgagaaaaatgaagacaaattaaatactagtaaaaaaaaactaggtcagggagaattctaagttttgggtccaaaaattaaaaaacaaaaaacaaaaactcggtagcagggaacatctgtagggttgtgctataaaaagatctacttctggctgtatgtatggcaaatgagtgttctgaaaaatcctccttctaccaaaaagcctacatacagtgaactgcaaacggaactagtaagctagcctgtaaccacagctaccctaaagatatctgccaagatgaggaactacagtcaacttatagatatctgccaatatcagaaagaagagccttaaatttttttattctggagttggggtctcactatgttgcctagcctggacttaaactcctgggttcaagcgatcttcctgcctcagcctcccaaatagctggtactacagacacacgccaccacacctggctgttggattttgacggcaccccgagggacagaagacaacgccttaggcccatataaggtggggagacagattctagacattgcagagtaacccgaacagactaacctatcctcagttagcaactataaaacctagacaaaacaaaaaaaataggtatttgaaggtgtggaagagtgaccaaaagtaagtatgaactggatgaagtctatatgtgaaaagagatttgctggagggcaacttcccaaacagcatggctcatgaaggcagaaagccacaggcttactggcttgaggaattagtgcaaagtgggcagaacagctaggaaattaggggggaaatcttggaagagaaggaactacaaaagagatgaacctcaaaatctacatacaaaccctagtcaaatccttggctaactgttaaatgacacatgtgcagagaaaataccatcaggccaattaaaaaaatggcagctagaaactaaaagaactgagcaaagattgtagctgccgtccactgcaaaggagacagtttggagttcagctatgttaactacctgctagaataaaaactaacacacttaagaggaatacagtgtaacagaactcaaagtctctacagtgtatcattcatgatgcgtagtaacaattttaaaaagtgaccagacaggtaaataaacaggaaaatgtaatacacactgaagaaaaagctgtcaatagaaaccaatcctgtggtgaatccaatgttgcaattagcagacaggacttcaaagcactaattacatatcataaatattttcaagaagaggaaaatgtctcataatgaacagatgggaaatctcagcagagaaatgtaagctattaaatggaaattttagagttgaaaaacaaaataaaccagctaaaacaaaaaatccacaattgatagtaactgatagaaaaatacaaacacaaaaaacccagaatacaggcgatctaagatctaaacaccttgacctcactgacttttataaaacactaccttatatagctacagaatatacgttctcttcaagtgcaaaggaaacattcagaagatagactatccactgggccataaaacacaccttaacaaatttcatttttattattgttttttgatacatggtctcactctgtcatccaggctggagtgcagtggtgcaatcacagcacattgcagcctcgacctccctgggctcagtgatcctcccacctcagcctccacagtagctgggactataggcgtgtgccaccatgcccgactaatttttgtatttttttgtagagacagggttttgccatgttgcccaggctggtctcaaactcctaggctcaagcaatccgtctgccttgggctcccaaaatgttgggattacaggcatgagccactgtgcctggccaacaaatttcaaaagatcaaaatattacagtatattatctgaccaaaatggaattaaattataagtaaatagcagtaagatatctagaaaagtccaaatatttggaattaatgcactcctaaataacccatggagcaaagaataaaccaaaaggataattagaaaatattttgaacaaaatccaacatacattcctgaaaacaaaactctcagcaaaacaggaatagaagggaactttaactccataaaggatatctacaaaaaacctatacagctacaacacatttaataaatgtgttgtaaaaactaaatgttttcttcctgagattaggaacaaagcaaagatgtctgctctcactacttctattcaacatctgcactgaagtgctagctaatgcaacagggcaaggaaaagaaacaaaaagcatctagattgtaaagtaagaaattaaactgtatgcaaagatggaagaccctctaggtacaaaatctgatggaatctataaaaagctattgtacaaagtgagctttacctgaaggaaaacaactgacaatacagtgtaacagaactcaaagtctctacagtatatcattcatgatgtccagtaacaatttaaaaaagtgaccagacaggtaaataaacaggaaaatgtaatacacactgaagaaaaagctgccaatatagaaaccaatcctgtggtgaatccaatgttgcaattaacagacaggaaggacttcaaagcaccaattacatatcacaaatattttcaagaagaggaaaatatctcataatgaacagatgggaaatctcagcagagaaattaagctattaaatggaaatagctcaagcaatggaaatgccagtgataacatttaaactttcaagtgtaaattagaattctgaaaaactgtgaactctttaacttcccattatttaaagagttttgtgataagaccggaagtgatgttaacaaaagtgattttctgatattgtatagtggaaatatgtcaacatttggaaggtctgaacaactcagcaaaccaatattttacaaatgaccaatgcatgatgttataaaatcatgcatgggtaaaagatccactcaaagtattaaaaaaattaatataacagtaaggaaagttctttgatctggtttcaggttccacatagctcacctttaagaaaccagcacttgttgagtttttgtgtaacattaagaaatataatatgccttctctttctaactacctatgtgtgaggctaaattttctttctatacttcaactgaacaaatcacaacagacaaatacagagtcaagttacctattattaagtcagacattaatgagatttgcaaaaatgtaaatcaatgccatccttctgttttttcacttggaaaatgtaattatttttcatttaaatatacagtaattatgttaacataattagtttatttttttttgaatgaataaatactttttaaatgtctgagttttaatttataatatggtaaatatcaatatatataatccacatcaacaaaagctttttgaggtcatcagtaatttttaagagcgtaggccaggcacggtggctcaagcgtgtaatcccagcactttgggaaatcgaggcagacaatcatatgagcccaagaattcaagaccagcctggtcaatgtggcaaaacctcgtctctactaaaaatgcaaaaattagctggatatggtgacacatgcctgtaatcccagctactcaggccactgaagcatgagaattgcttgaacccgggaagtggagattgcaccactgcactccagcctgagcaacagagcaagactctgcctcaaaaaaaaataagagtggttgggcatggtggctcacctgtaatcctgtaatcctgtaagcctgtaataccagcactttgggaggctgaagtgggcgggtcacctgaggtcaggagtttgagaccagcctggcaacatggtgaaactccgtctctattaaagatacaaaaaattagctgggtgtggcagcgggcgccggtaatcccagctactcgggaggctagggcaggagaatcgcttgaacccaggaggcagaggttgcagtgagccgagactgcgccactgcactccagcctgggcgacagggcgaggctccatctcaaaaaaaaaaagactgtaaaagggtcctgagattaaaaagtttaagaattattgtgctagatactaaaacaatgtcctttagtaggcaagaggagatgggatctaatatgtgagtatacaaactgactttggatggaagcaaatattcatccatcataacaggaagttagagtacgtgggtacagatgttggtaggtagacagatgaggtggggtagaggactggaagacattaaaagtgactgcctcctaaaaccataaagtgaataaagattcagaggctacattttaaagatatatcaggtagaaggctccagactacaactcatcactcaacccctctaaaccttacaaaatatcattaaaagtaaccaatgtccaaaacaaagggtgtcttatctgaaccacctgaggtgtttgtccagagctttaaaaagtattatgaaaaggaaacagaaggaggagtgttccaagcatgagaaataggatttgtggacctcagaaaaagaagcaagcaaagtgcatatttttcaccttgtgattaaagcagagaatgaaataaagtgtggagcaacttacgagtggttagggaaggttacagtcaggtagaaaatgtaagaaatacccaggcttacctgtccactccgtcccagcgatatccaggccagatattaaatctgttgggaggaggtgctggaccactgtagcgaggtctcactaatgagaggagtaagaaaaaagtattcagttaatgacatagtttaattcagagctggatggcaatgtggaattttcctttttttttagtagagtctcactctgttgcccaggctggagtacagtggcacgatctcagctcactgcaacctctgcctcctgggttcaagcaattctcgtgccttagcctcccaactagccgggattacaggcgtgcaccaccatgaccggctattttttttttttttttgtatttttagtagagatggggtttcaccatgttggccaggctggtctcgaactctaaggtgatccacccacctcggcctcccgaagtgctaggattacaaacatgagccactgcgcctggcctggaaaaatttttatatagaaagaccaattgagttgaatctaaactcacaaatacaatgaatttaaattatttgggaaatccttctttgcatatagctatgtatcagcatcctaatgattctctcttcacaagtcacctccagctgatgattcccagaagtcccaccttttttattcttgttctccttggccttattcttcttgatgaagttggccatagggtccccctctctttcctgttctcttagcatcctatccagatcttcgtcatcaatatagcgggccagaggcttttgcatctctttcattgcatcctccacattttgttgctgttgccggctctgggcaagcctgggcaaaaaggaaccaagagtgtttgctatcctgtatgacatttccacttctacacgagatggaccatactgctaagtttggacaatctcctctttctagtaccctagggcaaatactgagcagggtaaaattcccagaatacccactagaagcgtggaatatatcaatatcctaggaagaagattcagcacaccaaatttcccattactgataacagctctgaaggcataataagaaagtgagtgatcagaagagcagagaaatgacttgttccagtcactgccatcttgtttaccctttcagtggttcccttacccttttccccactgggcatacagctcatctctctctgagtccttttctgctttcctcctttgctctaaacgttcgagtttcaaattcctcttacgaccagacttatctcgaaatacggtttcagcatattgaaattcagctgcaaaggaaaattatactcaaatatcaggatcaaaatcagaaataacattctaagagatcaaatcaaccgcttgggattctaatgctagataagaacttctgcagccagaccaaagtagttcctaccaacatcttggtgcatattggcactgggcccaagaaatggcattttccttttttttttttttttttttttgagatggagtctcactctgttgcccaggttggagtgcagtggcgcgatcttggctcactgcaacctccacctcccaggttcaagcgattctcctgtctcagcctcctgagtagctgggattacaggcatgcaacaccatgcctggctagtttttttttgtatttttggtagagacagggtttcatcatgttagccaggctggtcttgaactacagacctcagctgatccacccgcctcggcctaccaaagtgctgggattacaagcatgagccaccgcgcctgggcgaaatggcatttttcaagaaggaaagaagcactgggattcactgagaaattacaacaatgcataaaaccagagctgaaatttgatagcaattaaaagttcaaaatatcaggtacaataagctaaattaaaaaaaaaaaaacagtatgagcctaaattggtctctgcactttcatatttttaccttcaaatgccatggtttcttgatcctgttccttgagctcctgctgttctcgctgtatgtcagttaacaccaacccagttttagccccagaatacatgtgtgcagcctatgcaacggaaaagggagcatccaacattaatgagatgatgtgacagtaggctccatgggtacacagttagttgcatttgtgtctaatgaccagcaataattaaacctaaaactctagctttatattctcaataattaccataggattcaaaaactataaaagaaaaccatcatcaaaaccatcaagtttaagaataagcagaaacactaacaatatattaaatggagggctacgcatttgtatttctgacttttcagtatataaactgcacacatgaagactatctcaggtcatctgatcagaaaccagtataaagcactaagccttccattagagacccatactgataaaatattccatttacagtacaaactcaagcaaacctaagatccttaaattgtggatatatttcatggtaataacagaagatctaacaaatgaaaactttttgctaatttccacttagcatcaagatagcaaatcagcccacgaatgaagcacacagtatatcttgatatccttcagcaacgaaattggaataatattaagttgtccatgaactaaatggatatataaaatgccaagaggtccagctgaaacagagacctcttttttccctaaaaaagaagaatctcacttcctgggtaaagaacaggctggtctaccctgccaggaccagtcttctcagagtcttctacagacaagatttacctgataagtctgcactggggagaaaaatgcacatcacaggctctatcattctgtttcttaaccacttacaaataagattcctttactactaccaatgttctttacaatataattactcaaggttcatatggattttggggttttttggctaattcatcaagccttatcatgaatttaaaacaaaccattgacttctcagacaacatgatttctaaaagtggtttcatattttaagtgcctctccttaagctctggatacagagacctatagtccaatttatactagtaaatcactaacactagatgcttactttgtcccagacactgtgctaagagttttacttacactggcttaattatcataacaaccttacacagtaggtactactattatccacaatttacagataaagaaactgaggtttagagatattaagcatcttgcccaaatctcacagacagtaagtggcagaaggagaatttctgtatgtgatccgtttgacacaatgcttgtgctccaaacttcactctgcaaattacagtcctcggtttattcctaagaaaataggaagtttttctagacctgttaaaatgagattgtagaattaagaggctataaacgcagaagctacttgggaaatctggtatctgtaagtccatctgggatgggttatagccagtttgccttcagaaggaaagacctccaaaggtccttttaactaagatttactacacttctcagagctacatccttcttcttggcttgattctctgggacatatataaagctgagagagaagagtcacacgaaaagaaggacatggctcctgaaaatcctgaccttctttccaggaggctgactccttcgaggcggggacaggtcagaatcagaagatttggtcctctgtctcctccttggtggagagaggtcagaatcagagctccggtgtctaggtctattccgtggaggtgacagatctgaatcagaatcctggtgccctggactttgtttatgccgtggagaagaaaggtctgaatcagttgctttctggcagtcacctggataggagcaaagaatctgtgtgactctgatgtcctctaggtgaagaacttacatgaaatctcctatggctgggagaagaacctagaaattaaagaattccttacattattattatttttttttttttgagacagtctcaggctggagtgcagtggcatgatctcagctcactgcaacctccgcctcctgggttcaagcaattattgtgcctcagcctcccaagtagctggaattacaggtgtgtgccaccacgcccagctaatttttgtgtttttagtagagatggggtttcgctatgttggccaggctggtcttgaactcctgacctgaggtgatctgcccacctcggcctccaaagtgctgggattataggcttgagccaccatgcctggccaaagagttctttaatccccttggaagaatctaaaaagataacttaccaagctaatgtacaatatttatttagttttcctatgaagaattatcattaacctaaacataagtatggatggcacaggagaagagcaaagtcagaaacaacttttaagaccaacaggtagaatatggcattctattcccaagtgaccactgactgtaactggtgtgtaaaatctccacacactcctctatgtcagtaaccccacccatggaaagacaaaataacttgtagtcagctctccatagtgtggcaaaagtcagaaatacctggaatatagtctgatatccttggactaaaggataacaaagtactttaattttaaaattaaaatagttcctaggaacaaaagagggagtaaaaaatttcactgcacaggcctaagttctagcgactgtataagcatcacaagtcacctcccaaagggcattctgcaatatgtatcgacagtctttaaaacgcccacatcttctgacccagtacatcaacttctcagctttctaggaaacttatatagaagtagttgaatttcgaggaaatctatctagaagtagataaggaaataatccaaaatggggacaacagtttatgtacaaggatgttcattatagaattacagaagaaaaaacttagaaataaccaaaaacattcattattaggaaaatggttaaatttgtaattaaacactattaaaaattatactaacataaagatgttttatggcctgaggaagactacgttaagaaaggacagcaggcaagattgcacatgcaatacaaatgttctacacagccagagctcaactatataaaaaatgcaaaccaaaaaagactaagatgaccctggccacaacactaacaataattgcctctgaatgacagaattttgtgtcacattttatctttatatacttctgtacattccaaagcttctgcaacaaataaattgtacttttatatggggtggagcgagcacataaaaagacatatgaaaaccttcctccctgccaccataattgttcaactctcccaaacccagcctctcacttttcaaaactttcccaaagaaattccattcttatacctaataaatcaactaaacggccaaaagaaagctcccagggatacatacatccctctcatggacagtcatatgctcacctttggaatcaagctgcttcttgtctccaaaatgggattttgcttgcttttttcgtggaggagagatgtcagggtcatactcatatttgctgttctttgggaatgacaaatgggaggctcctgactccttccaatgtggagaagtcttgctagaggctctttctggggctttaccacttttggttctgggcagggaataagtgacattaggagccaaatcaggggagtcatgacgggcccttctgagttgctgtgtgtctgaagagccaagagtcctcctagatgtgtcaggggagttgttatggacccttctgggggaagagatatctgaggaaccatgacgggctcgcctaggaggagagggatctggtgaatcatgacggactctcctaggagatgcacctgaagaattatgctgaggcctccttgggggagaaggatctggagaatcatgacgggccctccttgggggtgaagtgtctgaggagtcatgacggatcctcctgggaggagatgtgtctgagtcatgacgagcccctctgaggggagaaggatccggggtgtcatgacgggccctcctaggagatggatccggggtgtcatgacggtccttcctaggagatggatctggggtaccatgacggaccctcctaggagatgaatccggggtatcgtgacgaaaatgtctgtttgagggtaggtcttcgttgtggcctaaacacaaataacaaagagtcagattcccacaaatgctctgtccctctgtccacccccacacccagtttcaaaagatgctccagtagcacatacctcagaactgctcagaaagcccaaaaggcctgcacagttttcttgcttaggggcagcaaaccaccactcatgaatatcttaagaataacccctccgcctaccaagtcataaatttgcaaagcattttcagcacatttttcatattataccctttaaggtaagcagggcaggtacccttgtattacagcatgaaaacagaggccacagcctctgttttcagctgaggagctgagtgatttcttacctaaggtcacagctcctaaaatgaagacacaggctagaatccaagtcttctaactcccagtccaatgttctttctaaaacctcatttgtgcagagttcccagctagtggctcctactgatattttgcctagatactttatagtttgtactcactcttctttcaataggtaaattgactaaaacggtgaatatcaaaataaaatgctgttaactatttaatccatttcactgtgctctttcttagagaggggaaaaatcaccataaaaaagaaaggagcaagtaattaccaatcacctactgtgtgccagtgtttcatagagattacctgattcaattctcacaacaagcctaggacataaatactgtcatttcatttatagatgaggaagttgatactcagaaagattaacttgccaaagtcatattgctaataagtggtagaggaatatttaaatccagctctatttgactccagagtccatgtgcaatctttaaaatatgtaaagctttaaagttaaaatacatagtttgagaccttccatattcaaaggcaccacagaatgaaatatctatagcaactggaacagtttcaaaatccagttcttcctctacctctatttcttgtcattgagctccacagcccaaatacaaataaaagctgggtaggaactgatgaatacttgttaaatggatgaattaaaccaagtcaactcctttactttggggaacagccctatctgattggaatccactccacagagaaaagtatgatgtctgtggggggcctaacagtaaatctgaaggaagcaagggtcagagattggtaagcgtacttccaataacaaattgggatgggggagtgaaagcaaggcagaagaaaaggagtgagtgagtgtgagtgtgactgtgtgtgtgtgtgactgaccttctaaacattcagatacacaagaaaaggcaccgtgtgtatgtgtgtgtctgtgtgtcttcctagacaaacagacatggagaccaaaagattctctttggaaaagaattctgattaggctacaaaaatcaaatacctactagcaattaaacaattctacaaatatttattaaaggtagctccttgtgctagataggggaatatcatggcaaataagactagtctatgctcaaacagatgtgacaaacaaatgctttttatccaattctcaaggactcaaatttttttaaagagagttaaattaagattattagcttaggaagagtccaaagtgggcaagtggagggtaatgcactataaaacaccaatacttaaggaaagaagagagaaatttactaacacaaacagaacaaaatacactggtccttgaccccccagaaatgagttgcttcattgtggaagaggatagtggtagctaaagtccccaaattctgctcctgtttcttgtaaactcctcccaaagtcttgcctatacaccaagtgctctcctattctgagtcaaagaggaatgggtgctcaaaggcctccaaattagtcaccaacctcagtaatcctaatgccaaaatataagagaaagaggaatatctggtctataagttcctatgtcttactacctctgaagaagtccaacttcctttttcctgctttatttttcaggatcaatgacatgctaaaacaaactatgcattcctctaaagaaaagtatagaaaaggaaaaaagatctcccctactaatggaaatttagatttatctattgttggaactcacctcccagaagcttccatttggcactggaacgaaaggcctccatctgctttacctcttctggccgctcatccacaaactctgccacctgtgagagtaaagatttcctatcttaggaaatccacaggatccagccaagaagcactgtctcaagaacctgaagttacaaccattccgattcctaacacaagggcgtacatatatccaaaatggtcatgaagaagtaagtaggggtcttcagttatgtttgctccataaacatctgattgtcactgtattggtttaattgtagatccttctctaattaatcaattaccctgcaaaggttaatttttttcattacaaacctttttattaacctgctaggtacacaacagccacttgtaaactaacaactaaattccttttacacttttacttctacattaacagtggaaacataggtggctccccccatcatgcctagcactaatcaaggactttgggtttctatgaatcctttcttgttgtaggtagtcacagtgataggttttcttgaatacaaccaaaaagagccactgagatgtacacagaatcattaatctttaagagctaaaaccacatttcatatcttctaaacttctgaacaaatcagaatcttctctatagtattcctaataagtggtcactcgcccaatcccttcctgacaaggaactcattatcttacaacacagtccactgcatttttcaaaaatgttagaaagttcttagttttactagtaccgtatctgccttcctataacttctttgaattcattctagttctgacctgtgatgtaagtccacatgacaaactttcaagattgctggcataataaatcctagttacagagtagcaactatgtgcaaggtactgtgttttgtggtttactcatataatctaactcgattctcacaataatcctgtaaagaaaggctccacactactgaatagcaaactgattcggagaagttcagtaactttctcaatgtcacaagctaacaagtggcagaactggaatttaaatccaggtcataatagccctctacttctcccaaaatcctaccatcattcttcatataacccagttttgagatctctcactgagcgttaaaagcacaggtttcgggcaagatgaattaagatctaaaccccagctcggccacttagcatttgtgtaacctttggtaaattattctaagcctcaatttcctcatttgtaaaagtgggattcaaaggattgctataaggattgaatgagataattcacgtaagcttagccatgcttggtacatgataaatgcccaataaatgacacctattaattattcctgtgctgccactgctatcgtaatcatcataatcgttttaccattattactggtggtggtggtgatcttgcagttacaaaaatgaattcagtaatcaagatctgttttaaccaatgcagagagcagtggcactaaagcctcctttgtttaggtttttgggccatcataaaagcaagacaatattataaaagaaaatggccaggtgcggtggctcattcctgtaatcctagcactttgggaggctgaggcgggtggattgcttgagcccaggagttcatgaccagcctaggcaacacggtgaaaccccgtctctaccaaaaacacaaaaattagctgggcatggtggcaggcgcctgtaatcccagctatttgggaggctgaggcaggaggttcacttgaacctgggaggcagaggctgcagtgagccaagattgagccactgcactccagcgttggtgacagtgtgagaatatgtctcaaaaaaaaaaaataataaaaacaattatgaactaagtgaaaaggcaaatgataaaatacacccacaacataagcctaatgaacatataaaaaatgattcatttcactagtgttcaaagaaactgggccaggcacggtggctcacgtctgtaatcccagcactttgggaggccgaggcaggcagatcatgaagttaggagatcaagatcatcctggctaacacagtgaaacttcatctctactaaaaatacaaaaaattagccaggcatggtggcaggtgcctgtagtcccagctactcgggaggctgaggcaggagaatggcgtgaacccgggaggcggagcttgcagtgatccgagatcacgccactgcactccagcctgggcaacagagtgagactccaccaaaaaaaaaaaaaaaaaaaaaagaaactggataccattactcacttgctaaatcagcataggtttgctattggttttgttttgttaataatccttcaatattggtggggcatgtggctaacacctgtaatcccaacactttaggaggcctaggcaggaggatcacttgagcccaggaggtcaagaccagactgggcaacacagagacctcatctctacaaaaaatacccaaaattagccaggcatggaggtgcgcacctgtggtaccagctacgtgcaggactaaggtaggaggattgcttgcacctggaaggtagaggctacaatggggcatgatcacaccactgtatttcagcctgggcaacagagcaagaccctgtctcaaaaataataataataataataataataataataataataataatagtgctctaatattgacgacgtaggcaaactggcattctcatcacctctagtgggagtgtaaattggtagcaccttttggaaagcaacatgggaatataactaaagcgaaccataccctttgatccactcatttcattttatgggaataaagaaataaactgatttctacaaatgatttatgtacaacgatgtatgatattttataagtggaaacaatccatgtatccagtaacagaacagataaaatatatatattgaactactacataaccgttaaaaatcatacactcaaagaatattttaaggtcttaccagagtatccacaacatattatttagcagaggagtagactccaaaaccctatgtacaatatgatcccaattatgttcaaaaaaataaaatacaagcgtgtataatctctaaagagaaaaacctgaagagatatgcatccaagtattagcagttatctttggatggtaacatgcaagtgtttattcttttaaaaactttaaactttttttaattcccaaatattctgtaataaatatgcattgcttttataaaattaaaaaaaaacaacaaacattgttaatatttacttcttctgaccaaaactaaattggctccctaagatcactatttcccttctaattactagcaagccctcttttaaataatctattttagaattttgctgggaattggccaggtgcagtggctcacacatgtaatcccagcccttcaggaggccgaggtgggcggatcacgaggtcaggagatcaagaccaacctggctaacatgatgaaaccctgtctctactaaaaatacaaaaaaaaacacaaaaaattagccgggcgtgttggtgggcccctgtagtcccagctactcaggaggctgaggcaggagaatggtgtgaacccaggaggcagagcttgcagtgagccgagatcataccactacactcaagcctgggcaacacggtgagactccgtctcaaaaaaaaaaaaaaaaaaagaattttgctgggaattaatattaaatactcactggaatccatctttaccaactttagtggaattcagcctatctacagctctcctttccactttgtttctcagaaattctcagcaatggtttcatgaaccactgggaggtcatttgcctatgattttgtccacctggctcttacttacccttcaaaactcagtatttacatctttcaggatatctcccaacagaatacaaagtatgctacctccccgggctctaatggtacttggtacgtatgtgaaacatccccaacatttaccatactgttgaaatttatctgaaattcagtttttcattctagggtataatctctaaaatacagctatgttctattaatctacatatctccagtacttaggcaagaatatacaatttgaaagcttagttaaagcactgaaaaaaggagcaaataaaaagttccctataactgaacctcagcattgtttttaagaaagattccaacaaaatgaaccacagctaagtctcatcattactctaacactgatgtcgagaagtcctctctctgtgatccatctcatttctaggctgatggaccctccataaagagacaagttggtgtataggcatcagcaaagaaaactattttaaacagctctttggaaactgtcacctcttttctgttctcaactaacccccctacaaatctaccctaagctggaaaaataaatttgagaagcttggcctggcacaatggctcacgcctgtaatcccagcactttgggaggccaaggtgggtggatcacctgaggtcatgagttcaagaccagcctggccaacatggtgaaaccccatttctacaaaaattaaaaaaaaaaaattagccaggcatgatggcgggtgcctgtaatcccagctactcaggaggctgaggcaggagaatcatctgaacccgggaggcggaggttgcagtgagccaagatcatgccattgcactccagcttgggtgacagagcgagactccgtctcaaaaaaaaaaaaaaaaaggaaattgagaagcttgcttcatttcaaaatcctgacagccccaaagatacataccacaggcaaatctccatcatcttcctcttcctccttttctagtttggttgtggagatagctgtccagctcacatcatcatccacaatccgcattctaaatgagaataagaagatcaaaaagagtcattctaggataccagcataaaaacatttatctattggttttaaaataaagttcaaaatcctacaggatcctgcatggtccagtctttgtctacaaggtcaacttcatctcctactgctacttccttggttgaacacctccctggtcatcctttggtgcttagaaaggagccaagttcctatcacatcagttttcacatatgcagttccttccctctgcctgatctactcttttcaatctttttctttttttttttttttgagacggagtctcgctctgttgcccaggctggagtgcagtggcacgatctcagctcactgcaagctctgcctcccgggttcacaccattctcctgcctcagcctcctgagtagctgggactacaggcgaccactgccacgcctggctaattttttgtatttttagtagagacggggtttcaccgtgttagtcaggatggtctcgatctcctgacctcgtgatccgcccgccttggcctcccaaagtgctgggattataggcgtgagccaccgcgcccggccctagtctttttcttttttgagacagggtctcacactgctgcccaggctggagtgcagggacaccatcatggctccctgcagccttgacttcccggggttaagttattctccctactcagtctcccaagtagctgggactacaggcatgtgccactgtgcctgactacttttttgtattttttgtagaaacagggtttcaccatgttgcccagactggtctcaaactcctagatgcaagcaatccacccgccttggcctcccaaagtgctaggaaactctttctcattccaggaaactcttcctcattcttcaggtcctaacacaaatttaacttcctttggcaaacttttcttgactgcttcacccaattccctcaccatcccacactcactcaagactaagaacccttgttaaaaactcttggaatactttcattgcatttatcataaagaaaatatatcgattagttgtgtaattagttgcttaaagcctgtattcccattaatctataagctccacaagaacagggactatgttttttttgttcacagaggcatcctcaacaccctacagtaactggaatacgaaatattcaataaatgtttgttacgtggataaactatatagctgagcccaaataataacaatgactgccatgatgtgaagttattcaaaaagccagggtcacttaatgcaatccctctaatcacaaccaccacttaataaaaccattattattattattctcattttaaagataaggaaactgcagctcagtgagatgaaacaccttgcccaagggtacacagcctataaagtggcacagctaggattcgaactctgaccagtgctgctccaacactcaagctactttcatcacatggcactgcctccaaaggatccacacaagtcagcgaggcagaaagacgaagacaataataaggcaagcaccaaaccagaaaagaacttggactagttctttagaacaatgtgacttcactgggtatctcagtgccttagggttactgtaacaaagtaccacaaattgcgtggcataaaacaacagaaactctctcgcagttctggaagctagcaatctgaaatccaggtgtctgcaaggccatcctccctggaaagtctctagcagagaatctttccttgcctctcccagcttctggtagccccaagcataccttggcttttggcaacataaatccaatccaatctcagccttcatctagacatggtcgtttttcctttgttgctgtgtctgtatccatacttccctctttttaaaaggcaaacagtcatcttggatttggcacccaccttaatcaagtatgacctcatcttaactgattacatctccaaagaccctatttctaaatgtcacattctgtggttctgggtggaaaacgatttggtagggcccactacactgggccacaaagttgtcccatatgaaaataatacccacttcatggtagtgtggtgaggcttaaataaacttatatatgtttaaatttcttataatggtgcctggcaagaaaagtataactatataaatgttagcttctcacgttaggactattactaagagtaacaggaggtgatcaaaggtctctgattcagaaccaagtccttgggatctgggaatccccacaggcaggtaccgggccctaaagatccaagcacagaggctttgaatccgctccattattctcgaggcacaatattcattctctatgggagaggacggaagtctaccaaggcgggaaaagagtaatcaaagttacaccccggctttaacgcactgacgctactgctcagaggctcgagatgtaagcggggcggcagaggcaaggcggggggcctcaagcgatgtgagtggggccctgagcatgagcaggggtcggcggagaagccgagagacccgccaagagggaaggaactgccgggcggccgagggcggagttgggaaggggtggctagacgtcgcaggccccgccccggccggtaccaactcaccccttgccgccggccccgccaggcttcggccgctttttgcgacgcttgcgaccggactcagatccccggtcgacgccggcatctgccccggacaagtaacgcttcagatactcggccttggaaagcggcggagctgccgccatggcagcggcgggggcagagagacgggtcggcgctggggacaaaatgcctcaacgcgtaacggacgccagccacccgacagggcggggccacggccggaagtggcggagagtgctaagaatcgcgcggctggcaggtgcggccaccgggacgcgctcgcaggctagccagggacgtgcgcaccttcggggcgctccacagccctgggacgacgccaccaggtttcttctcttcattcactcacccacccacccacccatccatccaaccgcagcaagcgctgttctatgaggccacaacctgacccaaaggaccccgcccccatcggccgcctaaactccagagcacgagcaagaaagtggagggccacgggctgcagcgtagccgagtttgaatactggttccatagctggctagctgtacgacctcgggcaagttatcacaaaacagggagaatcccggcacctaactcggaacggtcacaggctgagatgatattactgtgtgaagtgcgcagagcggtgttgggcacatggtcatcggaactatgttcgttatttttataagtatctttaagtggggggaatctgctccactaggcttccaggtacctaccgtccaagaaaggaagccaggaagtgcaaaccaacataattactatgaaaaacgtagtttctaagacctgtgtaactcttctagtgttctattacaagtagcccccagttatctcttgaaggaaactgtaaaacaatcttgccaatgagaaggacggacctggatcattttttagcatagtaaaagagagaaaccagagagaatgaattctaacactcaagttttggggggaaagaaaagactttattctttgcagggggtttagagctttacctgaattatctcatttaaccctcacaattctcaaatcgtttcattatcatattttacagataagaactgaagcgtggcaagattaaggaagttgctcaacttcacatagtcagaacatgactctagggagtagaggctagcgaagtggggtgcaagaggtcatccaaatttcttgaaataccagatctttttacctcatcatatatgttagattgtcagttttatcgttttcttcccagctttattatttgacaaaaaattatatatattcaaggtgtacaatgtgatgactggatataattatacattgtgtaatgattaccaaaatcaaattaagtaaaacatccttcactaatttatgtagtagttcggtgggggggcacttaagcaaatttgtcttagcaaacttcaagtaaacaatacagaattattagctatagtcaacatgttgtacattagattcccagaacttgtcttaaaactgaaaacttgtaccatttgagagagaagttttagtgttactgaaatcacagacttctgacagaatttgcaggatgctatacacaactacacaaaagtgcaaacaatagtttcttggaccaagagtcaaaaaggtcacttttttaatatattagtcaagcagacagggctatactttataaataaatacacattatctggggataagtgtttaaaaaattctttactcatataatacaaaacaggcttggggatcagtcttgaagcatgaatttttacccagtgggccatgttgagggggttgcagcacaggcccagaaaggaaagcaggctggggctctgagggcttgtgagacgaggacgctgggctgagaagatagggcttcactaggcggagggccccagggtaccccatacacaagcctgccttggcttctcgtccaatttggtgcatctcacactacacagccctgccccaccctggtgtcagcaggcattcagaaagcctcacacttctgctccagtgaacactgccaggatagccctctgaacttccacccacccatcttctgcccatttgttttctttgtcttcaattccactgctacccatcctaccccagtcccttagcctgacaaggcccaagtgtctccaccctgtgctgcagggcagttaagcaggatcagatgccgtgccaatggcctgctctgagctttggcctctctctgcagttgtatctaatagaacaaatacagtaattgtggagctgagcttaaaatattcagacctcaggtttcagagtctgactggcatgggtttgacacctgcctcttagaagctctacttctggccaggcacggtggctcacgcctgtaatccctgcactttgggaggccaaggcaggtggatcacgaggtcaggggtttgagaccagcctgaccaacatggtgaaaccccatctctactaaaaatacaaaaattagctgggtgcagtggtgggcgtctgtaatcccagctactcaggaggctgaggcaggagaattgcttgaacccaggaggcaaggctgcagtgagccaagatcgcaccactgcactccatcctgggtgacagagcaagactgtctccaaaaaaaaaaaaaaaaaaaaaattagccaggcatggtggcgtgcacctgtagtcccagctactcagaaggctgaggcaagagaatcgcttgaacctgggaggcagaggttgtggtgagccaagatcacgccactgcactccagtctgggcaacagagtgagactccgtctcaaaaaaaaaaaaaaaaaaaaaaaaaaaaaaaaaaagctctgcttccttctggaagtaacctctctgaggctgttttgtcacctgtaaaatggggataattttgtttatcctaattatccccattttacagactaggaaaacaagcattggaagtgccaatactaaactgaggtgaacgcacaaaataagcagctttttctctccacagttggaaacactgccatttgccttaaaaagaagtgtgtaaaaaacattttttaataggaataaagccaagtagtcttagccaccactgccctaaatgtaagcagagacaccattttctgcagtgtgcatcaggcacataccacaggtgtacaaagaaggaaatatactgatgttagaatgaaagtgttgccatcattaaagttttcagttggccaagtcaactgcccttcatacttgctcccaacactcacctcccctcctccactcatcatgacacagatgtacattcagtacctacctgtatgttcgtccacacgtctaatgaccgaacatggctgcatttcacatacttgacccatgaaagtaggaggcgtgccctcatgcatgaaccactttccttttttaacacaatcacaaaccttttccacttaaatgttactcatggctgtgaaactgaatccacatgttcctggcactttgactcacctaccctggccttaaagcgagaccctttccctatctttttacctatagatgttatccctagtgtcctaatagggtttaatctatgatggaggattttaacagattttattaaccatgtgtcatatgctgggtgctgtggagcaagactcagttaactatatgtaagctcccatcctgacacactttatgaaatgagaaaggagctgaaagataattcaagagaagggtatgaaactgaagaatgccttgtcatcaaagggcaggaagtaccttagctgggttatcccagtctggcacctggtcctcagtcttcaagttcagaaactcaggtcatcatttcctaggaactgggtggattctgggagattgcctcacaccaaccaaactcacaagagattcagtaataagccagagtgccattttttttccttcacaatggaaaatgaacctgatactgcagtttatcttaacagagcacacctacactatggggaagtctacttaagagaccaaatgatagatcagagggttgtctggtaaacttagattcccaagtcagctggaaacatacctagagataatctcttagggtagaatagttgcctgtgagaagtttgcccaaagtactgaagctttatagtttgaatgagtcatttgctaacctgagtctccaaacaccttactctcgccctcacttacagaaattagagatacaggtatggaagttagtcccacatgatagtaagatgccaaagaatctgatatggagagatgtctgaaagcagaactctcagaaacaaatttagtaagaggggaggaggcaaagtgtccaaataagaaatattcaaagtgaagggaaaaccaagggtacagtatctcgagagccaaaagaagggttaagaagagatggtccactatcaaatgtgacagaaatagataacactttccaagtggaaaatcacttgtgacctttgagagtagtttaacagagcaacgagagtagatgtctgattgctaaatcatctctaactcattcttcagagttaagtttgcaacacagccggacgcggtagctcacgcctgtaatcctagcactttgggaggccaaggctggcggattgcctgagctcaggagttcgagaccagcctgggcaacacggtgaaaccccgtctctactaaaatacaaaagaaattagctgggtgtggcggcgtgcgcctgtagtccccgctactcgggaggctgaggcagaattgcttaaacccgggaggcaaaggttgcaataagccaagatcacaccactgcactccagcctgggcaacagcgcgagactctgtctctaccaaaaaaaaaaaaaaaaaaagtttgcaacacaaagcaataaggtttgtgataacatcttaatcaatgaactggtctttattgaacaaataccctgcagtctgcaccacaggagtcaccttttgtttatgagaggcaggagactacagtgcaaagaacactggctgggaagtccagggcccaagcagcagagtgttcactggtccttaactttcagaagaactgcagagagcctcctttctctctggatgaatgtgtttcaacatttctaactgagagtagggctaactgatcaggtacccccactggctctaacctcacagctctagcatttgcagttccctctgccaggaaatctcttcccccagatacccacacagctcactccctgacctcctcctcagctttgcccaaatgtcaaattatcaccttcttgttcagaagatcttccctactccccatttccttgcacaacccagccccattccctgctttacattcctccatgacactaatcaccatctgatgtactgttttcctgatctgtttattgtcatttttccccactagacttcaagttccatgaaagagatttattttgtcctctgttctgtggtgtgcttggcataaagtagataagcaagcatctgctgaaggaatgaattaaatgccagctgcaatccccaaattacagtagatacacgggaaaattttctttaggaggctgaattctaacagcatgatatcaaacaaggatagggtcaatacagaggccagtgctgtttgaaagtcatcatttcaatggtaactccttcacttgtgctggactcggtctcccctcaggagactcctttcctgttcaaagtcagtattttatatactcaaaaccaacaacaaactccaggtgtaactttattccaccttctccaacttcagagttccaaccttagaggatagagcattatgtggaaggagggtgaggacttgatatgaaaaaagtgatgacatacccctggttcatttctgggtttcctcctaggccaattcaaaacttccaaaataaggtcaagtaacacaataggctcacacttgcatcacaagctgtttagaaagtgtgcacagatctctgactcagaccagatgtcctccccaccatgggcaagggctggtgggaaagacactcccagccttcgccttcatccaatactaataaataacctacagaaagagcagcgctggaggctggcccttgagccacccactgctaccgttgcggagccaggcctgcctcatagccctctgtcttcatgtcattgagccctagctcctcattttggtcaaaggtgcgcttgtaacgctccaccttcatctcaggatcatcttcaggcgcatacacattctgcaaggtcaaggagagacaatcagtgccgctgtgccactccccctctctgcaggcagcttccaattcccaccttcccaagaacagaatgagttttgggtttttttctttttattggcctccaatttcccatggctagactgaactagtgggtagcaacagagcccacatgggccaggggtagaagaccccagccccagaatcagggaacaatccacctattttgttatatctgcaccttcttatgaaaagtatgacaaatggtcttaatcttggaaagaacttagaagagttttgcctgacccatggtaagtatccaataaatggtaaaggtacatcaatcaccagactctctcctcagtcaacttaaagcctatcagtttcctatcttggcctccggacaaggtaccatttctcctcaatccataatcagatttgcaaaatgaaaactccagaactgggacaagagcttgactacagaaaaaaaaggggcctcagagtatcctttttttttccttctttacatacacttaaaaaaaaaatcccctcccacacccccctcttttctcccttatgtatcttctaacttctgcctccttggtaaaaagcagtccatttagaatcaagtctttcagtttctagggaaatgatacatattcaaggaagatcagaaaatgtatctctatgaaacatcagggaaggtctactatacctgcaagtaactgtttcctgctggatcatccataataaagtgggccttcatgttaccttcgatgatctaaaggagagagagaacacagcaagtaaattttacataacccctggtaaaaagaggctatgtcgggggaggggggagggatagcattaggagatatacctaatgtaaatgactagttaatgggtacagcacaccaacatggcacatgtatacatatgtaacaaacctgcacgttgtgcacatgtaccctagaacttaagtataataaatatatatataaataaaaaaagaaatgaaataaatgaaagtaaagaaaaatttttaaaaaaagaggctatgcctgccagacaagaaccaacccaatttatattacagaatccccaaaagttttaagaattggtgaaattaggtagctctgaaagtagaggggaaaggttctaaaataaggactgttagaaaagccaacatcagcaagctgtggactagggggtgctggcccagttgaaggtagagggaaaggaatcaagaacaagtaggttaaatgaatgtaagcttatgggaaacagaatacatacacaccccagcccccttcccacagctctcagaacactgccagccaagcctttaccctcaggccaggaaatggagcagccacagtcatttaacctccttgttcttgagtcctttccctctaccttcaactgggccagcaccccctggtccacagcttgctgatgttggcttttctaacagtccttattttagatcctttcccctctactttcagagctacctaatttcaccaattcttaaaactttggaggattctgtaatataaattgggttggttcttgtctggcaggcatagcctctttgtctgactagcccaagaggaaagacctaacaattctggcattggaggccacctcagcaaaacagctaagttaaattcccctgtaataagccccatgtcaacaaggctcaccccctactcaggtctttagcccgctacttgtaagaagacaatcaatgattatcagacatctgagcaaagcccttaacactgaaagatgggaaatcaaatggggaaaaaaaggatgcaaggagaataaaatgtcaaaaaagatccaacatcagtatcaataagtgctatataaactgcatgctgaaaaaatttaaaaaataataatcctcaagaagaaaaaatactacatccttaagacaggatgctattttttaaaaagctccttggaaaataaaagttttagtggaaatgaaaacctcaattgaagggttggaaaataaagttgagggaatctcccaaagaagaacaaaaaaaccaagaaaccaaaaataggaccaaaaaaagagtaaattatagaagaccagacaagtaagtctaatatctaaaacccaggagttttcagaaagaacagaaaaaaaaaatcagaaaaaagataatcttcaatagaataattcatgaaagcttcctagaactgaaccacatgagttttccagactgaaaaaatacatctaccaagtgcttagcccagtggatgaaaactgacccacaccaaggcacaccctgaaatttcacatcaaaggaaacgaagagatcacaagactaggtcacatataaaagaccaggaatcaaatggcttcagacttctcaatagccaaagtggaagactatagtacaatgtctttaccaaactggaagaccatagtgcagtcttcgaaattctgataaaaaattatttctatcctagaatcgtattcccagccaataatcactctagtgtgataacagaataaagacatgttcagatgtggaaggtcccagaaattttatttcccatgcactttttcccaggaagctactggagaagatgctctaacaaaataagggagaaaaacaagaaagaagacgtggaatatagaaaaccagaagagggccaggtgcggtggctcacgcctgtaatcccagcactttgggaagcccaggcaggcagatcacgaggtcaggagttcgagaccagtctggccaacatagtgaaaccctgtctctactaaaaatacaaaaaattagccaggcgtggtggtgtgcgcctgtaatcccagctactcgggaggctgaggcagcagaatcgcatgaacccgggaggcagaggttgcagtgagccgagatcacgccactgcactccagcctgggcaacagaacgagactctgtctccaaaaaaaaaaaaaagaaaagaaaaccagaagaagaatccccaacatgatggttagatgttcaaaaagtggcaagacatgagcatgcagcctcctgttcactggagccccaggattctaagtactgactggccagtgacctcttacctggtccatcttctggctaaactcctgtagtctctccgtctgtccaggattggaactgtcgcccagtgtgaaaggatttttggtcacctgcaataaatgataatccaaactatgtgaatactggctttatatttgttaggcctgaccataaactaggcagggggtgacagtgggtgccctgtcagggaaacttggtttccatttagcccacaccacctttctgaccaaggcagtcactcctaggagtctatgggataatgtgccaagataacaaaactggcaatgtaaaacaaaatcgaaacatgttcttagaatatgatctctgatactaatttggagaagaaatgcaaagaaaaagtacaatttacaaatacaaaatgcccaacagagaatcaagtgaaataattcatcaaggagataaacatttgggctaagtcaacccatacatgtatgttttttatgttgggaagttttaggtgctagaaggaccctcatcccctaactttacagtaaaataaatgacttgtccaagaccacaaaataactataaagtcccaaagttaggcctggaatttccattcaacatttcccataaacttgtcttcaccatccaaagtaatatttaagtctcttaaaccagctttaaggcaaagaaacccacagttaccagcaccgaaaattaggatgtctgaagtcttccagtccctcttcacacagccaaattgctcaaaggtggtttacacactactcaagtgactcaccagttcccggatgtctttcagcagcccttccagtgtggtgaacttgcccccgaggactgccattcccagt

SEQ ID NO: 267 - DNA, 43486 bp, Homo sapiens
cctcccttagtcccccaccccctgcaggccctggtgtgtgaggttcccctccctgtgtccatgtgttctcattgttcaactcctacttatgagtgagaacatgtggtgtttggttttctgatcctgtaatagcttgatgaagctggagattctcctcttatgatcttttgcctatattttctatgggagatttaccctttttttctcatttgtgagaactctttattgccacatatagtgaccctttttatttatttacattatgaatattttatcccaaaatattatttatcttttcacttatgtgttatctcttgttcacataattagttgtaatgtttatattttcaaacatatctatcttttcatgcatagcttctggatttcttgattaagaagttcatcctaatccctagattatacataaattatcttacaatttatttcaagatttaaaattttcaaatgtattttacattaaaactatagtgtgaggtagattttaactaactttgcttcaagatggacagccagtttttatagcactatcctttctagcttgatgcttttggagaaataattttttaaaaaaggtcaatagggctaaaactttagaggtgtggggaagataatagtgggagttgagagttgaaaggcaggcagaaatcaagtcatgaagggtgacgggagcatagaaaaggacttcagaacttaacagagtaattccatttaagaggttttcagcaggagaataacatgatccaatataaattttaagaccactctgattccagtgtgaaaatgctgcatagacagaagtgaagaagtggagggatacatagaaggcattgcaatagtccagaaaagatatgatgatggcgttgctttcgagacacaatggcagtggtggtcaggaggaatagatagacttaagagctattttagaggcggacaggattgaatggaagatcgaacgtgggaggcctgagaaggacccaaagatgactttaatttggggataatgatggtttcttgatcttcataaaactggaggtaaaagcagacttaggggaaagagcaagagtttagtacaaaagagatgaaaagaatcataaaggaacattgtggaaaagtctattgcagtaaattcgaaagtttatgggaaatggatgatttctgagtcaaatataaactgacaacattgatcctagaagagatataaaacttaaacatatcattagccatgaggatgttccaaaatagttgagagttttgatttaaaaaaaaaaaaggccaaaatgctttagcagctgagttgcatctaacctgtaaagaaaagacatttcttaagttatttacgctattctggatgattgaaaagcatagagtaatggcagcattgtttgtttccaggcagaaacccagaggcaaagagcatgctgatcagaagcagagttaagttatggcacattcatactatagactattatatacctatttaaagaatgaattctatctatagctgtagacatggctggctgaaggggtgggaatttccatgctatatttttaggacgtgagaacagagagagtatatatataatattatcctatttttgtaaaacgaaacaacaaaaaggaaacctaaatggaatgtggtggtgctgaattttgaattttcaacttatatttttatatctttgagtagcttttttttttttttttaaacagagtctcactctgttgcccaggctggagtgcagtggttccatctcactgcaacctctgcctcccaggttcaagtgattctcttgtgtcagcctcccaagtagctgggattacaggtgcctgcaaccacacccggataatttttgtattttttagtagagacagggtttcgccatgttggccaggctggtcttgaactcctgatctcagctgatctgcccgcctcagcctcccaaagttctgggattacaggcatgagccacagtacttgttactatgagagttttttaatgataagaataaaaagcaatccgtgaggctttagccatgttgattttgagaaatcttcaagatagttaaatagaaatgctgagtggtgaagatgctgtaaggtctgatgtttggaaaagaggtgtggactagagtcatccaaaggagtcacacacccagggcatttgaagtcgtgggagtggatggcaccacgaagtgggatgtgtaggtgagtgaagttaaactcaggaccaaaccaggaactccagcagagaaatgttcagtggaggaggaagagccaatgaaagagaaagagatggagcaaccagatatgccacggggaaatcagtgtttctgggacaatagatgttaagtggtccagggctaaaatgaacctcaccttgctagaagtggtctccatagatgtctcagaaggctgtaagagaaataaacaccctcggccttcatttcctttccaccactagagaaaattagcacttttcatagcttgtttttaagacagcatgagggcagttatttatatgtactattagctcttaggcttaaacatcatcaactgggaatggaagaaactggagccaatctatggagaagccaatgcctatggacaagactttgagaagagaattttctagcagagacatcattgaggaactgaatggagcaatttgttagagaggcctgtgtttattatagacagtacccagcatcctttacagcagtgattcctgttaaaatgcaaggagaatatacatgtctcttagacacttgtcttacttttctcccctcgtttcccactgccattagcctaattcagtgcctaatctgctcacctctaaaccagtcccctccctgtggttccttagggtctcaacctaatgttatgcaggttgcatacagcacaaggatgtctgagtgatgggcaagtggggctgaaatctaacatattctcccggccaacccatgggtgcttatgtaggcctgttgcttcctggataatttttctcacaggggcgtggcaagctcatggagccttgaccctgcatggctaggttcactcagaggggttgctttcactattggcacagtgatgttgaagtggctagtagcagccctgagtcccatggcaacaatgaactagacacagtctctgccctcaagattgacaggttagtagagatggataatttcagagacaactatcttcaaagcaaatactttaaagaacgattgctatcatatcaatcttctttcaaaatgctccaaaggctctctattgccttccttaggctggaattcagaactttgtgtaatctctccaagctaatctggcatcctctactttgacccctgtccctgagcaagcctctatgcctttgcccagctgttatttctggcttaggacacccctcccacccacctctctgggcagtcacctccccagtgtgcactcagccttcccgcccatgcctccctgaagcaattatggcttgggccagttgggactcgacccatcattacaaggctgaggacacccaatctttatgctttggccttgactctctaattttacctaaagtaggaacctacggaatcaatagtatcattgcattttcggcacccaccacaggacttgtaccaagcaggattgaaatgaatttggtgtctagtctgaagattctataaacattttccaatgtactttcaaatatttctgttaaatgcttgcccttgaaattgtgtagctaccttgaaaagatagatgtgtaatgtaaaatgatttatgagtgttctattactgcctctgacctacatatatttttcttttttatttatatattttcttcctcagcatgatacatcctaataaagaaagccaacacagaaatacatgctttacaatcatgctaataacacttttctgctttcagacatcaatgcattgagactgggtctgttttctaattatgcagacgaatgttgacaaaactgaaaagcaaataaaaagcatcaagaaacgagttcattttattttatttttaatggcatttgtagcatttatacctttttctggttgtaaatagcatatgctcattgtagaacatgtatcgaaacaaattcacacacacatagccataattattccaccatccaaagataacaattattgatttctttgtgttcctctctgtataaaggtttttcctctaaaaccttttatagttttatgttattcatttagatctatgggctattttgagttaatctttattaacttcatataattctgaggtgtgaactctatattaaggtttatttcttttcctgtggatgaccaattgttccaacaccaccagctggaaaggataagttgcctccactgaactgtgtttacacgttgtcaaagatcaaatggctgtatttgtatgagtctattattgtacttcctcttttgtttcattgatctctgggtctatatctttgctatgggtctttttaaattaaaacacagacatatttgtcatgtgtcatgagcaatagaggccaggaggagaaaacggtcccatatgtgcccaagaatgggcaacaattacttcctccaaccagctagtccctgccacctcctgactcagacaacacagaaactgaggtgaacagctcaataaagttaccacttagatccatggcataacacattaataaaaccaaatgtctgcttttttttttttttctttgagaaggaatctcactctgttacccaggctggaatgcagttgcaccatctcggctcattgtaacctctgcctcctgggttcaagcaattctgcctgcctcagcctcccgagcagctgggattacaggtgcccccaaccatgcccagctaattttgtgttttcagtagagacgggatttcaccatgttggccaggctggtgttgaactcctgatctcagatgatctgcctgccttggcctcccgaagtgccgggattacaggcatgaaccactgtactcggctttgtcttctttcttaaatgcctttctcactgtcagtgtttttctggtggtgtcaactgaaaaatatgccagcctcacacagctcagggcagaggaaaaggagtttcacatagacttaaggaaaagtttcagataaaaatacaactcttttttttttttaaaccaggaaggaaaatgtgaaaatggaaacaccttttactatttgatttgaaaataaagtgtcatccaagccatagcagaagcttcattattttgacaactggtctctgttaaaaataagtttccaggttgccctccagcttgcaccatttgaatgaggaagatccagaacgacattctagtgcgtaaaaatatagataggtggacatgcagagagatggaaacagatatagtctccccccagcccaaaccgacaaaccgagattttttttctttttttttttttagacagggtgtcgctctgtcacccaggctggagtgcagtggcacaatctcagctcactgcaacctccacctcccgggttcaagcgattctcctgcctcagcctcctgagtagctgggattacaggcacccaccaccatgcccagctaatttttgtatttttattagaaatggggtttcatcatgttggtcaggctggcctcaaactcctgacctcgtgatcaacccaccttggcctcccaaagtgctgggattaaggcatgagccactgcacccggcccaaaccaggatcttctatgatgtacgattttttaactagaacaggtcatctttgctgcatagagagctggcgttgacagcactggttatttctcattctttcttgttgaccacaggctctacagtggtagagttgttggtgttaaataaacttttattttcttccttcagtctaatattggggaactagtcctttctatatgtattgtgataataattgcagctaagaaataatgtacttttaattgaaatggccagatggagccatgactttttcaaagacatgggtttttggcttctaagttctacacggcatgttctaattattgggcagtttttcaacattcctgacacctttcggctgtgaatagtggcttccttcaagtacacaacatcttatcctgttgttttgcactttctgagttgaaatcagcctttccaaggaaaatttccttattccttttctacttttgttgtgttcctaaatgaactaatgggagcttactcattatttaactttacttttctcactttatcttatgcctgcagatgggagatagaatgggattacattgtagaataagaaaaggggccaccgtcatttagtcattaattcatgcatgcattcattcatttattaagcagctactatatgtcaaatactgtttccaacaaggtaaatcttttcctttaaggagcttttggtaccacaggagctagatacaagcaaagtaacaaaatgcagtatgataagagctaaagtaggagtttagcactgggtggcctagaagcatcgtgtagagtcccccacccagtcttgagaatcagagaaggccctggagcaggtagcagctaagacaaatcttggagaacaaatagaagcccagtgaaggggtggaaggtaaggggagagtccaagcagtgagcattgtcggtgcaagggtccagagaagatggtgagggagggggtcttgcagggaactgtaactattttagtattgcaggagtgcagagtgcaggggtgaatcttgtgtgtagtacagtgttgcttaaaaaagataaattaaataaacaaataacccaaacaagttagaatatcccagataggatatatactcttgcatccaccgcagacccctatcgctttccattgttctactctatcctgatttattttattaaccacctggcctatgtaggcatttgtgtttgggattccctacctctgaacccagaccaaagatcaaattcaaactatctcagttaccatgtcaggtgtgaaaggaaagaagaccagctttttgatggaactgtgaagaccaacccagtgaacaatcctacccaccaggtaagaccaggagaattactcacatacattaaaagaaggatctttcatatggaaccaacctaattgtccatcgatcaatgagtggatgaagaaaatgtggtacatatacaccatggaatactactcagccataaaaataataaaattatgtcttttgcagcaatttagatggagctggaggccactattttaagtgaagttactcaggaatggaaaaaccaaataccttatcttctcacttatagctgggagctaagctatgggtatgcaaaggcatacaaagtggtataatggactttggagactcagaagggggacgtgggaggggactaaggaataaaaaactacatattgggtacaatgtacactatgtgggtgatgaatgcaccaaaatctcagactttagtactatacaattcatccacataaccagaaaccacttgtacgtaaaaagctattgaaataaaaatttaaaaacaaaaaaccaaacaagccttaaaaaatagatctttttcctcagggagtgaaatggagtataaacacaaatatttattgaggtcttatcatgtgccaagtactatgctaaatttttttttatatcaggcctttctataaaagaagatagcaatttaagcagtcacagatgcatgtatataattaaatttataatttgtaaggtgattttacacatcttaaaatatattttatttactagaatgtcactttataatgtgacattctaataaataatgtcattttgcataatgtttaatgcaaacaaataagcattcagtaatgtttattgagggccagttgtgcgttaggtactgaggcttctctggagatacagaacagactggcccctgcctcgggttgttcactactgtggacttcagcacatcacagacgattatctctgcctggtattctgcattgtcagattcagtctgagtcatcttgggattacaggaaatcttttaaaaagtcagagtttgttcctggctaatatggtgaaatcccgtctctactgaaaatacaaaaaaattggcaaggcgtggtggcgggcgcctgtagtcctagctactggcgaggctgaggcaggagaatggcatgaacctgggaggcggagcttgcagtgagccgagattgcgccactgcactccagcctgggcgacagagcgagactccgtctcaaaaaaaaaaaaaaagtcagagtttgtaatcctgcaaactttaacaaatttgtatatttaaggttgattttgatcaagctaaccttcctccttcttggaattaaaatctcagacactaagtaaatcagtaacaaacacttctgctggtaaaccagggctagcattatctccccgggacttctcagattggcagcgtagggttttgcatgccttgttaacctgacttgtaataagttcttagtcttcacaatggaaactgagccaaagcaggtttacatttccgtacttgcatttggtgtgagtcatgagaaaggagaatatttattttctgaggaaggaagagaacctgagctaactttgaatttcctcagtggcctagcatacaagtgccttaggcttactgtaattcaatccttttgcgaatcctatatccaattacccagatatctacatctaaaaaaagcttgtcttcatcaaactgtcagacaggagctgtcagagagtctatttgtgggactgccctgtatttcagagcatttgcccataaggagctaaatcatggagtagggaattgggttgtgcccccacaacacacctattccctggatatgacatcctggtaaaatcggactgtgtagcttccctgagcacatgattatttcttcgtttcctgattgctcagttggccctgttggttgctttccctgctcacagccggcaattgtcgctggatcgtagggcaagagaatattccagttataacattttgatcagctgcggtactggagcaatcaagatagggcagccacaggtgcaaaaataatgaaagtttgtgcatctgatgacaggtgtctggggtaaccctcgaacattaggaaagaccccaccggaggaaagggactcacaagttaatgattacagtgaaagcagaagtaacaacaaaaatgagcacatgagagaaacagtgggactttcgtaatgttgaaaatgaggtggagagagaattctaaattgcaagttcagagaaagaggctcttgctgtctgtgaaaaacaaatagtttggcactactatgataagaaaagcccagggaataagattctgaaaaatttgggagcacttgatatcaaaagaaggagatttagaattacatatagaaacaaatggaaaatcaaggctgttttgaggggtgctatcagagggtcattggagaggatgtagctttacaatatttatatcaggctgtgcattggcaggagttctgtagaagttggactgaaagctggaggtaatgacgtgggtggggcacagagcagctagggagctctgatgcggcttttgcttggggcagagtatgggaagatatgcaaacgctgaggccccaaatagtgcagtggcctttgtgggcagcacttacaggtgggcttggaaacacttgcctttggaacattgtttaaaagtaagtagtgctcccagaagggctgtaatttctttagattatctgatagcagactccgtgatgtttaccagcttcaaggagatcagaccattgtgaaattttttttttttttctgtagtaaaactagccccagccagcccaactgggaatttactgcctgagctgttttccaacataagttttgctggcaaaaccagacgtgagtgttccctcgactctaaagggacctgtttacactgactttatttttactgccagctttcaagttggaagagggaaattacgtttaaaggtcagcaggtgagcagaaggattcctgaccagccattcctgtgggtgtgtgcccgtgtgcactctgtgtacgtgtgtgtgcctgtgtatatgtgtgtgcctgtgtgtacgtgtgtgcctgtgtatatgtgtgtgcctgtgtgtacgtgtgtgcatgcttttctaaatgccaaccgttgtgctctgcgctggctgacaagacctgatcacttgtttgcgggcataatgatgggtgtcaggctggttgttgggcagtttcctatttgtttattgtaaagaaggtaaatcaatccgtgggattttctggcttggagagcaaggggtgtttactgtcaacaggataaggaccaggagatataagatactgagttccacggtgcatctagtgttgggacaggagcataaaaggtggggagaagccaactacagggtatttctgacttggatggaacttttaagtacttgggtgggaaatacaatttggaaaattgctctctggtgaaagcaccagtcaatgtagctaactaaggtatgattaggttggactcaaattcaattttatcaactcttctttttaaattcttttttttttaatttcccaaaagatgacagatggattttcacaatttggaaataaaaacatgagtgaagggttcggaaggcaagtctctggtccattacacacttccagaaaaacttagtacccagagactcacattactgggagtgctatctactcacaagtgttgcactccattgagaaaaaaaaaaaaaccaggaagttgctgttctactgaggactgaccaagaagccatgaaataccttactgtgggagacttagaagattgcctactgaataaggtaaggacagacccggtctctcccatgaaccccctccccattcacactacttccaaacaaaccttcgtccagaaaggatctcaggctctttctaaagacacataaaatgctcctcagaaaacagactgtcacctataacaatgtttgggggcttaacatatatcagccttacttctctttgagggtctggtacccagagacatgctgagtatagaatatagaatggagagtaggaatctggggaatgagggggaactccagctctgccactgacactcgtgtggttgtgagtcacttaacctgcctgagccttggccttcttctctgtaaaatgggaataataataggagcttcatggggtaatggaaaaagagctaatgaaattaaaacaaagctttttaaagactgtgaaagtactaggtttttaaatattattatatttttagtacacatcagttaagaacttaatttcttctagatggtctagatggtcatgtcaaatgttagaacttgaaggaaacttaaatattacctagtttaagccttttcatttacggatgaagctactaaggcatgatgttaatgttaaaaccaaaatatttaaattgactaagaagtaggcactggtctgcagttttcatgcctttacaagttcgaaagagaagatcattatcatagtgataagtaaaatgtatttcttaggcaaaaccattaagagagataaataaggaaaacctgggatgataaaaactagagtaaacaaagtgatttcccattaattcctccctttgagggctctaagtggaagagatattggctggcatttttttcgtgggtcctgtattttttgtaagaaaaaactccaaactttttagtgtggtgttcaagtaacttcaactgctctatctttctaccctccgctccccctgcatttccaatagcagaaatcctaaacagtgttcgacacgttgaatccagtgtgtgctcatgttttgtttggcctgtagattatttctaatgtttttcacaaacatttcaaaatagattttgcatagaaatccagatttctgtctttccaggggaaaaaaatcagaatatttcgcaactacaggtcccagtttcttgcctggaaactgtgtgctggggctgagtgtttgctagccagagcacgtgctggccaattctcaggaggctgatcctgtgtctgacacttgctcctggtccccgctgcctctctcacgtgtgtcccctactccattcctgtaggtggttgagtctcccatttctgcccaacaagaactgggccctgagcaggccaagggccccagctcctcctcgccacttttctggctcatattcatccttcaaactcagagtccactttctcaagaaagagtccctgacaccccagcacaaaatgattttgcccacatattcactcccgttataattagtattactggcaccatttatttgatcatgagtttgtatattaactcctgacacttttctattatcatcttggttggcaacttacatgtcatatcatttcattctttataagtttctggagggaagaacagtgtcttgcatacctttctttcctttgacattcagagtatcttgcacatatatgatcagaaatatctttagagttcgttaaaggcaagagtggtgtggaaggcgacaggtcaaggtgcatacaggatctcatttaacctaatcaacaactatgtgatgtacatattgcctccatttttagaggaggaaacagaggcttgtggagattaaataacttgtccaaagttacacagctaaattgagagggtactgaagtttcagccttgtcttctttactccaaaggccgaacgtcctctgccaaactcctctatatctctgcaaacacatactaagcacctgctttgtgcaaaatactgtgctacggtttgagggtagaccaaggcctgagatgtggcctgctaaatgaaagagaaattttggttttggtctctaggatagccctgtcccatctgcagattttgtacataaccccaaaggaagaaggagggaatttcacatgcagtcaggcaagtgcttaatagaatgcatggtagaccgtaagggatgcagtagagatttcaacagattgctggaggagcacggtgcattagttgtgatgggaaaggtgtcttacagaaagaagagtagagacaaagccttggaggaagtgtagggttttaataagtggagaagtataggaaaggtcttccaggctaagggaaccccgttcaaacattcaaggtgtatttcattcccagtcacctttttcttttggggagcagaacagggcagtggttacaaatatgggctttggaaggctgctacctgtgttctgtaacttactaactttgggaacctgggcaaattacttaaatattctgaactttggtttcctcatctataaaatggggataatcatagcatccaccttaaagaatgatgggtaggcaggaatgagcctactcttataaaatgccttgcacacaggaaggactaaataatcttagtttcacggtaatgctgctgctacagcttctgctacatttgggggctgcaaatattctgcgtgacccaagcatttgattcatggaagaattagtctacaaaggaagggatatgatggtggaaagcctatggtctcgtgcgtatctatcactggatttaactttccatttctttacattattagcccctgaaagacagagatgatgccagtttttgttttgttgaaatttttctaactgatgattggatttcatgcaattctggaattaaaggtctgacttcttgttttctggaaggaagtcctcagccttttcttctcagtaacactcattgggaatgacatacacatagtctgcatggtcatgggtgtgatcaggcctgtgtgacattcctggcatgctacttagcaccaccactctgtctccattgcaaggaagcgtatcggaatgcaagtgagtcagagtgatattattataggggataaccttaaatccccataatttatatttgaagcagtaaattattcatgaacttgagctattaatagcagcaaatgacttgtggggcaacaatgaacctgatgctgtggttaaggaggaggaggggaaagcagcccaagatgggacaaggaccttgacagcatggagacatgcctgggaagagcaaggcccaaacaacatttgtttccatgttttgccatgaactaagtttggtgacaaggttgcctcaaggctgccttgaagctgcaactggtatcttgctggcttcctaaagtttgagaggcagtaaaggatttccagggttgggcttgcaatgggtgtctacttgtgttagagcctccttctttagatcactgtacagctgccccaaccccactgcctgcttttccacaccctgaaatgaacttcttgctgtatctgtctagggtgtggccagaataagtggagagaaacagtctgggggttctgtgttgtcacaccatgagggtgacaagaggtgtctggcactaagcctggaaacccccagcacaaatcacttctggggctaccaaatagcacggtgatgctgtgtgggtaagaacttattgcaggaagtgtagccagagatgtggggagggacaaggctgcccgccacctagagaaagaggcttctgctcaggtcccacagcaggagcatcactgtctggcccttgctgcatgaccctttgtgcttgttagatgccagaacagttgctgatgcctaaatacatggagacctaggactccttatttcatgagtcttgactttaaattgaaggcatttttaggttcaggaagaggataaagggtaggccgtacttctggtacatcagtacttaagggtgtggcaaagtgtgatggaaagaagtgttggagagcctgtctaattctacatctaactgccggtgtgatgttaggaaagctgccttgtcactctggtcctccataaagtcacaccagacgaggcaatttctgaggtctcttccatttctaagatcctgaatctaagttgcagcagaagtgatggaggaagaaaattaaaactggaatttgtggttctaggtctcaaaaagcattatcttattctgactttcacctttggtaatcaaaacaggtcataagggtgaactaataacctgtgtaacaagtgagagattatagttgttttccaggagtgcgtgatcttgtcctgctcggtaagaatttcaccatcaaatgagggcacaatttgtagaatagatttacaatgaagtactttttccaataggctactcttcacgtgtgttatgtgcatacatacacacatgtacatacatacacacatgcacacacactcttaagcttctatttaaaaatgatttgatggtgatgaatttttcattagtttattaactcaggaatcaaaatatacatacatatatatatatatatatatatatatatatgtatagtcactgctatgttactaacattcaagttctatggaattacatccgtggggctggcagattcaggaggctagtcttggccttcaacacgttctgagaacttaactattagagaatactatttctcaaccactctgcctgcaatgttctatctaattaacacttttattacttttctccactgtacctgctcagacttcaggtccctgaagtggcctaatgttccctattctaccactagctttatccgttctttattccggctggaagatatagcccactgctgaaaccctctgttgcttttttatctttatccatctcttgcccagcaaactccaatcttagcacctcaactcttacctttggagggctaagaggtggtggagcagatctcactaactgaacttactgatatcccacagcctcagggactcagcctcagccaagtcttgacactgtctggttatctttactcatgcacctaaacagtctctcattccttatagcagctatctcagcagtctatcgcctgaaatctcttgccttccacttcactcttagctcattaacatctcccactctataaagaacatagacgtcagactggaaatctctctgattttcactgccccctacccttttatctgtatctgcatgcacccttttccccttctttctttctgccacaccaagatgaattcctcactcaggcctctggatgtgcatgactccttttgggtgggaaatccttacaaactggttttgctctctgctacctcttctttcaccactgactcttttctctcagcatttaaacatgtttacacctgtgtgtcattttgcaaggaaaaaaaaaactgttcgcatccctgttgttttggttttccccatggtaaaagttcttggggccaggcacggtggctcacacctgtaatcccagcactttgggaggccaaggtgggcacagcaagaggtcaggagattgacaccatcctagctaacatggtgaaaccccgtctctactaaaaatacaaaaattagccaggtgtggtggcacgtgcctgtagtcccagctactcgggaggctgaggcaggacaatcacttgaaccgaggaggcagagtttgcagtgagccaaggtcacaccactgcactccagcctggcgacagagcgagaatccatcaaaaaaaaaaaaaaattcttggaggagttgcttacctctgtcttcacttggttttcttccattcacccttaatccacatttaatgtgcacctcttccccaccattaatgctagtgcccagtgttcccccaatgcagcaatcctattctagctgtcagactccatggacatttgggggccttaactcactcaagcacttactgttgactttgttcttgaaattcttcctttactttcaggacctctcacggtttattctcccacttcaccacctcttctagggcaattgtgttctaaaaatatcacaggaacaattgcacaggcatgaggagcacaaattctctctttgtgcgcctcaggcctggctcaatacctgctattttctcattctagaacaactttcatgccccctttttcctagctaacgcctagtaagctttcaagatacaactccaacacactgtgcctccagaaaggcctcccaacctccaaactggatgaagtatccgttttctatgtatccatagcatctgtgcaaacctctaccttgcactagattgcagtgattttaatttccaggtcatctgtcttgctttgtcaagttatctataaacctcgtggcaacatgtatgcacaaagcacagcataaaatggatgttccactcaaattactcaaatggaattgaatcacaacacagatgggaagtcctatgctggagaggacccttaagttttggcttctaaaacctttatttttgtcatttgttatttttcccataatagcatcccacaattgtattctgtgcttacatttgtcttcctcactactgtgaatgcatggccgggtctatcttgtgcattgctgtgttccagcatgtaacagtgcccaccacagaggacatgctaaacaaatacttactgatgaactgaccctatatgtgatatacaacgtgtctaacaataggtgcacagtcacattcttatactatgaacatatgaagttggcttgctggttgatgagaagtatgagtgaggtctcaggtgactggcctagttgatgacttagtttaggaaaacaggaatctctttgacttggactttttttttctggctgtcgtgatcagtttatgggtgtctcaaaatgactctagaatatgtagaaacagccattataccaaattcagagagagtataaagattcatagatgggcattagattgagatgtatcagatattgcttgaaactggcccctggctgaaggagcctctgaaggagagtcttgctgtcatgacagcagcttgtaggtgcctcctgagcaagatgacaaagtgccccctccatttcagaaaaaacttgcagacccttccgtatcttatttggatttttctgtgtctcttctggagtttactaaaagttcctttgtgtttcccacaaacatctatttccctaaactttaagtatctgattagtgttgagttttctatgagaatttcccaattcttcataactcactgtggtaactttctgtcagcagaaacatgccttttcttaagggtctagaagcaaaaggcaggggtgagtacggaggcaaagagaaccatcatttactgatgacatcagtgggaagcaggctgctgggtgctgatacaagttaagtggtttaatattcacaccatgggcagcaggcgtgacaataccatggtagagtctcaccatggttcacaaaaccctgtgtgatgatctggtccctgctttcctttccaaactcacctcctatcactttccttttgccagatccaaccacaatggcctcactgctagccttagagcattgcctacgtcagaggaggaacatggaatctgctctcctaagctgtcttcagcctcactcaaatgtcacctctttagagaagtcttctttgtccattgcccaccctaactaaaatagctgcccctttattctctagtcccttatcatattttatttttcttcatgggacttatcatacttgatattacattatacacacacacacacacacacacacacacaaacacacacacacacacatatatatatacaggaatacatatatatacacatttatatgtgtgtctgtgtgtataatatcagatatgacactatatattataatattgatattatacattacaattatatataatatagtatgtattatatctacatttattcctatattttcagctagagggcaagtatctacattgttcactgttgtcttaatcactgttgtgtccccagcacccagcctggcacctgctacatagtaggtcctagataaatatcaaatgaatgcatctgttacagaaaagaacattgaggcaccaccaagtgtcttctcaatggagtcagacctaaattcatctccccggcatcttgggaaggcaggatttttgagctgaactccctcagtcaccccttgctgtacccttgtctcctcactctcttatgctggtatcttggggcccacagaggaaataaccaccattgctggtccctctcacacccaggtggacttgaggcgccagcagatttcccaggctgtggaggaggtgcagaaagtcgttcatcatttgaccacaaacatcagcaaccaagacattagatttcaagctgtgccttactctgacacgtacaatgaaaatattaaggtaagcaagtcttgctgtctctaagtgccaccaacagagccaggacacttgggcaggtgaatctcagtgtgtgacagatgcttgcctcactcagaatactcataacaattcttgttttcataggtattcttagtttttactatttacagtctcattttatacatgtcatttcagccagcagggtgccttatgcctataatcccagctctttgggaggccaaggtgggaggatggcttgaggccaagagtttgagaccagcctgggcaatgtagtgagattctgtctctatagaaaaagaaaaaaagatagatgttatttcctttgagcccccacattcctagatgagaaaaactaggctcagagaagtcaaatgacttgatcaagtcatatcaggcactaaagccagaactcacacagaggcttttgattccaaagcacattccgctgtcacaatcaaagctcagttaaatacacattcatttattaagcacctacttaatagattgggggtggggtggagggaactgagggcatccataagaagacagttgaaagtcagtctgtgggttgcagatggggaaggaagaaagtagaagaggtgccactgagaagctgcaggagcagactggcaacccctctccctgctaaagaatcccacccagtgtaagccaatgggtaacaccagcattcaggcaacacagtagtgagggcagagctgtacacagagaaacgaccttacttaaacctgtaaaccaccttgtggaaaagacaatctgttcatttccattttagaggtaagagaagtgagatcctgaatcattctgaatctccattattctttatctcgatttttattatgccacctacctctttcactttgtattaaatttgtatgtattcatggcccatttctcacaacagactgcacatccctcgattgtaaggaccaagtttactattcgttttgttcctagcacccagcatggtatgtggcacatggtagacacttaacatatgtggaatgaatgaataaatgaatgagtaaaagaattagtacctgagcaaaagaccattgctggcccattacatctcaaggttggtggacgcaggaaccacctaagagattctgggatttgtggattctgaaacagactcagattgtaggaaattaatcccagggtgaaaattataaaaccagactgaatcctggaatgctagaatatcacttgcccaactctaccacccaagccaatctaacttggacacacatagaccagtgactagaaatagagatattacattacttttcttagcactatacccaaggaaatttccttcagtggtcccacttagaattcatagcttaaaatatatcttgcatttatatatgtcatgtctcacatattaagttttgaaaatagctacagcatagcatataaaattgcttttaacttagatcaaaatcaacaagtttttgtttgttttgcttttttgcctgttttttaaagatagggtctcattctgtcacccaggccggagtgcagtgctgcgatcatggctcactgcagcctcaacctcccaggcttaagtgattttcccacctcagccacctgagcagctgggactacaagtgcaaatgccaccatgcctggttaatttttttatttttattttttgtagagatggatttcatcatattgcccaagctgctcaacaaatatctactaagcaccacttatatgactaataacatgatagttgtgcttttgaattcacatgaaagtgaattgaaataatgtacagatctgaaattccagggactttagatgtttttcctctttttaaatccagctgcctttctatgggtaccagaagtcatgtggatacatcatctaaaacatcaaactattgttttcttagagttagacagaaccagctggagctgattagggctttccccactcaatgggtcaatgactggccctgggcaagagttaaccaaattccatggtcagagctttccaggaggaggaggcagctgactcacagccgaaggcgtgcatgcagtgggacatggtcatagttcaagctcctttggctgctctgtttacccacttgttctacctctcggctgccggtctgcctgctttcccccagtcgttgcttcactggttcctggagaaaggggctaggtaaattctgattgtttgcttttttctttaagcttagaatcatctcaacagctcacattgtctcaacaaataagctttcattttgcctttattttggaagggttagtcatgaacactgaccataggtcatcagtacaggccaaaaaaaaaaggagatattttacaaaatctgttacgtcccctcctgttacttcccacctttaatttgtgtcaaaacattcaccattccatgtcattcattgttggctgagtgccagcccagggtagagaaataataactgaacaagctgtccaaagacctaaattcaaattctgactcttctacttactggttgtgtgtccctgaggagatctccaagcccctctgcatcttgaattccttatctggaaaatggcaagaaagctcaccttactgtgtgactgtgaagttgaaatggtcaaatgcattagaattacggtgttgcgtctgcatggaactgaatgcatactcattcttctttctcaaaccttaggtctcctctggagttcctggtttagttcactgtctttacttgtatattcatgagataataaactcagcaggttaatttacttgcccgaagtatttacaatgattcagtagcagaacaaagaggtaatccacttgtaacacccaggtcgaggtctccgtgtatctggtcactctgctgagggtggagtggttaacagagctgcctgacgagacaggttggttcccaggacttccgttacctcccgaatctgtgaattcatgcttgttttcaatcctttcctgaccctaggttttggctcccagtcagttcctcgtcacagtcccaataaaaggcctggccgggtacagggaggccagggagcagcactggcggtactacacactgcagggcaccaggctgccctgcccgttgcgggaccctgagggtctgcagcagtggctggaggtggaacagtttatgaagagcctgtggcagtggcatgagacagatgtgaacatcgacggagacattgtgcctgccaaggtcctcctagtgttccggaagctggtggaaaatgcagttagaacctgtcacctctcaggtgagctgatcaggaacaagtgcaagggtaattgctggcattcccctttcactctataaaacctctgtttgggtgttacctgcagctcacagcctacatttgagaaaataatcatgtgctcttcacatttatttaatcttcataatatgaatcagctttttttcctgctgttgatgcacagaagattggaattcatactaacaaaatagtcttgtggctttaagaaagttactgtgctggcatagatataaaatgctgtggattatgcaccttaaccaggcttaaaaacttaagcgtattgttttttaaaaaagcaaattattcacaaaccccaggtcttctttattagcacatttctactgcagcacctccatctgactgcagtaccacagggtgctgagattccacatttggaaaccactaacttgtaccaaagcacaaaatccaggagccataaagaactgactaagtttgacaactccaaagtcttaagctactgtacagcatatgcatacacacacacacacacacatacacacacacacacactccctttttgttcacacaaagcgaaaaggtgaatttcaaactggaaagaaatggctaattttcttaatttataaatcaataagaaaaaagatgagctgaccaatagagataattaccaaaaaaaaaaaaggaatcacagaaaaagaatacaaatggcttgcaaaaataagaaaaggcattccatctaatgtatatttcaacgtatattagaatatacctaatgttgggtgcattaaaatacctagcaagctaaaagaaatgaaaagtttgatcatgcttagtgtcgagtgggcatggtgaaatgggtattctcatgttgttattagaagtgtaaattggtgtctcctttttaaagggcaagttgtctatattttatttttataatgtgcttacttgacaattcaacaattccagttctagaaatatatttctacaaatacacaaagaattgtgcaccaggatattctctgccataggttttataatagtaaatagctagaagtaatctaaatggctaacaaaggaaaattggctaaattaaattatgctatctctgcctactggactactatgcagcctttaaaaagaacaggcatatgcccatgcatacatacagagctatgaaaaatgcatgtgctaaatagttaagtgaaaaaccaaactgctaaacaatatgagattccatctgtgtgaaaataaaaggatgtattcatacatacatttgtttgtctagacagaatagttctgaaaatttccataatggtaatagtttatgtttaatagatttttttactaagtagaataagtttcatgggttatttaatttaatcctcataaccacacaatacagtaagaattcttttcctacctgttttagagatgaggaaactgagacttagagagattaagtcacttctgaagttcacacacctcataagcagagccagctgcagggcagggtgtgggccggcagggtgtgggccggcaggctggctgcagcatcggctcacctcttatgctgtgcgacattattcatggtgaaagtgcaaagcagagattcagaatgggcaaggtttatgaggcgcttttagtaaataatgctaaagtgccagttgtcatgttcctgtctgggcagctctgatgagatgcagacaagccctttatcccaccctggccagggaatgtttcccttttgaacagcctaacacaattaatgtgcttccattttcttctctgtgcaaggaaatgcaaaataatagattccaatctatttcaagaattgggatgagcaaataaggatgaatagatcctgatctattcaagactgcttatctttatctgcaatgaaggcaaacaaacaaaaactgtaccttttgaaagaagaaggagcaaattggaaatgaggaaattatagtatgtgagctggaaaactactagatgcgttagttttctcttcttctctttgcctggttggaaaacgaggcaatggagacttctttcaaatcactcaatcctctgaaacagtggctgtgacgtgctttgatgtattttgtggttacaggggtttctgatgatagatacctctgaggctcggctggctgaatggatggtaaaaacaaataccatctaagagactgaggctcagataaaagaaaggtgaagccaaatttcaccaaaggcatatgcataaataaggaggctgatgctgtccctaaccagtgtcagaatatctaggtgaagagggaaaaaaaatggcattagccttccctatgtttgcattactctgaaaaccaacatttagatatttgggtggaatggagaaggatatagaaaaatagttaggtttcatttttacagtagcaaatacagaagttccccaacttgccatggctcaacatatgatttttttactttacaagggtgcgaaagtgatacatgtttagtagaacccatacttcgagtacccatacaaccattcaatgaattccatgagatattcaacactttattataaaataggctttgtgttagatgattttgcccaactgtaagttaatgtaagtgttctgagcacttttaaggtagggtaggctaagctatgatgtttggtaggttcggtgtattaatacattttcaacttagaatattttcagcttcatcaggatgtgacctcatcgtaagtcaaggagcatctatactacactttttctttttattctatggcttttactttcagttgatcctcctgaaaagaatctattaatttaaaagaaaaggtaccccaaatgccttggggttgggggagaaagaaaaactcaccagcaatgagacttcttagtaatgttccgatgctggctagctgactaaccatctggttttgatgtcaaaaccttgacgtgctacaggcattgtgatccttcacgtgctacagacattgtgaaagttgccacaccagttgcaaggtgctggtcagagcaactgctcacaaatttcttgtttgaacgcttgtaatgtgcaaacctttctcttctccttatccatttggtcatttcccaccaggtaaggtcagcctgctaggaaaccgctctgcagtttgggttgctgtggaaacatctgcatatcaggtggaactggagctggtccccgcagtggagatccccaccacctggtccaagaaagcccggtggcctcgatgtctgcagcgctggccttcccaagagagagtggagtgcatcaaggtatcagtgggcgggacccagcttgccagagcagtgatgccaacagcttaaccagtcacagcattactgactgccaatgagtttccgaaggaaagttgaggtgttactagatcagcagttctcaaagtgtgggccctgcagcagcgtcacctgagaacttgttagaaatgcagcttcccgagcccccactctggacctgctgaatgagaccctgtgaacagggcccagcaatctgtgttttaagaagccctctgggtgatgtgattctgatgtatgctcaagttggagaactgctgtaggagaggaagtgggcaccatcttctaactgtccacatccaaggtggcttgtggtctccctggcacccccttctcatccccacgtaggatgtgctgtctgcctggtgacaagttccccagaccagcagactgcttcagaaatggctttctacaccagtgagcattgttcttcttatttcccaatatttttctctttcttccagtcgtttggatttaacttgttggcctgttcaaattatcactggcagctgagcttcctccgtgctgagcaggtgttactggaacagctggatgaagatgggggctgccgtaggaagtgttttcaggtcatgaggcacctgaaggaggacatctggtgcccagggaacaggccggttatcacgtcccaccatctgcaggtgagtgtggggcaggttggagaagacccaggggcagctttggataggtcattcttcctgtggcctctgtagggcctggccagagccactcagaaggggtagcatgtgtgaaaaattcaggatgaggttctagtatctatatttgccatccaacaaattactacgtattatggaaatatgtaaactagcaccatatgggagtccacaacacccctgcccagggtaaaatttcctccctcccttcccttttccaattctcttctatcccacttttcctcccctctcacttttattttacccaccaaaccaacctgagtgctcactaggtgccagaaaccctgctgaggttcagaaatgaatcacaaaatgtggtttgtgcctcacactttgatggctttatgtttgcgccagtctttaaacccactgcagcctacgcacacctcctcatgcacacagacccactaacacagaggggaccaggaaatgcaacacagaggttaccacacacgtagtgccacacacttctttccagggtccaaatcaccaggcaaggatcttcccttgctctgccagcccctgcctctccttgccctaaacccaacagtacacattcattcatgccttcactcactcattcagcaagtgtttattgagattactctgggccagaggcctgccccagtacctgctgtgggctcaacctctgcaggcacaaaggtgaacagacacagatgtgtttcctcactcatggcacttctggtctagcatgggagatagacatgggtcaggcaagccagtgggtgcgtgtacaatcacacagtgaggaagcactggaaagggaggagtatggctctgtgaaggctcagagcagcagagcctgacctggactgggcagtcagggggcctccctggagagggggcctttgaccaccctcccgactccctctttctcaaattgtgaaccacacagagtgaagtgtactctcatgtagcagctctgtgcagcctgctggagtagggaggtaggagactcttgcaggacaccccagcccagcctagctagtgtgggctgtgaagcctagcttcagccctcctccctggccccagaaaggatggactccctttctactcaggtaagcacaagtccctggggcagtcacctatctgtgaggtgccttcctcacatacctcttccttctctcattcgatggacaaaactgtcttccagccccatgttactctgtctgctctaaagtaacttattgaaggacagataccacattgatcttgtccagctggcatgctgacctaactcgatgttcttattcattgggagaaggtgaacaaaacccccattatctctcccaatgctttgtacatagtagcgcattaaatatttgttgagcaaatgaatgagtggcttcacatcttactcaacttttctctttttttcgcacaaaatcactaaccttgcttcaccttcttatctttccaataacctgtccattttgacctgcggaagaatctgttaacatctcattcacatgcactggggcttttctctggagttccaacattctcaacgtgtcccaagcacacttccctaaaaacacgcaggctgttctcctggatggagggcatgtgcttgcagaagatactttgattctttctgtggatttagcttctcttgctttcctttatacaggccacactagaagaggcagagctgagacgcaaactcaagtctatctcatatcaaaacctcataaccttaacgattgacttcattacctctcaattaagatggatggaaataccattcggtgacatgaatatttcaggcaggattgaatggggccaccatggatctcccagccatggctgcttgcaaatctgtactccccacaagggctgacttctattctgatggctcctaagtcacctggtggattttaaggcaactccttaaggattctctgtttcaatcctccctgacccacctgtgtggcacaatagggcatcctcaaggatgggcattttttttaagtgggctatttctggagtaagataaacagaaagtgctaactgcctttttctctggtcttccatccttagtccacagacagaattatctcccatttaggcatccctgcccttgaaatgaatgtggctggtgataaatgtggtgctagacaccatcccagatgatgacttgagtgtgctggatccttgccaaatcttcattttgaggaaagtggaagaggttgggttgcaaaacagcattaggaagctgtggcactcagccttgcctcaccttaagtctgacactctcttacaaggccctcaccttctccccaaaaaggctctgccccaagactatttcatgtgaagcaaaagcttatcttttattgccttatttattcctaaaacccactcaaaatacattggcttgcttataatgagcttaactgccccagtttgcttagggagataaaagcttaattaacaagaggaattaacattttttctggtatctaggttatcttcgcttgcatgaaattatctctaactcatttattcataataacgtaatctaaatacatagttgctatgaacttacaactgctctaaaaaataaagactgtataaaaataacccaatatctaaaccataacattaatggataattcattaattcacttattcaataaatgtttattaacttcctctcatgggctagcctttgctgggtactgggtagcttaatagtgaataaaaataggcatcattcactgctctcataaagtttataatccagtaggggaaatgataaaattaatcacataaatataaaaactactactgttgtcgctgcttcttatgagaagtacatgactaagagagtgtgcaatgggtgtactagggaaatttgatctgatggacaaagaagggaaagaagtgtgccctatgcagccgaagcaggatgtgcaaaggctctgtggtagaagggagcatgaaatggctggtgtggctacatgaagagagcaagggaggacacaggtcaagatgagtctggaaaggaaggcagggaccaaaccttataaaccacaccacattaaggatgatgtttttagctaacaaacaatgggaagaccttgaagtattttattttattaattttttttttgtttttgagacggagtctcgctttgttgcccaggctggagtgcagcggcatgatcttggctcactgcaagctccaccttctgggttcacgccattctcctgccttagcctcccaagtagctgggactacaggcacccgccaccacgcctggctaattttttgtatttttagtagagatggggtttcaccgtgttagccaggatgggaccttgaagtattttagatgagaagggaagtagatgtatattggcagcagtatggatggtgataatttggatggtggcaagaacagggatgggctgatgagatcgctactgcagaggtccagtgagatgtggaggcagtgtggagggggatggtagaataatactggaggtgaaggtaaatgggtagactcgagaaatacttagacaagaggattacaggacttgactggggacggtaagggagaagggcgactcctaggttttcgtgttgcacaactagctagttaagcaactctggaggcagatcaggtttgtgcaggaagagcaggggttcagtttgggcatgttgggactgagataactttcagatactcaagagatacacgataagcaggtcagaggagaagtctgggctggagacacaaatttgcaagtcattcatatgtagtgagaattagagctgctgtggtggaggcaacatagagctgaggaatgaatgtagactgagaggagaagagggcctagaattgagcctccagaaactccacttctcaaaggcaggccaaggagtaaaagcctgccagggaggcgctgtaatgctaggagaaaaaacccagagagcagattgcttggaagtcaagtgaaggatggctcaggagggagggtgtgggcgagagaaccaggtctgctgaaaggtcaggtaaggtgcaggctgacaaaggcctattagatttagaaaagtggagatcactgggccttgacgagaggagcctttgaggattaatgagagaagaatccatattggagcagactgaggcaagaaatgggaggagaggaaatgaccacaaataatagagccgactctccagagaagcctggatttgcagagggaagagtgagggcaggaggcagatgtggggttggggttgcaggagagctctcaacttgtgaaaagcagttgaggaagagggtaatcagtcatatacagttcctggaagatgggatccagggccctgtggagggatcagccccacaggcagaagaggcagaagcagggaggaagagaggtgggtgccgcagtaggcaagatctgtctggtttgggaggatgaggggttccattttccccgtaaagtaggaggcaaagacattgcctggattagtgaacattggaaatgttggaggagagtgagggaatagattagggaagaggtgcgggagaccagctggtaaactgaaggcccacctgaagttggggattgtgaattcatggtagatccagtctgcccaggcaactcttttctccctccttccaaggccacataagctcaataattgtttccaagctatcctcctcaattgcccgaaacaatgtctgacagcacttctcccttccacagactgtgctcttttggacctgcgagaaatatccccactttaaagactggcaggtcttcagcaaagcatttctgcgcctggtgaggaaactgcacaagtgcgtgagccagcacttcctgaaacactatttcgtccggaacagcaacctctttcagtgcaccaacccgactgaactggacactgtggcccaaaagctggccaccttcctgaagaacccccagatcggcccgccctgatggttgccccggcctgggaggctcttggacattttattctggcttaacattgttctttggatggttcctcagtcaggtgccaggatcctgcctaggagaaaggccacgaatggcagcggaaattacatcaaaccagaaacacttcagcagggggaaaactgtgccccaggatgtctggcccaggcctccctggagcccagcaagcatttctgccctagctaattctcctggagacagctctcatcaggcttccccaggcacagatttggaactggtgacagttctgaacttagtttcccttgttcaggctgtgatcgtctcacagtgaagatggagacagaacccctggaagtctggacatgagcctgctggccaatactgtgcccagcccactgatcatgggcacattctcctgccatttgtaaaatgggaatgttaacgtgcctacctctgagcagggctgtgtgcctatgaaactgtgctggcgccttttcaaggggaaggcattggatcaacacaaagtgttcctggttggttgagtagctggtgtttgcatcctggatcggtacccacagcactgacgcaaaattgcacctgatgagttagtgagcctgtgcttccttgctgccctccagcttccttagcatgtgggtcagtggctcctgatgttctgtctgcttcgctggtattctctaagcagggaggggaatggttttgatgataagtgtaagtcaaagatgaaagtacaactcttggcctgatcccaaccatagccctctctttgcttcccatgccatgggccatggatggaacttccttatatatttatgtaaataacctagtactatgatctgcatggagtgaccttaggtgtctgtcactgctcagtgtgttcctttgctcacttcattcactcactcactcattgacaaataatgctcattaggcaccgggaacacagcaaagagcaaagtggatgaggacctccccctggggatgccacctaatggtggagacaagaaatgaacgacagataaacacgcacagttattacagatggaagcaagtgcttcaaaggaaataaacagaatgttgaagtagagtccacagaaaggtccccgaaggatgaaaatgcaaatagctgaaggggaaggaaaagtgaccaaaggcaggcatggtggggctggcatgagtcagagcacctggccttgtaaagccaggaaggaatcagtattttattctaagatcaaaggtgtgacatttggcctctccagaagcagaagagtatcacgatctgactgcattttaaacaattgttctggtaactgcatgaagaaggtctggggactcacacaggagctgggcactgagtgctcttgagccacccatttggaatttcacagaggcccacaaggcaacatattctgtgtggcacaaccgatcaggaattctaggagttctcggtgagatcaatggtttttttctggcgtttatgtaatgcttctcaactcaaggggctcctttattacttttgaatgtttttgcccaaatgtctataccaaagataaatttctaaagcatgaactactgattttgttttcatgaaaattcacatttgaaaatgaaaatgattacttttcaaaagtactgtaaacggcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatagatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaactcctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaattgaaaaagagggaatcctccctaactcattttatgaggccagcatcatcctgataccaaagccgggcagagacacaactaaaaaagagaattttagaccaatatccttgttgaacattgatgcaaaaatcctcagtaaaattctggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggacgtatttcaaaataataagagctatctatgacaaacccacaggcaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacaacatgattgtatatctagaaaaccccattgtctcagcccaaaatctccttaagctgataagcaacttcagcaaagtctcaggatacaaaatcaaagtacaaaaatcacaagcattcttatacaccaataacagacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaacaaatggaagaacattccatgctcatgggtaggaagaatcaatatcgtcaaaatggccagactgcccaaggtaatttacagattcaatgccatccccatcaagctaccaatgactttcttcacagaattggaaaaaactactttaaagttcatatggaaccaaaaaagagcctgcattgccaagtcaattctaagccaaaagaacaaagctggaggcatcacactacctgacttcaaactatactacaaggctacagtaaccaaaacagcatggtactggtaccaaaacagggatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccaacaaaaagtgggtgaaggacatgaacagacacttctcaaaagaagacatttatgcagccaaaaatcacatgaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaaaacttttacactgttggtgggactgtaaactagttcaaccattatggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcagacttggaaccaacccaaatatccaacaatgatagagtggattaagaaaatgtggcacatatacaccatggaatactatgcagccataaaaaatgatgagttcatgtcctttgtagggacatgggtgaaattggaaatcatcattctcagtaaactatcgcaagaacaaaaaaccaaacactgcatattctcactcataggtgggaattgaacaatgagaacacatggacacattaagggtaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtatgattaaaaaaaaaaagtactgtaaccaaatggtggggtccctaggctatcgtttaataagtaatgattttaaaatattgaaaaaaaaatttccaaaccaacaatgagtttacaatttttgaaaacatgaaggcttggtgcagtggctcatgcctgtaatcccagcactgtgggaggctgagacaggagggtcacttgagaccaggagttcaagaccagcctgggcaacatagccagacactgacaccccgtctctacaaaaaatttaaaaattagccggatgtggtgctcaggaggctgagatgagaggattccttgagaccaggagtctgaggctgcagtgagctttgattgtaccactgcactctagcctgggtgacggagtcaccggaagggagaccctgtctctaaaaaaaaaatttaaaaagagcatataaaatggtgaacaaactaacattttgttaaatcatcaaaaatttgtattctaattctcatattcttgtatcttaggaaacatcatttttgaaaaggtggcaaatgtaataaggttttaaatttaatttcggccgggcagggtggctgaggcctgtaatcccagaactttgggaggcctaggtgggcggatcccttgaggccaggagttccagaccagcctggccaacgtggtgaaatcccgtctctactaaaaatgcaaaaattagccaggcatggtggtgggcacctgtaatcccagctacttgggaggctgaggcaggagaatcgcttgaacctgggaggcagagcttgcagtgagctgagatctggccactgctctccagcctgggctgggctacagagcgggactctgtctcaaaacaaaacaaaaaccatcttaagcaacttttaaaacagctacacagtcacggaatgctaaaaagtgaaaattgactgtaacattggttcaatatgtgtgtacgtgtgtggaaagggaggaactgacgtgcgccacagtctgattccggtagattctttccgtctttcccctgagatctgagggttttgcaggaagcagggctaccagcagcttcctgcgtattcccaattcttgccagcagagggcagcaagggaacacatatgaaaggagccaggtcccacccattctcgtcctcggagcccagcaggtgtcacacttctcagcccgtaacttacacctggtccctccagagcaaggatgagtggattccagctcatgccaaattgttgacctttcctgccattttagccgagatttacatctttctccttaaaactcagattttaaaagggagcctatgagaggaccgtccatccaggctcccggggcattcagctccattctgtttcctgggacagattgcacagctaagaaaagccagagaatattactcctttattctgttcttttttttttttaattctccaaaagaccgttcaatccttcttcactcttccaggcccaagactaggcgtgtagaggaatggttggttttcagccaccgcagttgacctgcctgcgtctgcatcccagttctgatgccgaggagctgcatgaccttggcaagctgtttggcctttctgtgtctctagttccttctctccaaaatgggcattgtgatggccagaattgtgtccaccacaattcataagttcaagctccaacccccagcacctcagaatgtgactgtatttaaagaggtgattaagttaataataaagaggtgattagctgattcagtctgacgggtatccttaaaggagaggagattaagcacacagagagatgccagggatgtgcatgcgcagagggcagccacccacagaccaaggagaaaggcctcaggagaaaccagcctgtccacacctgctcttggaccaccagcctccagaactgggagaaaatacatttctgttatttaagtcacctagtctgtggtatttggttattttcctatggccctaggaaactgttacaggcatcatgaaagaatatatacctcatagtgttaatgagagcaacgaatggaatgatggatgtaaaaggctcttagttgagtacctggcatgggataactgctgaacaaatgttttcattttagatgcctacccctcgtgctatttgcccatctctaccattcctgataactataccagaccacagataaattctttgtaaagaaaatataaaccatcacagaggaaacatgagaaaatttcactgcaaattctgcaagcccattctccccttcgtccctcttgctaaaatatagaaggtatctccctgaaaggccaatttctccacatgtgacagctcagatgcctcccagctcttcagtctttccatttatttcttgtagtttcctccacatcctcccgcaatggccgcttcactctcttctcccctttactgtccagcttcctgagttactatacgtgtatctccacctactcgcctcattcactctttttgtttttttaaattgtgaaatatatttatacatgtgagaatctaacctatttaaagaagaataataaagcaggctgggcgcggtggctcacacttgtaatctcagcactttgggaggctgaggcggggggagtcacgtgaggccaggagtgtgagaccagcctgtccaacatggcaaagccccgtctctaccaaaaatacaaaaaattatccaggcgtggtagtgcacatctgcagtcccagctactcggggaggctgaggtggaagaatagcttgaatctgggaagcagaggttgcagtgagccgagattgtgccacggcactccagcctgggcaacagagtgagactctgcctcaaaataataataataataataataataataataataataataataatacaccaatatactgtaccttggtgaaaaatagcacattgtcagtatacggaattctccttgcttccccttccttccagcagcctccttcctcccagacataggtaatcgtaggtatcccacattttatgttaatcattctcatgtttttctttatagttctacttcctaccatatttcattgaacttaagctcccgacattgtaagatgcattattatttcacctctaagaaagagactcacaaaatgaatggtttggttacaaaattttggttacaaaatgaatctcaattttgaagtgtttgaaatgtcaaaaaaagagacatggcttagaatcaacaaaatatgatctgcatgcatcccaaattgtgtttttagttttgactgtttcatttatctaaaggctttacatacatgaaatcatactgtataaagtcgtctgtgattgtttctcatggccacagagaaacaatcttttgagattgtttttatgcttttgagactcccatgtgtgtcttcatgtagcagtcgtttattccttttcaccaataaataatattccactgtgggaatctgctgctacactttatatattcttgttactgtaattggacatttgcattgtttccagtttttgtgatttgaatgatgtttttatgctcattcttatacatcttcagatgcacacaagtcttttaagggtgtacacataagaataaaatgtaggttcacagaatacatgaatgtttaaatttactaaatattgtcaaaatatttccaaagtgattacgccaatctaaattctccattttaatatgggtggattttcagcaactttctccattataatggagcacattttgcatcttgtttaaggaatccttctctcttttcaggtcatgggagtgctcctatattctctagaattttatagctatggcttttaggagaagtagctgttccttatttttcctattctattccaataatattggggtaatctctttgctggaaagtttggtttaactcatgtaaagaactggctggaccttcagttttattgccaggagatattttactattaatctttttttttttgtggtaggggggcggaggagggtacggaatctcgctctgtcgcctaggctggagtgcagtggcgtggtcttggctcgctgcaatctccgcctcccaggttcaagcgattctcctgcctcagcctcctgagtagctgggattacaggtgcacgccaccacgcccagctagtttttatatttttagtgagatggggtttcaccatgttggtcaggctggtctcaaactcctgaccttgtgattcacccacctgtaattacccactcacgcctgtaatcccaacactttgggaggctgaggtgggaagatcacttgagctcaggagttggagaccagcctaggcaacgtagtgtgacctcatctctatattaataaaataaataaataaaatttaaaaagagaaattcctaccctttcttcttttctaagtatagaaatttttaaacgccattttagtgcaattccacaggttttttttataatttatttttattgtcttcaagttctatttattttctagtttctacactaattttaagaaaattgtttccaaacctgttgggcttcctagttatgtttttgttattgatttatcactcaattgcactgtaataacaacaagtgatctgaatgaccccaatcccttgacattaattgaggccagctttttagcttagcacttcttcattgttctatgtacatacaaagaagatacacaagtttagatgtaatgtctaataaatgtcagttatatcctacagtgctcaaattttctatattttatagatttattggggggggctgtatttcctaacatttactgagagagttgttttaaaatctctcattatgataatggacttttcaatttttgtgtatggttttgtcaaaattgtgtttaatgtacattgaaattatattattagggctgtatggtttagaatttttatatcttcccaattaattgaagctttttcactataaagtgacctttttaaactcttgtaaacattttgcgtaaatattgatttttgtcagttattaatacaataatatcactttattttggctagtagttgcctggtatatatttttccatcctttaactttctatctgtttgtatactttatgttgttgataactgcattctttataaatggctgattttttaaaaatcccatctgatagttgaggtcttttgactctatgtttagtccatttatatttattcgaattgaaaatacatatggattcatttctattcttttattatttactttctatttgacctattttataaatcctctgccccccacttttcatctttttaaaattaagaggtttgtttcttctttttaaatttcttttttttcttattggcttggaaagtccataccctatctctgtccttttaatggttaccaagactatttacacataccgactaaattgtgtagattaaaatctaaagctaatcaataccttcattttcctttctgacaaggactcaaaggctttggctgctatcaatctccctaccacattttctgctgttgtcatcctggattttggttctagactatttaccacacccctacacacatacacataaataaaatagatatttttattacattattttatatttcttattttatgcacatattagccactatgttaactcactactctttcttgcatctcggattttctattagggatcattttccttctgcctggagtagatgctctaccgttttctatagtaacagtatacaaaagtaaacagtttttatttgtttgaaactgttcttattcacctgtattcttgaaaggtaatttcaattttatgttgaaaaacaattttttcagcatattaaaaattctttcactgtcttctggcttcttttgttgctttttacaagtcagtcattagactatttgttgtttctttgtagagtacctgcgttattctatctgggctcttttaatactctttctctctgtctctgtacctctttctcttttttttggatttattaggcctcctgaatctggggaactatttccagtaattctggggaattatcagcccttaactttaaatattgtctcttcctcattctctcagtattccattgtagaaggaaactcaatttacatgtataacacattctatcattctaccctctcttttaccttctctttttagaattggcatcttttttttatctctcagacctgcattctcagtaatttctttggatatagcttccaattgactaattctctcttcagctgcctctaatctattgtttaatctgtccactgaatgttaaatttctaacgtttcagttctcatttttaggaagtctgtttggttatttcttaaacctgcctatttgttctttaaggtctcatgttcctgcttatgtttgtacataaacataatagatgtttatgttttgtttaaacataatacaaaacatattgttttacatatatcttttacatatatgttttacatatatcttttacatatatctaaacaaaagatataaaacatatatcttctgtttaaacataatagatacaattgttctacattccatatctgaaaattctgtttattttccttaaaactttatcagtaggaatttgtttgacatttgatttgaagttgaggtatctaaaaggatttgcttttaattctgccagttacccaagagcataccaactcgagaccatttaaattaaacttgatgtttgtggtttttcaggccaataggtaaatgaatccagatagaaaacatttgaggctatcttgtggttaaaaatccttaggggatttttttccccctccttccagtgctaaggtcaaggtaagcaagatgacttctttatagcaggtttattcctcattaacccttattctgagagcatgggcatttgagccaaattcaggcaggggaatcttagtcgattccctaccctttgcaggccataggcattctcatctgttccctagactagtacggctgaccatgaaaagttccagatttctaggatcagaaaacctgtcagagcaaaacctagttttgctctctcctcatctagggttcttagttttatttcatt

SEQ ID NO: 268 - DNA, 267288 bp, Homo sapiens
tcctctgtagatactctattaatcctctatttctactggctttcattatttttgtgtacgcagacatgtccttctttctatatctctagccattctaaaagtagataaatcagtgcttctgaaacttgaatgcccatatgattagcctgtagaccttattaaagtgcagattctttctctgtatgtctggggtgggattcacgtttttaatttttaacaagctctcacatgatgtaaatgttgatgtccaaagatcacttttagcagcaaggattaggatagcccagctcaaatctatcatctgtgtgaaatcatgaacaatgtccccagacagaatcgtcttttgtttctttggctcttaaagcacatcatttatattcctaacttagcacttagcacattcagcctgctgtgatgtatacaattctgttcatttctaactaaattcttgacagtagactgtgcgttcaactcctgaaagctgtcagtgtccacacagggatgttgacatactcgacccatgattatcaaattattgaactggatagaaaataatcgaataatgtcctaaaataacattgttttttgcataagcattcatttagaaatcaccaacatcaatcaactcaactagtgcaaatcatgaaagagagtagtggtgtgacccacacaatggatggttttggtcgcttggcaggtgttaacccaatgaccacaaccaaggaggatttaccaaggggatttttgttacttgcaacaagtaaggagaacactggggatagttcccaaagcagtgtgtctctccaaaggaagatgagagcagggctttcattaggctggttggcttagtcattgtatgaaaggcagggtaaaggcagtgcaggcacagtcctgatcatgcttcttcatatattgcaggtatagaaaatggtgaataagctcctccctaggtggggtttttaagtatggtaatagggagagttcaccaaacttcatctccaactcaggcacctctggttttacctggtttttgttttgctatagctgggcttcttcctggaaccttttgaaacagcagaaactcagtgtgccacagttacaagttactagggaaccctgagttacaatgtgaatgatcccaaaaggcaaataaattgtgatagcttccttcttttaaaaatacactatagaaggcaggtgggatgatttacagggtgggatgacaaagctaatctgagatgatatattttccacagataatcaagtaaatgagcaataatttgcttttcaaattctgagtctcttccctggctatgctttaaatgggacttccacatgggccatagcccaaagttggatccctttgcacagaggctagacattgaagtagtggcctttggggtaacgcagactcacttctgttgagagtaattagcgaagaaaatttgtgggaactgaggaaggttcagcagaagtctgccctctctggacattttttggtggctgggaagcagggcaattgtcctgcctgactgtggagtttgttcagccttgtcatggacatctattgcataattccgactttccttctctggagtaatggacatttcacttcagaaggacttttaattttacttaaaaaatccagtcaacataatagaagataaattcaattttcagtaacattttactctgttaccacttatgtccttagggaagcttaaagaattttcatcagtacactaaaaattagatagttggatatgttgcaaaactttcaacacttgactcaaaattcccactattgctaagacattcttataaagaaatattttggggggaacttagcaactacggttcttgtgaagtggtcccagtgggaatgaggtttatgccaaactctttttttaaaatttggtttctgcctcttgtgcctggtatccagtattagttacagagtaaacagtattttccgaagactgacagggtcagctgttctgggaatgtggccgttgacctccctgatggattactgtcctgcagactgcttccaagtcagtagaaaggtaagcattctttctgtataagtgcagattgctttggaacatgttacaatttcaactgataaaactgaaagtacattttgggcacactgtctcaaagggcaccgagctgttactttgggggcaaagtgatttatcatgtcaacacaaccatgacagttaagctgctgggtttgggggaggggtgagctaggtgttgaatctggttgtattgattaagtcaaaaagacccagaaaaacttaaatccggaactcctttccaaagttagaaagacacattgtaattctgcttctgagtccttttccctaaaatcctgtcagttcaccttggtttgttgtctttactcctgaaatagcaacggtgtgtgtgtgtgtgtgagagagagagagacagagacagacagacagacagacagaaagtggctactaggaactactaggaagtgtatcgaccgttgaaagggcctagaaatatattgactgcaaatgcaagagcaaatcctgttcaaccaagtacctctgtggatgtaaccatgcacaagagaaaataaattgaaagccccttgaaaacgtgctattatatagtagttgagaaaacggaacatgctggacttgattctcaactgattttagccagtttgttttacagactctgaaggtatgaatttagttttatatccgaattactattgctatgtagaaattgtcaccaatgttaatagcagtagttttttaaaacctcacattttacttttcaataagtttccaataaaggaattgcatttttttaagatggtgcacaaattaaaaaagcacttttcaaagttcttacagttctcacttgattcaaatattttctaatgcttcaaaaaacactctgcctcagaagtaattttagaaagaacatgttttctcccttagatggactaaaatgtattttttatagtcattcaaaaaatatggcccagaaccaaaataaggggacaaccagtatcagaagaagttaaaaaacttacattccagtagaaatagtttatgtttcactgaagaacagtaattacaaaggtacaagtttgttaagctgtcattatcataattatcatctactgatattttggggttggcttttttatctgcttggcagcttcaacttacaaacaatatttgttgtatagtgacgaattcaactttaagaaattcctctatagacattatcttttcacaagctctgagtacccaccacaacttttagaactcagtactgcttgcctacagaagccatcacggatgccttaaaaagggtggtgatgggaggttaaaagtcttcccgtagaagagttgacagctgctccttaagagtttgcagctgccaaagctgataaatagattcaggtaaggatgctgagacaaccagaaagagctgggaaccattctctcgcttgcctacagccacctccctccccaatgctgtgaccaccaattggaacacagctttctagagacaaaggcataagctctgaactaagagcaacaccaacagatcagaagttaactgtttgagatcagtgctcaatgctgggtctgagctacatttggattaggcccttgggtacctgaagcatgtgctgagtatagtatcctggtccatcactaaatgggtgtggagattacgtgggcttctgaattgatcaaggggggaataacggactcatgttctggatgggctatgtggaatgataagaaacctttataaaagcatcaattgtcccagaagatgacccctgtcttagtaaaaagatatttatccttggagcatgtaatggggaagattctgggttgtctatgccatgtttggcagattgtcattctttcaaaagaaaacagcatttgttttcattcgtgccttgtctaccttgtgaggtttcagcagtagagcacctatctgtgctttttttgtggagaaggaagttttttaaatggcaggtgagggaaaatcaccacaattaaagttaatttacatttggatctctgatccagtaaatgaacaagcaattttaattgctgcaagttccactttcccccagtttttgaatacaggcacaaattcatcaggcacttatttgggaagcaggtgtattgaatgcaaaggaatgaagtgaggtggcaatatcttgaaccaaatattatgtgccagcggtcatttgtttccattttgaatggaattcttgcttggttactgcagtttacattttaatttcctgtttggagggaccctatgtgtgtagtatattcctgggaaaaataataaatttccagcttaaaaaggaattacaaatctttctttgtcaattttttttaaaaaagtaatagccttcttaatgtataatttatatgctataaaatttatccttttacgctgtacatacactttggtgatttttagtatattttcaaagttgtacaaaatcatcaccaatgtctaatttcataacgttttcatcatccaaaagagtaactctgttcccgttagcagtcactccctgttctgccttccctcctaccactggaaaccacaaatgatctttctcattccatgaatttgcctattctggacattttatgtaaataaatcatgtaataggtggtcttttgtgactggcttctttcacttattgtattttcaaggttcatccatgttcttgcatgtattaatacttaattcctttttattgctgaatagttttccctgtatggatataccacatctgttttaccatccatatactgatagatatttgtgttttttccactttttgacaattacaaataatgctgtcatgaacatttgggtagaagttttgtgtggacacatgttgtcacttctcttgtgtatatacctagcagtggaattttggggtaatattgtaattctatgtatagcattttgaggaattgccacactgttgtctaaagtggctgtgcccctttatgatttcaggagtaatgtaagagggtttcagtttcctcacatccttgccaatgcttgttattgtttgtgttttattttagccatcctaataggtgtgaaatgttatttcctggttttgttttgtgcttcctaatcactatgatgttgaacatctttccatgtgcttgttggccatttgttttctttggagaaatgtctattcaaatcctttgtccatttttttacattgggttatttgtctttttattgttgagttgcaagagttctttatgtatcctggatacaaatcttttatcagataaataacttgcaaatatttgctcttattttctatttcagtggtttccaacctttttgcttcccagaagacaatttttccacagatggggctaggggtgggggatggtttctggatgaaactgtgccacctcagatcatcaggcattcgttagattctcgtaaggagcatgaaacctggattccttacatgcgcagttcacaataagattcacgctctgatgagaatctaatgctgctgctgatctgacaggtggtggagctcaggtggtaatgctcgctcagctgccactcacctcctgctgtgcagcccatttcctaacaggccacaaagtactggttcatggcccaggggttggcgatccctggtctagttaatttttttgccacacttattagggtttggatagtatctttgaagtcacctttttcctacataaatgtcatgtcgaccagggaaaaaatgtcacacgcttttactgagaacctgcttgttgccagacattctgttaggttccttacacacaaaatttaccacacttaattttcgtaacaacacatgtggttggtatcatccttctatttaggggacagggaactgagactccgataattaagtaagtagtttgctcaaaatgagccaactagagagtagcagaatctgcaaacaaattcagttgtccctgcttcctaaatccatttctttctcccttaatagttacgtgagtaggatctgtgtcttgaacaatcaatatggtattcattgtagtatgatttgtgttggattaatataattttattcctgtttcctatcaaaagtcttataaacgattatgtattaagtgtctcaagtctcattcattggatccattttcttccctgccctccctctcattctcttttccttctttgatttttttctttccttccttttcctcttgccctactttttttcacaggtatttatttagcccacactacattgtacgtgcctgaataatatgatgaataaagcacagtttcatgcttatactctagcagggaaggcaaactacaaagaagttcatatggataaacttaacatataatgtgacataatttaataccaaagatgataggagctatgaagaagaaaacagcaagtgagtgaacaaagagtgatgggtttgctgtttgtggtggggaaggcctggatgaagtgagaagggagctacgtgactatctgcggggagagcactccaggaagacagctcccaaggaaggaacatgtttattgtgactgacaaatggaaaggacaccagagtggctcagtctcttttctgtttgaccagcaagtagatgagagctagcttttgcctgggcataatttcatctaaagaaagcttctgtgcctcagtcgtatctaaaatatattcaaacgtatctctgaaaaggcatggaagagagagcattcaccacacagtgctggtgctgtttacccagtctcctgctacacctgtaatgaagtgatttgttcagaggagaagctaaagtgcatagcggctggagaggagcttaggcgaggggccttgatggctgcttattagttgtgtaactgtgtcttgctttttcaactctgaaatgggtatgttagtttgatttggctgtcctaccaaatactacagactgggtggtttaaacaacagaggtttgtttcctcaaagttctggaggattgatgactgaaatcaaagtgtcagcacagttggtttcttccttttataaatatttgtaaatttattttttattcaaaaaatttttccacctctaacttcgttgtgaagactatttagtacagcaaatgttatggacagtttaaaggattggggccaacgttaactgaccaagaacaacttccatctaaatcatcacaaaaaatgtttaaataaagaaagaaaaaagtaaaagtaaaaaagggggacaacaggagcttcaggttgaacaagaccctcacgtttatctaatacattcaatcctagctagagtgtaacaaaatggaaacaggaacactgtaatcctaaacttccattacagctcattctttgtacacacctgtgaagcccaccctcatttctctagtgctcccaactcaattacatcctagtctgttgggactgctgactcaggagcatatagaactctttaatcctatctttgttgtaaggctggcatgtctgggtattagctcgctaaaccaggcagctgaggtctgccagatcgtccataaaatcaaacaactgatgatatcagtgtgacagaggggctgttgggatcattctcttcagatattcttcatttattttacaaatgccgtccatgcatttgttcaaagattcatagtcagcctcagttctgtcttctggctttttggtaggctgtgccagcaagatggtgtgagatcgcccaccaaactcttctcacggtagctgctgcttaccctgcagcaccagggttggtttcttctaaggctgctctctttgacttatagatggccatcttctcagtgagtcttcacagggccttccctctgtgagtgcctgtgttctaatttcttcttagaaggaaccactcataatggattagggcccatcctaatgccttcatttaaccttaattacctctttcaagaacattctttacatacagtcacattctagggtattgggggatgagaacttcaacatatgaattttggaggcacaaatttagcccataacaatggggaagataataatatctaccctctagagtgattttaaaagggaattgaaataacatttggaaagccttaaagcggtacctagcgcacggtgagtatgccaaggaactgtgctatatgagggttattatcctgctactatccagtcgcacctcggttgtgagtttgttgagggccaaaatccagggattgtatttgtaaattgtattattattttcaattattttatttaaaaaaaactacctgcccctaggataatctttatctattacaggcactcagcacatgtttgtgtaactaaaacttttcatgcctaccacatctcttccaaatcactaccatattctcatctgccaaccaactctgcatcacacacaccattccttttcctcctaaccggatcctggattcagtcttcaggcattaaactcgcatgctgagcacgaattgagtttccttttgcagccacagcatgattcttttttttttttttctagagaggtttaggaagttcgttcacttaagattttaacaattgccttacttttgacacataccgatcttgcatgttaatcaatctttaagacttttgttttccaacttgttagaacaataaccagcataaataatttcctttctggaatttacatttgagtgaaaagaggaagccccttttgcccatgaatctaatatggtgtttctgaatttatcatcctgaaggataggtttattgcctactcagtgtttcacttctggagtcttcaaaccttccatcatgatgcagaataaattctggagcaaccctgcctgacaacagaggattgactgcaatcgtttgaaaggacagagctccacaacacattttctgaaatgttttcttatgaaggaaaagctgatagggaatttgagttaaagtagacaaaacagaacaaaacaaaaccaaaaccaaaaaacaggtgttaaaaggatgttttaaacaggctgaagtattaaatcaccatagagagcagtcttagtttactctgaaatccgtttctattcttctattaccttccacatattttgttttgctgcaaaacacagggagaactatttaccattaagttgcccaattaattttctttaaggcatgtaacattttctaaagaaatctgaaagtacttgttccactgaaaaaaatgagatttatcttctatatcataactttgctcccagtgaaaaagccaggataatgaagaacaaaatccatttttgtgaaggaaaacacttttatttcatggtatttttaaacatcattttgtcaactctccatggaataaagttgacaacaccccttgaatatatatttgcatgtctttatagttttaatttgttatacttttgctcttcctctttaagcaacattttgaaaaatctacaaagtaatacaaacatatctacagtactaggttgcaaattggaatttggaagcgctagatctgctgattttatttgctatctgactatcacatttgttctttttaactgatttattaggtctgtattctagagtatattttattctgttgcaacagctattaatgaattctttgatcgtggatttttgtcacatacatctgtattggttcagggagcctaacctgttggaacattctgctgaagagtttgcttttatatctagggacatttatcattatctaaggccagctgcctgacttctcttcagtgctctgtttatagggtttgaacatctataaatggaaacactagctaaccagaaattatcgctagggctctctgatagtgtcctaggctctcacaacttggaatgtcctgcaatatctaacatgtaagcacgtcgaatcattttctagacagaatctgaacctctgtgtctctcagtctttctctctttctcattctctttcaatatggaacttgaaaagcgtgaaaaaagaagcttattaaacaagaatttagaggagaaactgacggtaagacatgagatttagcacacacagatttataatgaaattgacagggtagtagagcaactgtcatagactggaaaagttgtgctagccggcctctgtttccatgttttgctggtcaataactttaaaattaatgagttccatgggctttcctgaaaataatgtaataaagttatatataaaatgccattacacaaatgagggcaaatttgatttagttaaatgatgtggtttatcgtcattttaaaaactggaatccatttattttgacctctcattgtgattgcctcagcactggaagattgttttatttacgtatgcgaagcttagcgagtgttcaaatccattttttctcagagataccaggaatatatgccaagaaaaataagtattatagaatatattaatgttttattaagtttaatgaacttctggtataaggataaagttttttgccatagaagttatacaagtaattttgccttgatactaagcaattaaatgtcaatgattaatatggtgacttacatttgctcaaatacaaaatagactataaccttgagttaaatgtgctgtccatggctcatctgatgagcataggtcactaattatgtttgtaaatttactgtggttatagagttaacattggaacaggtcataactaatgttaatatcagcataaataacaaaaagtaagataatatagcccataataagaccaaattcatgggaatacattgttctagatgtatgaagttgaggtttatggactattcaagatattaaaactagaaaaatggaaaaaagaaccatactgggttgaaaactcttgaagtgtattagaatttcaaggtcttaaagtaatatatttaataaaatacacaaccttttcttaaaggaatcaggtcatcattttcagtacccactttgtacctctgccctaggtgattgtccagacatgtaatggccacagagtattttcctttctgactatttggaaaggccatgtgtccttgtagagctaaccagggattttgaatcagaaagggcttggtgaaaattcttgcccacaactaccaaatataagaccatggttttgtttaatctttctgagtctcagttaattcatgtgtaagatagggaacagtaataactaatctgaaggcttttgtgaagaataaaaactataatgtatgtgaagtccctagcctaagcctatttttaaactgtttttggtctgattcacttaaaaagcacatgcccaaagtttactaatatggaaagaaaaaagttaaaatgcatttaaaagtaaaaaggaaacccagatatggtaagcataaaggcttagtggtcataaaacctttatgaaaccagatagggagtaactaaatacatgaataattggttgctatgaattagtgtgaaatttgaccctgagcttcctggcagtcttttacaggaagttttgcgagtaaacagaggacatggggcaagtgcacaaagtgaagatggactcttcttattcgaagtgattcgatgtattagcatttcactttctggaaagtcagacattgtgcatgcctgactctatcttgaatacagctataaatctagaagtgagcaaaaacctttccttagaggaagtagctgtcacaaaactcatgaacattactctgtagcagaggcctaggtctagcctcagattgacttccaaagattgcggggaaatatggcggcacatcagaggcatacgaacattcacctgcattgagaagagaggctgttctaggggtggcaggaacacatgaaagcccagtgtctggggtagttaagtgtacaagcaaatagagttaaggaacctggcacctttcagatacaggagttctgatgacactgttatcaagaaaagttttgcctatgcttagtattttctatttaagagagttggaaaatctatatctttgagggtttccaataaaagttattttggctgtttatgtgaataaatatccaaaaacttcagttcatcgagcattatgtttcatgttaataccaatgtaacacagtatgactggctaggttgctgaagacagttgaaaaatgtatttttgtggagttcactattttctgaaatttattcaatttatttattataaatagtaaagttcgtaaaagtctggtttttaaaagaagaaaatattttttccattaaaatatttaaatatgtgtacattataatattgtgttatacgtttgttaaaattaaagctgtatctctcataaggatctttattatgaacagtgctatagtatgtgtcacgcacttaagcaatatgtattattgggtttatttgaaaaaatttctaaggtaagatctatagtaaataagtaagaaagtcaccagtctgcagaatttaaaaattcatcagtttattacacacaaagataaaacaagacaaaataagacaaaggcaagacacaagtaaaacaagattctttgctacacatccaatataaatcttatcttaccctgggtgagtgaattgctacttttaagtattgatttttgccctgagtttattgctgtttgctgattaaaagattgctaggtacttaaccaattcaaggtgactcttttacatctattaatcaatacataatcagaaataaaggaatgatatcaaattcttcaaaatttcttaaatctaccaatgccaagtgaaatttctcataatttggttgatgttattccaatatttcaaacatgagaagaaaaatcaattaacatggacttaaaaggacatttccacctctttgaaaaccatctattaaatcatgtggaatatcttagtcattgattctgctagatgacaataaagctaatttttgtgggaaatggtagagaggtgcaagaaaggaggaaagtattttgtaacaatatgtttcaatttggttagttccaccataattgctgttgaggttgaatggatcttttgtttttcctatcatgtattttctaaactctgttcctgggaattctgattttccaaaatgcttcccaaaatgtagttctggtttgtgttcaagaatattcagaaaacactgagcaggaaatgcactatacaacacatttccccttggagactcgtatctgtattgtaatatactaaagactgtgaggcactctggaggttaatccagtgtttcctaaactcgcctatcactgtaatatattttaatgtgtgtgcaataacagtgaatattctgaggaactagcagtgttctctgcaacatatcttaggaaatgacctgttagcatatgaatttgtagtctgattttatttttgagttgcatttttggaataatgatagacaaagagatacattcaagctgggtatatttgtatctataacatgaagttacttctggaatagttttaagaaataggtactagtttctatgtattatgttaagtaaaactaagacaacaaatcttgactattttccaaatgtctttaagactataagtgcatcaacaaagagtattacttatatttaccttctactgaaatttcataatgaaaaggaaaaaaaaatcatttattactatagtaaaaatgatcatgtacctcagggcattctgataaataatggtttctttaagagattataagaagaaacagatctcatgcataaatttaataatttctattgtattaacataatatgtctcaagacaattttatcttctcaaataatgaatgttcagtaatattacaaaaataatgataatggccgggcgcggtggctcatgcctgtaatcccagcactttaggaggccgaggtgggcggatcacgaggtcaggagatccagactatcctggctaacacggtgaaacaccatctctactaaaaatacaaaaaattagccgggcgtggtggcaggcacctgtagtcccagctgctcgggaggctgaggcaggagaatggcgtgaacccgggaggcagagcttgcagtgagctgagattgcgccactgcactccagcctgggcgacagagcgagactccatctcaaaaaataataataataataataataataatgataacaagaagagtatatgattcaacttattttatattgagacttggtacaatcaaatcaacacagtggtcaatttctaaatgccataaatattgctaccttgagtaaaaaagcaactctttgagattgagaaagaaaacaggtcatctgacattagttttctttaacagcatatatctaatataaggagctgaacaattatattttaaataatttaaattttactttttgtatttaaaaatttgatatattttgaatttgagagcgaaagacttatccaatgatatgtaaatttacttatgatctcataataacattcttcttgatttcagaaaaaggagttcataccatttatttattttttatttaattaattaatttattttttgagactgagtttcactcttgtcgcccagcctggagtgcagtggtgcgatctcggctcactgcaacctccgcctcccgagttcaagcgattctcctgcctcagcttcccgggtagctgggactacaggcgtgcaccaccatgcctggctaatttttgtatttttagtagagactgggtttctccacgttagccaagctggtctcaaattcctgacctcaggtgatccacccgcctcagcctcccaaagtgataggattacaggcgagagccactgtgcctggcccataccacttatttttaaatacagcaaaagagaaaagaaatggaaaacaaacaaacaaactgttgttaaaatgtaaagctacaaagaattttagaattctgtgataattcagtgaaggatagctctttaaataaggttaattaaattatttatttattttgaattcgagtttcactcttgttgcccaagctggagtgcaatggtgcaatctcggctcactgcaacctccgcctcctgggttcaagcgattctgctgcttcagccttctcagcagctgggattacaggcatgggccaccatgcccagctaattttgtatttttagtagagatggggtttcaccatattggtcaggctagtttcgaactcctgacctcaggtaattcgcccaccttagcctcccaaagtgttgggattacaggtgtgagccaccatgcccagcctaaattatttattaattcatagcttcattaatacaaataaaattaattactttctaagaagaaatctgttaataaacaaaaaacatgagattcgtgcttggttctaattcctcatatcattatctgatgacaggtctgggtgttgttggtgagtgtcttcagagatgcaacctagtgcctattggatgacaatgtactcagaaaaaacaaaacagactttcaaatcagtatacatcactagacacttattttgaataagacagagtactaagggctgcagtgggaacatacataataaagtcctagccctcaaggcaattattacgctttgattatttttaagtacattatgatataataatgataggttttagccgctcagaaacattctaagtgtacaaaccattgacacctcagtttctcacatggacctgtggtagcaagtctataattattcttcagaatgtcttaacaatgggaatgattgtaaagcattttatgctgtaacatggtaacatgattattattattattattatttttggagatggagtctcactctgtcgcccaggctggagtgtagtggcatgatctcggctcactgcaacctctgcctcccgggttcaagcaattatcctgcctcagtctcccgagtagctgggaccacaggcacatgctgccatgcccagctaatttttttttttttttttgtattttagtagagacagggtttcactctgttgcccaggctagtctcgaactcctgggctcaggcactctgcccgcctcggcctctcaaagtgctagaattacaggcgtgagccgttgcgcccggcctgtaacatgttttattctgccataatatctacttatatatttatttctctttctaattgtgtctaactagagtcattggtaacaggcactcactcagaaggccctgacatgccccaaaacaagtcatctattctgccaatgtttctgatgtgttatctagatattactttccgtatggcttgaatgttgcttctgatctatatgttattccttacaaggcaacttcacataataaaataagtaataaatgcaaattaaatttaataagtaggaaatctctggcggtaaggtactggatgtatgtatctttataccacaattggttgcattcattcttaataaactaattttggtgatgacctaaatgaaggaaagaaagataaaaacatgcaaacgatgatattttatttttttggcattacatcatttattttggaaacctccttccttgtctctgctactcataagagtagcaatgactcttgctgtgttttggattcaactgataaagttgccttagatgttccttttgtctgagggacaattttgatggtagaggatgtgagtgagttgctttgcccccatacgttaactcccctaagctgccggctcatgtttgattttattggtgacattgtcatgggccatggtaggcacttcagcatctttaagactgcagctgccctccctaaggtatttgtgttgcttactgtgcattctacgtctccacttggcacatcgcccacaatggcccattcatcattggtatattttaaatttattatccacttttctccagagatagcatccagagttgacatctaaaataccctgtggaaataattattttcataaaacagatgggtggtagagaccaaaatttcatgttaagtttctcagtaagcatccgtcagctggaaggcaactggagggaattcggaaccaggattctctgagtttctgaacagtgtgtcactcctgaatttttagtaaaattaattaatttttccctttcttagggaggtaagacatttccgagatgtcaataagaggattatatggttgatctctctgcatcagatattagagatttgatgattaggataatgttctccaaataactgagacaacccttaagcattatgagtaattaaaaaattctggtcttaccccaggtgaagtatagtagtaaatagtaaccgtgaatcctgatcatttggcagaccaaagtgaaaaactaagtagttgaaaaacttaaatctcttttgaataagaaataattccatcttaatttctttctggcctcttctcctttgagccaataacaaaaatttaaaaattgcaaaagaatctatagcaagaaattttaaaaagagagaggaaaggaaatatgctatgatagtggtggaccatgaggatcattgggaaattgctaagcagtgagaattaaagtcctaatgtgcataatggcaaaatgaggagagactggaaaaatgaaaaagcgagtgtgtacaggtgtttaattcacatacctatgaaaatctaaatgaagaacctgtgtcttcagtgtgtgtgtgtgtgtgtgtgtgtgtgttgatggtgacaaggattcttattccaaagaggttttctatctctccctaagtgccaactagtatggtgaggagcatgttagatctgattccaggagactggtaggtaatacagttaaagttgtgcttgtatggctttgacaaatcacttaacctttggcttctttatctacaaagtgaaaggttggattggatttgaaaatattgctatgctcttcattattttatacatctatcaaaagtgctctctggctgtggatttattaaattctttccataccaaatgatgcctatttattcaaacattaggaatcttgaaatagtttctatttttatattatcactgatcaaatgtaaaacagaagtccttgttattagatgaaaccttccttttagaatagaaagttcacagttcagtactgatcaattaaattgcatagttttctatgttttcactgagaaataacaaagattcaggaattggatcatgggtaaatattgtgaaatagatgaaaaaagtagcatgtaagtgccttaatgtttgtattgaaatgcccaaaataaagcattatattttctcacac[147 bp omitted]tattcattctctttctgtcattcctaccactccctgcaacgtacctgacacagatatcttagttcctttgcaaccttaattttagcccctctgcatcactggtggttgaggaaaaagtggacgcacaagtattgccaaactctagccaccattttcattttctttcttacattaaggaaaatgagggctgtatctattggaacccagggaggggagctgagagttgaaaagtgaaactgataaggatccagatttctactttatggttcaaatcaagttctcgaagccatccagccctttgaaaaccactgctaattaaagcagtgtctgctgataatgtaagtctgagactcactgtttgaatggatcttttgatatagctctgtgtgatggcgaataacagaaaggagatagatggattgcaggctttaaccgagctgtgctttcacagtgacatatatagcatactgtacgtgtggcgaaatattttctaggttctcattgtgagaattacaattatatatctagttgttctgtctcaagtacagctcccctaagggaatgacaaatagactgtggtattagtgatggaattgtattagagaatcatttgctttattttgctacatgaccttcatgaaaataaggagatgatttttaaaaaaatggttagaggatgtttgtagttcaattgctggtcttttgttattatttataacctaaaaatttctcaagggtccttttattaattttcttctcagttaatgggtattttcttgcatgggtagcttctgggaagacacccccctccacccccagcttggtcttcaaaataggcctagtacccttatagctgtcagagcgtagcaatttagagaccacctcgtgattttaaataccaacttgatgacattcgtcttaggagcagttgagagagctcataggattgctttcctgaacctgttataatttctctggggatatcatgtcatagtgggaggctgaaggaagaaaatgttagcataaattaatacacttatcacagagagtggggcattaacttagaatgtgaaggaaatatatgggaaataaaaccttttttcatccctattttgtttttccacttgaactcagctttcagttttggaattctggcatgttttgttgtgccacttgcttctgcttattcattcattcagcccagcaatcctttgcctacagcttgtagacctcctgcctgctggtccatctttgcatggggtggggaaggaaaagaaagagctggttttagaggctttcaatgaatctccttcttttcagcccttctttacagtcatgcctttgcctttgtggaatttgtcttccttgactctggcaccctccagggtttgcaaagtcatttatactaaggtctcttcttggcagctcatcttcatctggctgtctacctctatctccttttcatcttccagaaatttgcaatgtgctttttcacactgatttttctctttgccaggtctcttatttttgtgggtttatggtttaacattcctttactctcattttaatagtgtccagagaagaatataaaatgaacatgtgtgttccattagtgatcttgacccagaagcccctcaatttattttaaaagcttgctctcaatgctgtatttgtgttcgaaaatcatttcaataaatgatgggtgctatggaacatctttattctttttttgagggatgctacggtctggatgtgtcctccaacattcagatgttggaatttaataatcaactgatagtatgaagaggtggggcttttaagaggtgatgaagctgtgaggttggagtcctagtggatgagagtagtgcccttctagcagggcttgagggaatgagttcattctcttctgctcttctgccatgtgaggacacagtgttcctcccttttttgccttctgtcccttccaccatgtgaggatgcctagaagacaccatcaatgagaaatgagcctttaccagacacagaacctgctggcaccctgatcttgggcttcccggagtatatttctgttcttcataaattatccagtctcagatattttgttatagcggcaaaaatggaccaagactaaagattcaaatacattttaaacccagcaactttttttttctgttcagggtatcatactatatactatgtgaaatcattgcataagttatgttatttggcatgccagaaattttgatcatataaccaaaattatgtcatttctaaaagcttgaaaatttcagcttgtataacgggttataatctttactctttttcttagcataagaaaatcatttgccatagtggttttggtggttaaatgctgggatgcggtggtaagaatcaaatctgggctcctatgtgcttaacctaaatgagccaccattttctcatgtgtataatgggctatgacttgcctcacagagctgtcagatgaactaaatgtaagcactcaataagtggtatggtagccattagagaaatgagaatcacagtggtatacaaattacttcttgtgtctggagaaaccctggacttgtgattggggattgttttcttcagaaaaaaaccacatatgatttcaagcaactatcagaccagagacaatgcttactttcccactaggaagtgtgccttgaaaattttattaacttttaattgtatttttgttctgtgaagtgacaaagtttcaaaaacaagaatgtttaaaagatcctgcctattctgaaagatgttatgtcctaatctcagtggagaataattatattacaagaatgcaagcattacatagaggtaaaaataaatgctaaattgtgaggtacaaataattaggactatacctaatatgtgcttcatagaattaatttaaaaatccccaaagctgctagatttgtcaagttgggacatttgtaggaggtaaagaatataggtaagaagaaggagagttagggaaggagtcctggtacatgcgtgtgtgcacagaatgttcaaaagaagaacataagtacacgattgacagcacaatctgattcaatacattttaaacacagcaactatttttttttttctgttcagggtatcatactatatgcctcttaccttcatctggcatttttattccttgcacgtaagatattttcctaggaaagcaacacttccaataattaattaatttttttacttaagaatttttctaaaaaatatgcagtctcatctgcagacaggactataaattgctaccatttttctggagtataatatgtatggagaccttaattatttacctacctacaggccagataattttactccagacatttatatgaagcaaagaaatatacaaatatttagtttaatgatgtttattgcaatattgtttataaaagtaaaaatagtggacacagtaggggaattagttactaatctatgataacatgatacaaggaaatgtaaaggccttggtatagtggacagtattttccttttttccacaaaagtacagatgttatgcaaagtggaatgcttcttttatagatcatgcatgttgacagaacattaacatgtaaatcagtgaatatatttgtgcagccctattagccaaaccctagaatcttaacaacccaaataaaggcaacaatattatgggttaaactgtatttttcagttttactaagatttcaaatagctcagagtaatttttttttgtaaaaaaattgtactgtaacctcacatttttattatcttgctgactcaatgagattgtgtcagagaggaatgcaaggccatctgattttggtgctttactccttatccgagagcagatttatggaagccttgagtgcttacatccttctgcctgtaccaccttggctaccagcagactgcaggctcctcaaggtcaggaactctatgttcttggcaccttgtaagcctgatacgtggaaagtggtactcaaaccttgtttgaactgtctaggatgggttttacatgtctgagtgtgtgtgcgtgtgtgtgcacatgtgtgtgcatgcgctttatccgatttgttatgacggggatcccaagctaagtctaaattaaatttaccttgatattcagccacatctggagagctggtggtttggcactttcacagaccgttttcaagagacaatgaagagcttttcaggaagggacttgtcctgagggaagagacagatgagatatggtttttgttcatggaaaatgagagaccctgagcatggccgactgcctccaccttctgattgacctccaacttaacctcatcagtcatgctgagtaaaaaattttccatgaaatctttgtgtgatatacaaagcactaaatgctggcatgcttgttgctggcagattaccccctatagtgtggccatcagtaggcagctatggcattggtggcagaattgcagattttgtcattggaaaagcatcaccagagtgtgacaggaggagaatggcagtctcccgtcacttagccaaagtgctagttcacagagcaatgacagaattatggagactatggaactttctgagagtaggtgaaagtggaacaggagagttctatttttttcatgctatgtttgatgattaatttggcctcattttttgcctcaagaataacccagtaaaactcaatgagaggttatatttacaattcccttgtgaaaattaagtaatataaaaatggtttttagtatctattagatattttcagatatcatgaaattctttaccactggcagttatgattacagagatacttatgaaatcaataaaaattgggttatcctttgaaaattttcatatttattttgaaggaatttatattttgcttacatttttattcttattctaccaaaatcctgtgctgaggggtagcttctcctccatcacagcctgcaataacaaccatacacaataatgatgaggtagggcagagtacttctgaatatctggaacttttgtgcatttggtttgggtttgtttttataatactcaagaagtaaaagggattttatttattttatttttttgagacagtcttactctgtcgcccaggctggagtgcagtggtgcaattttggcccactgcaacccctgcctcttgggtttaagagatcctcctgcctcagcctcctgagtagctgggactagaggtgtgcaccatcatgcctggccaatttttgtatttttagtagagacagggttttgccatgttggctaggctggtcttcaactcctggcctcaagtgatttacccaccttggcctcccaaagagggatcattttttggtttcccatgtgtttaaagttgtaggtacaattttagattggtatctatcaataattgtgagaaggaataagctgtctgtcattctgaaaagaagcatgctgccatttttcttattactcagattgtattgatgtcttaccattaataataggacaactattgatgttttgatccagtagtctaaatatttcaggacattacttttacaaaacatctttaattaaattttttaatgtaacatcagaattgaaaaccaaatccctgttgattgatagtttaagataaactgagtaatcttgcctgatgatgatcatgatatagataataggcagaacacgttccatgttctaagaaataggtaaagtactttgcgatcatcaccacgaatcttggaggtagttgctattttcccattttgcagttggaggaactaatttttttttttttttttgagatggagtctcgctctgttgcccaggttggagtgcaatggcgcagtctcagctcactgcaacctccgcctcccgggttcaagtgattctcttgcctcagcctccagagtagctgggaatacaggcgtgtgccatcttgcttggctaatttttgtatttttagtagagacaggatttcacaatgttggacaggctggtcttgaactcctggcttcgtaatccacccgccttggtctcctaaagtgctgggattacaggtgtgagccaccacgcccgggtggaactaagtcttaagtcagtggcccaggacacatagcaagccagtggaagagttggcctcaggacagcctgaatccaggtctactctcctaaccctcacctatatccctctcatgacaggcccagaacctcagctccccatcacccctttatgatgatttcctattctcctcagaggaaatacatactttgtatttaccccaatgtgtaataaacaaatagtcaaagatgacatttacctcatgaggtcattattattcttcattcttgaaaaattggactaatgtttaggcatcatggaatggaataaaatcttactactatagactctaagtaagtaatagtactttaacattcttctaaatttacctaacatcttgttaataacattacttaacaacttgttaaaacaatttctctttaaagagggaaatatatttggattacacgttaaaatgtcactagaaatgtaattagataggtgataacttttatatcacatatacaaagctgtcttgccaaaattttgactactttttggggacctactttgttggtcaactattattgtcttgtcttgattgcaaacgaaaaacgaaccaaaaagaaaatatctaacataatttctcttcaattaatgttaaataattctttcagatttctatgttagtgtgtaaacctaggatacatgaaacccctgataatcactaatctgctcttcatctatattcatcaacaatgtcattagcaaatataattatattatttcactaacactaaataaatgaaattttgcagtgcagtcatgtgctgtatgatgatgttttggtcaatgatgaactgcatatatgatggtggtcatataagattataatggagctgacaaattcctgttgcctagtggcatcttaatgatcctgctcctcctgcgtaggcctaagctaatgtgtgtgtttttcacttagtttataataaaagcatttaaaaagttaaaaaacattaaaaatagaaaaaagcttatagactaaggataagaagaaaatactttttgtatagctgtacaatgtatctgttttaagctaagtattattacaaaagtcaaaaagttaaaaaaatgtaaaaagtacataaagtaaaaaaattaaagtaagctaagattaatttattattgaagaaaaaatatttttatgtatttagtgtagcttaagtgcacagtgtttataaagtctacagtagtgtagagtaatgtcctaggccatcatcctcattcttcactcactcactgacccacccagagcaacttccagtccggtaagctctattcatggtaaatgccctatacaggtgtgccattttttatcttttatactatatttttactgtaccttttctatgtttagatacacaaatatataccattgtgttacagttgcctatagtattcagtacagttacatgttgtacaggtttgtagcctaggagaaacagtctataccatatagcccagatatggccgtatactataacctactgctaggtgtggtagattataccatctcagtttgtgtaagtttactccatgaggtttacacaatgacaaaattgccaaggactcatttcttagaatgaatctctgtcattaagcgatgcctgactgtatacaagcatttttggctttttttgacttagcatcacttccttaaagttagtccaagttgtgaggatccacagtttctttttgtttctgagtattattccatgttatagctccagctatatcacagtttaatgatttgtccagtgaggaatatttgtgtggtttccaatgtttagctattataaataaagctggcacaaatatttgtgtatatatttctgtgtaaaaatgggttttcatttctctgggataaatgctaaaagtgtaactgctgagacatatggtaagtccatttttttttagttttaaagggaattgtcaaattatttttctgagtagctgtaccattttacattcctatcagcaatgtatgagtgtcacagtttctctatgtcctcaccagcatttggtattattattttttgttttagctattttaataggtgtgtggtggtatcttatcatggttttaatttatattcccttgattgttagggtgttgaacatcttttcatgtacttatttgccatatgtatatcttttttggtgaagtgtctgttcagatcttttgcctggtttttaattggggtttttgttttcttcttgttaagttttaaaagttttttaaaaaatatattctagatgcatgttctttgttggatatgtggttcgcaaatattttctaccaggttgtagcatgtctttcatcctcttaacagaatattttgcagagcaaagattttaatttctcagaggtccagtttaccattttttttcttttacagatcatgcttttggtatcaagtataagaactcttcactgagtcctaggtcttgaagatattctcctaatttttaaagctttattgcttgtcattgtatatttaagtctatgatccagaatcctcatctatgaaatgaagataataatactacccatgtcaaagggttattattagaaataacatgtgcaaaagtcttgacagtttattttcctgtgattttagttagtcaccactgtttttttttttttttttaaatctccttaagctcataagcaacttcagcaaagtctcaggatacaaaatcaatgtgcaaaaatcacaagcattcctatacaccaataacagacaaatagagagccaaatcatgagtgaactcccagtcaccagtgtattaatgggaaaaatattgggctaattgacttgtatttgtagagtagtctaagctgctgttataagtttacccaaatatattgataacttagcagaaaactattgttctttcacacaatagctctggaatggctgttcccaaaaagatcagcaataatgagtgttaatgagaatcaaaaaagaccaacgataagtgttgtagacaatgtggcaaaaggaaacttttgtacatttctggtgggaatatgaattggtacaatcaatatgaaaaacaatatggaggttcctaaaaaaatgaaaaatagaactactatatgacccagcaatcccacttctgggtatatatccaaaggaaatgaaatcagtaggtcaaagagatacctgcattccatgttcattgtgacattattcacaatagccaagatatggaaggttccaggctggctgtggcatgggaaatgagagaagttgggtctctgatatgtttttctgagtaactaccaagtggaagttaatacttcataactggggtgttgggattaggggagaaacacatataccttcttgggaacttgtggacaatggcaggacttaaaaatattcttgcagtattaccctttgagaaatacagtagatgtttgtgatatttatgaatcttgtccttggtccacacatgggactatgactagtcagagtttgggcagtcagaaggggtctctaaccatttgtattgcttttttacatgtcgtgctgattttatcttctttggtggatacttctatgtaaactctgtgaaggattggtgacaatgcttacagtgtctctacaaccctaagaagacaggggtacatcgtacagctgcagctctgcatgcatcaattcacatatttggtatctgaactcttgctaatcttctatggctttcctggactaactctgtaatccagcacaatcaaataagtccatatatgggattgcttctcaaaggatgtttataagacaccaaaactgagtagatgcttgtgtgtcagtgtgtatgtgtgttagtgtgtgtgtgtgatagagagggagaaagagagagagagacagggagagagaatgagatctaaagcctgtgaaagaggcttaatagatgtctccaaacagtaacactgttctccatcatggttttcagtaaaggcattgctgttgtgaaatgatgtctaaggggaggagtagtctgctagtctttgggaggtgtttgtaaatttgcagaagtttatcagatttgttgagaaagcaaaggtcagcagcctagggttacattttgacaggagaatgattattctagaaaagagatacatgagtcctcacaggagaggatagtgagtaatggtaaaaacaaagttaccagtgctgagtgcttaaggcatcatattggattcaaacaattaattccagttctgatgccctccagttgtggggttgtctttggcaatttctcctcagtgaacctgaaatttgttagtgtattgtaatctcagtattgttaataatatctactgatgatatttttgtgatttaatatgagattaaataacaaaatcgtctagatcaatatatatgcagttcagaaaatatttattcacacctcacctcactccttaatgcactcagtgttttaccacgggtaggatcaggtcctaacatgtggtatgagtacccataaaaagatcctgagtaaggggacatactagactattcagtatgccctctgataactaatccatcagtagatatttgttctttgatatgactttggcataaattaaggttgttagtttcacagtgaggtttccccttatgtttgatcagaaggcctgaaacttcttgaaaagagatttttaagactgggaaagcaaatctcagaagcaccttgttcattcctgaggttctctaggaggctgatgtcaaaaatggtttggattagtgtttgtctgtgacgaggttttactcactcgagtaaatgaggagaataagaacaattgtaatttctttaatagaataatttatgtttattcaatttattaaaaactctgttctttataagaataattgtaatttctttactagaataatttatgtttattcaatttattaaaagctctgttcttttgagattatatcattcctcatttttttggctttaagattttttctttatatttatgaagttttgatgattccttaaaaaacaattactgatccttgaagtccaaatgtctagaaaaccattctttctgacactttgctctctgctttcagatgtccttaaaaagtctcctgaacttttgttttcattaccaatctctaatttcttagcatgtattatatatcgctttcttttgtttctttttggaatctaattttcttatccagcaaacaaatcagtttttattacataaaataactcaaattaaaattgttttctattttatcacatgtgtaagtaaccacatttacttttcatataacgaaattagattgaaaactagcaaaaattttgagcacattctcgccaaagacatcatataatttaatagacgtagagtttactattgagaaatttttctctggttgaactgggagacacataatctccacagaaatctatataaccaatttaagtaactttttaagattgccatccttttgatttttgaacaataaaagttacactaatgaaaggtatgagcaaaactatacaagatctttggaaattggaatttctagtaattttatgtcatgttttataaaaagtttaagtgatttaagtttgactttcatcttggtttcctgggtaatgtgctagagaaaatggaaatgtgtgatgacattttatgaactttaaatcattcttctctgaaaatcactctgggagttgccatttaaaaacaaacacaaataaaataactgaagaggaataagtatgttggattaaaatgggtgaatgctactgaaatgtattaatggtcaaggctgatctcaaagccagaactctcctgtctttcaaaatggaaaacaccatgcatctttggcatagtgcaaatgtgggcaattgtgtctctcagatttaaagatggaatgaatacacagatcagaaatttttgatatggtgctcatctgtgaatctggtttcaaatgagcacatgagagctagcctcatgtgtaaaactgcacaatgttggtttattctctgacctaaacaagcaagatatgaaaactaagagcagtgaagtttaagttttccctaagatcacttagtgtcttttgatttttttaatctgtaaaatgaagttgaaaagaatagaggtaatgtaacatataaagcaagcatcatctatgttgatttctttgcatgttttctgtgttgtactgagttgtaggctgaaatgttcagccacgctaaaatgttaaacattttagatcaataccaaataataactgcagaattctccacctacagagagctagagaatttaaaaatcagaaagtgtcttctcagtagacagtgactatggctgtgcaaacccaatgcatttggcctgaaaaaggatttaagagcacaggtacttgttaacaggacatatttttgtgttgaacattgtagaattatagaggttgagatattgtctctcatcatttttgagcacttaatgtgcatcagactatttaccttcttcattagtaattcattaatctattaaaatatcctttgagcatctaccatgtgtcagatattattttaggtactgaggatacagtagatcacagtcttcatgggaccagcattaaggtggtggatggtgagaggactgatgataacccattcaacaaattaataaacaaggtaatttcagttaacaataaatagaaaaagaaaataaaacaatgaaagagtagaaattttttgaggtaagagagtaaatggtgactgctcaagagtcttcagaatggctagtattaaaagtcaaaaataacagatgttggcaaggctacagaaaaaagggaacacttacacagtgttgatgggaatgtaaattagttcaaccactgtggaaagcagcttggagatttctccaaacttaaaacagaactaccttttgacccagcaatcccattactgggtttaaatgcaaaggaaaatagattgctctaccaaaaagacatatgcactcatacattcatcacagcactatttcataataacaaatacatagaatcaacctaggtgcctatcagtggtggattagagagagcaaatgtagtacatacatgccatggaatactatgcagccataaaaaagatagaaatcatgtcctttgcagcaacatggatggagctggaggccattatcctaatagaattaatgaagaaacagaaaaccaaatactgcatgttctcactcataagtgggaaataaagaacaggtacacatggacataaagacaggaataataagcagtggggactactagaggtgggagagaggaagaaggtcaagggctgaaaaactacctgttgtgtaataagctcactacgtgggtgaggggatcaatcataccccaaacctcagcatcacaaaatgtacccatgtaacaaacctgcatatacaccacctgaagctacgatgaaagctgaaattaaaaacaaaaaatctgtcatggagacaaaatatgaaatttcaaactgcccttttttagttatatctttccctacccccaactcctggcaaccactgatttgttctccaacactatggttatatctttttgggaatgttataacaatattgctccatgcctcaatagactaatactttgtttctgtattattgagtagtattgcattgtatcggtgttccacagtttgtttaaacattcacccactgaagaacatttaaattgttcatgatttttggcagttaataaatgaagctgttatatagtttagtaggtatagattttgtgtgaacataagccttccatttccagggtaaataactaggagaggactttctgagtcatataagtatatgattaactttacagaaaactgccaaactgtttttccagggtggccaaaatattttgtatttccactagcaaagtgtgtgtgagttccagttggtctacatctctacccacacttgatattttcaatattttttattatagtcatcctaataggcacgtgctggcatctcatcatggcttgaacttgcatccctcgtggccaataatgttgagcatcttttcatgtgcagactttccatttgtatatcattgcttaagtacctattcaaggatttttgtcattggcaaagtattttgctgtcgattagtttaggccagtgtttttttcatcagcccacaattggcattttggctggtacaattcctgattatataggctgttctataccttgtagctaatttagcttcccggacctcaggcaccaaatgctcattatgacaaccaaaaatgtcctcatatatgttcacattccactgggaggatggtaccacttagtgagaaccactagcttagaagttagcatttttccctgttgctgggatcaggtcaatttttcctaattcatatagggtttgtgggggtagggtggatcccttaacaatatcaggttcttctacataagaaaggaataaatcttaatccagaaaccagcagttccccaagagttttactcaacttctttcccaacagcctatgcaatttttggcttttactcacagcctttctgtgaataaaactgaaaagactctccctagatgtaataaatgttgtctggactaagttttcctattacctaaagcatctcttggaattttcactaggacaggtagaagagggatgtagcagttcctatctgctttcttcttctcctgctctacattctcctcctcctcatcctcctcttccttctctctccctccacctttttcttctttgattttaatagatatatttacagatttataactgagttttcagcttgtttccctagcaactgattttagggtaccaaacatatttttttaaagtcatgattctatcacaacagaaggtatatcaccagaaagtcacagtctagttaggataaaatgtgaaattatgtaagaacatttagaaaacatctgtgaagcagtattctgtgacatgaactaagcatgttgaggaaacaaaggacagaggagttgaagacagagtcttagagtgaaagggcagcagatctggagtcataagactatcatcaccagggacaatatacctaatctctccctcagtttccacatgtgtaaattaggaataaagttcctccttaataaagctaacatcagttgagtaacgtatgtcacaatttcttgaaatttggaaatgtaggaatctattcattactactgcaaccaccatcattatcatcatcgtcacttagtaatgaaatttttgctgacatgggaggtagggaaggaaccacgagtagtaaaggaaacataaatataaagggagataagtgacatctgggaagatttagacacagttgtgtctgtttaggataaactgtaggcaaaagtctcaagactctcagagatttactattcattcactttgagatttctgccagcacagcacctcatgacactcctacaaacatcctcgaaccttctttagacccagtgctgctcccttttagcagttaagtcagaggagtgggaacaagttctcccaaagaacttgggtatagcctgaggccgtcttctcccatctgggacttcttagataatgtcttcattttatatcaacaatgagtgtgaatactgtgctttattccatgatatgtttctatttgttttaaagtaaaaatgatgttttaaatgaataagagctgcttacctattccccttgtggctagttaagatgtaatgaattgaaatgatccatcttgaaaggctgacctgaaacaaaggagctaacacagcatgtcatctatgtaatttctcttggtgcttggatttatcctacatgttttcgttcttgccaccctcaaccctctctaaagaaagctgctccacccacagcctgatgactttcgtgttttgtgccaagtatgttctctacccacttctgtgtaaagctaactgagccagaggaatcagcctgctcagaattaacactgtgaattatgtctggtacagagataggatggggcttctcttataattagggaataggatgccaattagtaacgggagttggcatgtgaaagaagttgggagtgacatgggggaaacaaatcttgatccagtagtggaagcccacagtcttaactaatttaagggaatgtcaggtgaccaaaatgctgaaaagacattacagaaaatatgtgtcatggtgacagtgtgtggaatggatgagaatgaggagaaatcagggagcgagatagaggttttctcagctcaaaagtgtgaggtgaaggttgactggagtggggtgttggctgtggaaccaagacgagtcagatctataggaagctgtggtttgctactctatcttaaagtgtaccagaaatgatgactttagtgcttctttattcctttgcaaatagaatacaacccaaatttctcagactttttaaaaagaacacttatcattttgttgctggtgcagactcagtgattcatagcaaacacagtaaacagtcgggtcatctaagtatttagtccttaaatttgacaaatgtgccaattaccatggtctttggtttctggttcaagaattaaaagccataatcaattttaaaagctgccacagttctttaagagtgaatggaaacagaatgtcaagcagctgtcctccactgatgtgccttgagttgccatctctaagcatgatggattggatgctatttgtgtgatgtggcaccacattcttttcctgtataaatccgattgctgtggcccaaatggggcactctgtgtccaagatctctcaatactacttaaaacatactcttgaggtttttgtctttttgtttttgaaataatgcaatgtttaggaaatatttcaagcacataggcccttgtgtattgttgttcaaacacataggtaggtcaaacacatggctgcttttgccaatttttagatatttgaaagcaatctattccagccgtggtagacgtttttttttttttcttcaacgtcaccttatttcaaaagaagaccttaaggtttactgtaaaaccattacctaatttacttccactatgaagactttaggtgggtgttaggtcggtgaaattaatgccacatatattggaaagaaatagcaagggccgatcaatggaaaggacagagggaactaagagctcttgcttgaaaattttatctgaaggtttttctctagcactgatgaaacatatcagtttgctttcaatttgcaataggcagaaccacagtacaatttcatattgaagtttaatatttgatatgtagaaaattctagatttttatttaaaaatgttatatttactttaatcatagtaatttaaaacttggcttcaaattgttgttatgatatctcttccttcagtagaaattcatgaggaatgggcccggcacggtagctcatgcctgaaatcccagcacttagggaggccgaggtgggcagttcacttgaggtgaggggtttgagaacagcctggccaacatgacgaaacctatctctactaaaaatacaaaaattacccaggcatggtggcgggcacctgtaatcccagctactcaggaggctgaggcaggataatcacttgaacccgggaggtgaagattgcagtgagccgaaatccgccattgccctccagcctgggcggcagagtgagactccttttcaaaaaaaaaaaaaaattcatgaggaatggtgatgcaccatgcatgatcaaattttgaaagttttacccttctcaatgaacatggtagtggcaaaaatgtaaatttgattttcttgtgagtcgtcgtgacttttatgatgctggtagacttgtcatgaatgttaagtgaataacagcatattcagcagagaccttgatatggtttggatttgtgtctcctcttgaatctcatgttgaattttaatccccagtgttggaagagggacctggtgggaggtgactggatcatgggcgtggattttccccttgctgttcttgtgatattgagttctcacgagatctagttgtccaaaaatgtgtagcacctcccactttacgctcttcctacttctctggccgtgcaaaacgtaactccttcctcttcaccttgtgccatgattgtaagtttcctgaggcctccccagctgtttcctgtacaacctgtggaactgtgagccaattaaacatcttttctttataaattacccagtctcaggtagttatttatagcagtgcaagaacgagaactgtgaaccaatttaacttattttctttataaatttcagtttcaggaggtttttacagcagtgcgagaatggactaatacagacctctagttttacatttatttaaggttagttgttggtaccagcctctctctaggtaagattattcgtggggaagataatattttcattctccccttcctttgatcagcccagccactggtggctatatttccctgagttccagtgtcttcagaaacatgtatctcttttcccccaagagtccattaaaataccctttccataaatgttgaataacctaacttatattaactttaaatttgaccaataaaggctatccttaaagggatggacattactttttttttttttggactgttatttctaatgataagaaaactcattttttatttttataatttaatacattgtcattatagaatatatagaaaataaagttaaaagaaaaatgttcccacaatttcatctctctaagacttcttctactactgttgatatatattcttcatataaagaaatggaactatcctgtgtgcaagtttcaaactgtatcttttcttaatgtatgatggtattttctacctttaaacatgctaataagccatatttaatatctccatggttttgtattgcacaactgttccctacatcatttaaataatacactattatttgacattaagactgtgttaattatttcactattataaattgtcagaattaacattcttttgttgagttcttcaaatactatcatgatcacagaagaataaaccctggctgtgatacctcattgccaatgagccagggacagagaaatttcttgtcccttgaaattgtatctagtcattcagaaatttttctgcttgctgctgaggatagtcttgattgtcagaccttgcaaattaactaaaattgagctaatttggcactcactgagggagaaaagtaatagcaaatggcagaaagtttggaggtgctttatattaggttgaaaacaaaaaagtaaattatctgacctatatacaacccaaataactctaaatttggaaatacagtaatgaaacagagttcactgcacttgagattagctgcagagcctttcacataaaagttattcatgaccaagatattaatgatcctcgaatgatttctttgaagctgtaattcttggtcagcgtcaaagttacgtggtagatggatcagaaactttgtttgaggcaggtgctgggaaattgaacaaaagacatattcagtgaatggaaaaaagatgggtgttacagaaacaaaatttgtgggttttgacacttgattggctactaagagagagaggaagatagagggatgagtgatacaaacctggaggtaagaggatgattctcccatttgttgtggaggagcaagttgtatggatatgggacaaattctgttgcaggcacttagactgagcttctgccaatttaatttattcccagcagggaactggaaatgcaaaattggagctagaacagtaagtgcataaaattaataattttaactaataaagagaataagtaccgctttagaaaaagaatggctacatttgaaggttgaagcaaaaaactatgatggcagagagtaagcaggcagggaagtaggagaatgcagagtcaagcggaacccaggaagaatggaactttggggacagaagaggattgagacctgctgacctatcgacgtgatgtcactgttgaacttcaactaagcagttccgcatgactgtgggtgtagaagccagataataatgaaaactaatatcaacaagaagaggctagaatgtgttaagagtttactctgtgacagttactgtgctatgcacatagattgcattaaatcatttaatccttacagcaatggccatgaggcagagattttcattgtcccccttttcaatagtctacagagatgaaatattttttccaagatcatacaatgtactatatgtagggcacaaactcaggactgtgctcttaacttctctgctggtttaattagctatacatgttccaaggaattatatagtaagtggttgatgagagagggggagcagtgcataggacccctctttgaggaagcttagccctgtagtaaagaagaccatgagagtgtcctgagaagggaggtggtactgtaggagaggtatttctagatttaggcattgagagaagagctgttcccaatgggatggtgatgtctgtcagtaggtggctgaagtacaatggaaataaaagccatttttgctgaaaagatcaggttctactttgaggctagggttctggaaaggttatcagcattcatagtaaagggatagagaaaggaatgagtctcatgaggagtaagatgctgaaatcattatggaaaatgggtgatggtcctgtagccaggcaatgacagatacagggctgggaagattcagtgcttggggagaatgtgcattttgagagagcagaggttattcagagatggcagagaacagtgattgcaaagggtattgggggttgaggggtgtttgggcatgcacccagtttacagtgggcatgtggtcatgaaggagcataactgcaactggcttcgatctactctattcgaaagatgtttatgggaaacaaagccattgagggaaggggcagccatcagttattggggaggagctaaaacgaatgttcaaggcataggttaaatatatgtttcccctgaagagcagagtggttccatagggcacagatgaaggctctggcctgagcctctggtgacattattatgtttgaagtatctgtgggtaggaggctgggaatggactggtgacaggttttagtgatggaaagtgtagaatggggaggagtcttgtattggctgagttttagataatatcccccttgctgaaatttctaagtaagagttgaatttttggtgtttgcaacctactcctcaaaattaggactcagtactcaaggctggtcttgagaagaagtcagagatagagagagttggtggcacacttgagataaaaatgctgatgtcctgggtcatctggctacttttagactttccttgaaagtctatgtagtaatgttacaaacaagatttgttttaaagaaagaataagacattaatgtcttaaatgtggatatacataaacctaacactgaaccagggctcttgaccttggctaatgaactagaatcctctgaggattttcagcaaatacctaaagcccacaaaagatcagtgtaaagctaatctctgtgggtggggccctgttatcaatatttaaacaatactcctcaggccttccaacatacagtaatggctgaaagcatctgctttatataaagaacagaaaagaagaagcatagctgcataatctttttgtaaatgtgaacctacttgcttgctcacacttctgctgggtcagtgctctagtgtcatgagtaagtcttggtgtcacttattgctggttcgttatgaagctgcagaaatactgacacaaatgctagattgatgctgatggtacttgttttacaatcaatagtactccttcatcacccacaaagataaatgttaggtgaaaggaagcaaattgggaaacaccctatttacttgtagtgagagggtcaggcataattaagatacagctttattatgtagagatgctttcttaccctacaagatgggctctgtatgctcagctaaacaccactacttacccccaatctccaattctaagtcttatctttaaagcattattcacaatatataaattgagctcttccataatttacatcttgcatataattaataatctaatgtaaattgtgttttcaatgaagtaatcattaaatagttttggaatgtcactgtgaagtaatatccaaaggaaattaaagagtttaatccctttctttgggttatctaaaaatatattgtgtaaaactttattatactaaagtgcaacattgtacgtactctggttgaaatgttggtgacagtttaataattgtctcagaattaaacaacaaatttaagtttgattacatgatttgatacattgcaaagtgggtagagagggtttttcacatgggagctcttgttacagaaaaaaagaacatccattcattgatttattcattttcttttaaagtaaacatctgaagctctagtgtctatttaaattcacttcccctcatgtaaaggattaagccttgtatatacctaagtatatacacatacatattatttttactttataaaagtaatacatatttctgtaataaaggcttaaagcacaaataatcaatggaaagaaaatgaaaacacatatagtattttttaccttaccatctgccaataaccatgactaatgccttagtatattatcttcttgctttatacaaacacatacatgtacatgtacagatatacacatttgcacaccatgaattcattctgcatatagtgtttagtactcttttttgggtcacagcacatttgaacattattgttctcattaaatattcttcacaatgttaatttgtctggatagtattttatggtttggatattatccttatttgacagtctgctgctagacatttagattgtttataatttgagtttttttgtttttgatttccatttttcctaatataatcattgtttgattgcatatctttatagctaaattcaacgtttttaatgatgaaacataaaatcgtggaagagaatgttgttttgccccagctggttaaaatagagaaatgagtgcagtttttgtattctggcaagctgtatgggcatcatggtattattcccctacactctgaggttttgagaattctgaaaggctattaaagatgggaagttcttctcctgatattcttcacctaacactaactatttttatacgcttatctttcacatgaactcacaggtccatctgtgtttacaaaacatactctgaactttctgtcctcatgctgtttactgcatctggaatgtctttgtcctacagacgtttccaatgcaggcttttgaaatccaacccaacaataaaactagctcaaggcactttttcaagaaggtctccccaagtccttcaggaggtatttgtttccatctcttttgtgtttcttgctccactttcccttctccccactctcaacctccttgttggacctcgagcagtctactagtataaatatttgtatattataaatatataagtattagtataaatataatatttgaagaactatcctgcagcaagtatgttttagtcatctttgttttgtttataatacattgtagagtgctttttgagtgcttagaatcaatgcattctttgaattaaattgtttaatttaatttaaatatgccacttcaaatattaattttttcttttatttttcctttcaatacaaaggcagggaatgggtagttgtaacatcagtggaaaactcaaatttactgattattactttaatgttgtctgaaaaatgtaccaaaacccaaacgtacaaaactcccaaactcagcctaaaggagactgctttttcctctttacctgtgtttgagactttcagtgtccctcccagaccttaattaatcctgatagtctctatattgtagacaattttaggggactatgacacataggaaaaagaaaatctgggattctgatcccagatgtgcaaataaagagcaatttgattgtgaggaacactttatcctctctgggtctcagtttctctagaaaatgagggaacaggaatggaagatcttgatggtcttatctaaccataaagtttataatttttgaagacacagtttttgggctatataaataaagtttagaacacttagtacggactggcattatggcaagcattttacatgtttccttttgttgtttgctggtaacaaatacaattcaaattgccttttaaaaatgggaatttattgcttggtataactggaagaccaagggtatatggacttcaggcagtgctgaattcagaagctaaaatgatgtaatcagtgtctgattttctccatcttactgctgctctgctttctctcttctgacttctctgtgttggcctcactcttagtcaggctcatggattatgatagaaaagataatggtaacagcgttaagctagaaaattatgggtgagaacgctgacttgcctagtttagatcacaggtgtagccctttgctcaattactgggtcccagagaagaaatatatgatcctcttaggctcagatgaacatctacctggatggctataggacaactatgataaattggaccaggaccaatggcatcaggaaagcacattaaactcctatgaaaatcatggcactcctagagcagaaggaaacttttaagttcgtctacctgttgttcaaccatctactgagaaagcctgaattgtttctgcaattctggtaaggaaaggaaaggtttagattatgtttaataacactgattttagagaattagcatttttgtttttagctaaagtttgaaaagacacaggtagagatctatttttcttttacacaaaataactgaaatggttcataattatccacataaaaatggacacacattgtcacaattgtttatatagtgtcctaacaatccctgagttataataattagttttagcacacattcaagaatgctcttctttcactgtttttttggagataaattataaggaaaaaattatactacttattgaaaaggggagagtgatagtccaagatagaaatatgagaaaacattgtgacaaattataaatataaaattctagaatgagggaataaattggagtgcagagctgaatctctattggtttctaaagtgaatctgaggtttatttcagaggataaaggaatagtggtgaatgaggtctcatattaatatgctggtctactttgaggtattgtaagagggagatatgtggattggggaaattgttggctcagtctgaaagtaaatgaataaaaaatatggtggtcatttcagagcattgttgactgctaagtgctttgtgcatcatcttctcacaaaagtgagcacttatattagccccattttataatgaaaggacctaagactaagagcagtgatagtgtgctgggaacacagaactagaaaatggcaatagcaggacttgatcctaggtattcctggctctgatacccataccttaagcaccactatgttttgtactgggttgaaccatgtggaattcccattttgtagttcaaaacagtcaaaatgtcagctatttcacaaggtaaaagaatatgctcagaaccataattttgggatgttaaagagatgatatttatatttttctacctttaaacttcatatgaaaatgaatagcatttatgatgtcttttctttcatggtttagagaaattatcttttttctcctacttctcattctgggaaaatgcaatataaagtttaaattaatagtcttacttacataggcagggacttgtgcaaaatctcattataaagttcaagtgacatgatattaatttcttgatttaccatagcaggtggttgtgaaattaaaatgaaagaaagtaatgccaaattgcagaatgctatcatgattactagctttgtgactgtgggcaagtaactgaacttaatttagtcatattaatctaatataccttgtagagttgttgtgcaaattaaattagaaaatgcatgtaaagagcttagcacagtgcctagctgaataaaatttccttgttacaatttttattttatttccagatttttaagtgtctatttgagaattgaatccaggtgggagattctgagatgtctgactgatacaagtgcactagtggctaatataataaataatgcaggaatgactttaaatgaagcatggacaagtactctcaggctgtttaaaccttggctctactatctaagcctgtggtgctgtttatgagcaaagcataattcagagtttagattttctttaatggaaaccatccaaatttgccatctgagccacaagggagaaatgtacctatgtgccactcactggtgctcaggaatgtggcatatgtacaagtttgcttttttttcacaaaaacaccaaagtggtgaaagttcttagcaacccattaaaaaggctctcttgctgaaagactccttttcttatcagcgctctcacaagaatttacatcccacactgagtcatgcagtaagtttagtgcttcccggcaagcagcttagagtcaagttctgcagctattcttagctgctccacaccctgtaatagatggaagacactgtatgaacttgcaaatgacacattgtaccgatgacaaacagggtggattgtgtcagattgagtttcgaagtctctactttctttcgtgtattaaggacagtggggaaaaaaaggcaaaaaaaaaaaaaaaaaatgacgggtctccttgagattcagtactgtatcggatatagcatcctgtaatggaatgtgaactgaaagcagaaacatacatttttgcaattcactgaattttcactctgttcctatccatattcagggctagattaaagatatcaaagcaataatagtcaatatttcacttgcaagatctcattgtgatcatgaataatatagaaatcatgctttgcttttgaatggtaagtagaacgttgcattatcatgtgcaagataacattttctctggcagcttcccgttaaagtcagtgtgcttgtataaagcatcttttctctaacgaggtaattgttcccaccctttcctacccattttctcaaggagccagacctctcctaacgcagaagtaattcacataagtatattagttacagtgcttatcacattgtttcatcactatcttttttttttttttgagacggagtctcgctctgtcgcccaggctggagtgcactggcttgatctcggctcactacaagctccgcctcctgggttcacgccattctcctgcctcagcctcccgagtagctgggactacaggcgcccgccaccacgcccagctatttttttgtatttttagtagagacggggtttcactgtgttagcaggatggtcttgatctcctgacctcgtgatccgcctgtctcggcctcccaaagtgttgggactactggcgtgagccaccgcacccggcctcatcactatcttttttatatgtctgtttcctgagtacactttttccttctatgtgtccccaatgtgtaacatgatcccgggcacacagcagggattatttatcaatataagcatacaaatatgtgtatatatattgaaaatgaggttatatcatatatgttttcataatgtggttttcaaaaatctaacagacttatggtagaaattttacatgctagtaaatgtagaaatctatattttcaaaatatcttattttatggaagtatcataaactatttacctagtcctctcttattgggcacatagttaattattcagaaaaaactacattgaagtgtgttttcattcagtccctgttcattcattaatttagtcaacaaatattagttgccttatatttttcaggcactgtttaaactctgggaatatcatggcaaatcaacatttgagtgaggggaaagagacaataaaataaacaaaaatataacaaacatggaacacataataaatatgattattaaaatatatattctatattcaaaggtgatcagtagcatggagaaaaattaaatggggaatattggaaggacatttataataaggtgatcagggactgccgagaaggtgacatttcagtaaagacctgaaggaggagtgcctgctaaactccttgagggcagagatcatgtctcttttgcttacccttatgtggcaattcctgctttcatgaagcttagaatctaaggtctaatttgatgtgggttatctgtgagttattaccaggtaaatggttgttgcactttacatatttatatatttttttaatattttaaaacttctctacgacaaccatatgccacttttaaattttaaaatgacatcttaattttaaaaatatttggttaaattattttgttagagtcatcatactgtggacatgtcatgtctacaagcatcctacccatcagctttgtttacgtgaattatttgaactaaaactcatccatcatgcacctaggtagtccttttcttgacctaagtgcatgactttgccttttcatctttcagttttggctctaagttgaccaagtttgaggaattgaaagatttcatgaaaagctgaaataggacacgctgtacagaggcttgaacgtgaaaggtcaagcagacctttgggagcaattcataaaggcttttgctaatctgttttagcttcccttcctcatttttgggaagatgttgctttctccctttgttggaggtcattctgctccctgtacctgtgatagattgctctatgaattgatgcactagggaatacttgcagaagtaaacagtaggagacccaggagtgagagacctcttctacttctgagagaatacttttatattttcgtgtcgtgtgtttttagttttctctgtgatactgaaaaatccccaatcttctatatgcagaaaaatgctaaaacccatctctagaagcttgccagcaagaatgcctttatttccacagctattatccacatcgatgtacaattcctagctctttttagtgaaacatttctcttatggagtgaagaagaaggtttaaaaagtattttcaattgaaggaagaaagaaaagaattttcttagtagttcataatattagtttaattcacttttggtatttgcatagaagttaaaatattccaaagcattttttacatctctaccatgatttgtacaatgttctaaggtagtagggttatttttgctttataaatgagaaaagtaagtcacagaaaagaaaagaaaattgcttaaaggcatagggttaacatttattgaatgcttacctttgtcagacatgttctaagcattttatatgtattcactcatttactcctcacaatagcccaggtgactttggtattacttctatcccagtttttcagatcaagagacaaagcactgagaaattaaatgacttgcccaaagacatgcacagctagttggcaccagagatggcatttatccacaaaactctggttctagcacacaacacataacaattccatatggctgctacactgggtagatgggaggttgggactataattatgcaatgtgaactttggaaggtttctaagttcagtagttacaactgcatacgactactgccccaggatacaaaaataaaccaaacttgtctcagaatattcttaactattacagtaaattcacaacaaactatcttgctagaaattttgttacattcttttgtctgtaagggttaataaacttataaaatgcttgcatatttgcattcagggggaatagtagttgctttttgttgtagcagaacctgcattcttagaaatgctgagaatatagaccttctcaaacttttctccttctgcagaaatctctttgcaacatccatgacaaatactaatcgatttctgctagatcacgtccagtcatggcaagtccactaatttttttaaggcagttttttccatttgagataactgattgttgggaattaattttctttttctttttaaacattggattaattttttttctgaatgtagtaaaatgttttgctttaagaattccaagatgcagtatgacatttctgccattaaatagagctcctgttttactgaagaaatgcaagagacctttacaaactgtttgagacagagaggcaaaaatagagactaaaggttcaacaaatgtattgatagtatttaacaggagaagaaaatctgacctgtaataatacaccatgttgacttgcatattttcttccactttacccctgaaactttaaacagaaagctaagttatagtagtcggactttctagaggtcaaattaggcaaataattttggatcacaggcttagaaaaatatactctgtattttgtgtagagacattatatgtgtgtgtatgtgtatattttagggggaatagaaaaaaaacatgtaggataactaattgggcaaatgaatggaaatgctgtgtttataattgggtctttacttccctttcaagtatcaaaattcagtttgataaataattattaatcatcttccaggtgtcagactttgtgttagatactggggttacagtggtaaaaataaagaggtgatctctgcattttggacattgcatgtggttgtgcatgtttactgccaaggacttgagtgggaactgaaatgcaggcagcattccacttgataagctgtgcactatggcacagggttgcatctgtctggagaaagggtagcctttatctaaccagcactgatgtgctctatggccttatggccatctgcctactttatgaagcttacattctaacaggaaaggcagtctttaaacaagtagctatgtgattagtgttataaaagggaggtaaacacagaccatttaattcaagtcaaaaggctaataaaatcctccttgagaaagtaacatttcatataagcaccaaataatttgactaggaattgaagccatgttgttctagatgagaagaaacagctctcttttccatacatcatacaaaaaattgttagtgacattggaccctcaaacaaatatcagatatcagatattggctcaaagacaattgttgtaattcacaattagttgggggtagaaaccaaatatctagaggaagatagagagagatagaaggaggaaaagaaggtaagagaaagatatgtggaaattgacttaccttctacttccactgtagtaaattcaagcttaaagctccgtagttgaacctgaatggttttaacaacagtatcaacaacaaaaaagtaaattctacaagtctataaggcagatatgctgtactatcatttagaaactgatatattggttgggcgtacattttcaaggcaaagagatagagggagagatttgaatcagtgtattcagagacttgtctaagggcctacctagcttgcatgctttccttccttccctttcttccccatattcctttcaacccaaatgtgctgcttctagttttctggataaagtaaaagactacacttagggctcagattaactcaggcttttactcagtctttcactggagaatctggcactcaaaatgttgctttgatttgtctttgtgtatgtagatccctcagaactccttggaatttaggtgactggcaaaactcaggcattcctgtgtgccatgccataataatattacaatactgctgctaattcttgttgatacttcctctttattctctaaattgagaaattaatatatgaggaggggaaatattcaataaataggatgtgaattaaaatttgatgacaattcatacaattttggaatatggggatgagaaaagaaataatcatctccagatttgtcactttatcaaaataatatagaaatgaaggtgcaaagtcacacaattaatgagtgaacaaccctggattcacgaatgtatgttgttcttaattccctgctggccataataaataacaagattagtattattggtatatctaaaggttagaattttttttaaatagcgtttggttatttagctaatggatatgtaaagagaaaaagagagcaatggaaaatgtctaactttgtgtgttatctattactttggtttatgaatggaataatcactctattatactggctaaacttagtttcacttttacaatggttatttcctttctagttctcaaaatattttgagccttgattgactgaaaatgagatccttttcattcagcataggcatgtagtgatttctcctaaagttttatccacaaaagtagacttttgattaacgatttttaaaatagtaaatttaatgctcctgtataatacctttaaactcactttataaatatagagagagtggaaaagtggaaatgacaaattactatgtgtctggagaaatcttaggtagcttcaagtactctccctggaaagtctagataccttcagagctgctgaaagctatagttatctactctacattttaaagatgacaatattatatgatgttaaatatatggcattcttgccaaaattctcaagtgcttcatgcttaaatgacattcctgaatcctagttattttagcaacactttcttcataacaagttcaaatgagatataagaaatcttagtagagaagttattcacctatgttgtaatttggcctttcactgttacaaccagcattcctaaatgtcttcaaggggctagagtcagagaaaacaggaaggaaatcacagttgggtgagaatgttccttggctacatgctaagtgattatgtgttgaggtcagagttgtaagatgtgactcccactgtgcattctgacgtgaaccacactatctcatttactgtcattcagctcatatacatatcagttacatttcgatatctttagatgaaaatctatggaatgggagtaggaaacattttaagtcaagggttacataaataattgttctaatttcttatttttggaactatatagagaaaaaaggtatttaaataggacaataatttagcagaaagggagttagaaaagatagaaggaggattcatcacagtatgaagatgggaaacagacaaatagagaaaaaattacatacatacatttgataaagaaagaagatacacagagttcaatgcacagcccccaacaatgccctagggagaaatcagatggaggcaaataggaaagagagatcttgggatcttaattagagacatgacagaggtttcaagttttactgtttctttttttttttttttgctaaataactttaaatctgtttgtgtttcacatatctagtcatagttgatgtggacaatggtaaaaagcttacaaaaactccaaaggggttgagatatctaggagaagtgtctggaactctagaaacagtaaccaacaatttgttaatttcacccatctgagccattttccttacttgcttttgctgtgcaagtatctcatcatattagtagaaacacaattcgctcaggaaggagatggaggcaaggaaatagagatggccaagttaactgagtgacttttcttgaggacgaggaccagatcagcagtagacaaaactgtatcaagagaaagctgagtgctaggctgcactaaccagctgagttgttttgagctggttcctcaaaatgtgagcttgtttccttatcaataaatgcaaataaaaccatggcttactggattggtttgaagattaaatgcagtagtatatgcccttccctaattgtaaagtggataaaataagcaaataaccactgttattattatttcattgtgctcaaagcttcataccaggcagcaggctctgatctttgaagaatttatataattgcagaagtaggacatacaaattgaatttaagtggtatcgaataaatgagaccatttgtgtattaaacactgcgctagtgttgggattcagaagtgaatatattacccatgctctcagggagtttacactgaagaattagtgtaaaccatgaatgcaacttgtaaaaatactaacaatgaagatgtaaaagactaaagaagagatctgagtattacagggtttattaggaaaatctcagcatgggtgggaagataaagcaagggttagtttagaagtcctattttggttatagctccaggattgcctagggatttgtgccaatcccattactttctcaagttggttgtatattttttaaaccattgccctttaaaagtctttgctttgaaatgtacttattttccctctacacgttttaaaaatttcattttaggatatttctgaaatcatttcctgctgacctgattttacattagacacctttgtgataaaaaaggtaatagcatatggaaacatacattctattccttcaccatctgagtgacagtgcgaagagggatcagactagagaatcatttgttttctatattaacagtatgtttttttttctttgtagtgtttcttacttccaatccaaacaatgtctatttcattattcctaaatgagttgttcttcctaacacattttccgttcatgatgtccttattagcccaccctcaattttcacttttccctgttttcaagttctgacaaagctttctgtaatatgttgtttgaattcatctactctgtttaactaatgttttgggatgttttaagggccttttgccaagtatcctctccacagactatacataatatagccaagtcaatagccatcaaagcacctttaaaataaattgggctatttccttatttaaaaactcaacatctgaactctttgctataatctgatttactcgccttccataaagtggggccctgtcattttctgttcccagaagtgtgggagaatgaaagggaaagaagagaggtgaggaacagggaatactgaggtggcacttactcatccctcaacagaattctgctctaagcctctgctgatgctggcttaattttaatatctattttttaattttttaaaataaaggaaattatccacgattattggaaaacaaaacataaggaaaaagtaaagtttaagacagccttttcatatatattttggacagagatcaagtcgagtgcctatcacaaagtgggtgcttagttaatgtttgtcaaataaatcaattaatgtgcagggctagaattaatatgggtcaaattgggctgcatgcaatggctcatgcctgtaatcccagcactttgggaggccgaggcgggtggattacttgaggtcgcagttcgagacaagcctgatcaacatggtgaatccccgtctctactaaaaatacaaaaaaaaattatccggtcgtggtggcgtacgcctgtaatcccagctacttgggaggctaaggcaggagaactgcttgaacctggaaggtggttgcatgagccaaggtggtgtcattgctttccagcctggacaacaagaacaaaactctgtctcagaaaaaaaaaaaaaaagaaaaagttgcgggggaggtcaaattgtaaggtctttttctacttacccatatttctcagatccctcttttcctctatcaccttgtttctcttttaatctgagtactcctaatactctccgcaccagtgtgtgtgtgttggtagcgatggggagtatatgtgtacttgaaaaattaattgctgaaaaaattccattttaaacttatttgttttgtaatatttgcaggaaacattttggatgtgataaaggtattatgaatttggcatatttaacaatggtgtgctaattctgtacatatgtttaattttcttgcttatcctttaggtgtaaatgtacaacaaataggcattaaacaatttaaaacatttggct[450 bp omitted]ctaactactaaaaattattggttttagtttggaaataattcagatgtatgggaataattttgacttaaaattaagagactgagaaatgatagactccttttaattttcattcatatgtttattttgtgtgtttaccttcattcaatccccagtgtcaagagttaacaacaggtacacgtttatttgtcacctagggcatgtgattagatttatttgattttgggaaaggagcattaggagtgtgaagatcttcacagtattagaccactagctgttgatggttaaaggtttgtcacccttcggcttgctgccctgcacaatcaatgcctacgatatgcttatttaatttattggcacagtaaagaagactatgtgatacaagaatctcaagactcaaagtctctttcaaaagcccttcaaactttggtaactacaagaataaacatatctcttccaccccctaaacacccaccaccaccgcacccctgccgtgggaatcaaggtcagcttgcagccctggtattcttaaaggaaatttatgaggaaaaataagagtcaggaacacctaacacaaagaagttaatttacaattacactaagccaagtaacttatcttctgcagctgataacttttgaagcattagggagttaaactgtatagatacaccagattgttacttctgagtttaggtttgggggactctagagttagcaagcagctgcctatcagggggtctccctatatataatatatgtattcacaatatatatgaatatataagttatatattcatcttcctttagatatatatattcattgttcctaagactaatgactttttacaaattttagtagtttacttaagtattagaattctctttttaatgctctggtttaagagtaacctaccaacatacaacaacaaccacagaaaacacaaactgatctgaaggcagaattttacagttctcccagttttcagtataagactcatgatttttaatggagacaatgttgaatgtgattccttggctcttcatttagatttttggtctaaatcctagttctgttagaacaaagttgtacatttttggacaataaacttctttgtcccttggttttcttatctgaatggagaaagagctgtaccttcatcataggtaggctatgtgtggctaaaatcaattgattcatgctaaacgtccagaacggtacctgataaattcttatatgtgtttcctattgttattaggactaaattataaagaattatcatttctgactacattgaagccacctctaattaaacagaatcaaggaaggacagagctctcattctttcaaaaaggatttagaggcatattcaaagatattactaaatgtataaagggatttgcaccaaggataaatgttaactacatcattatttctttccaaggaaaagcaattacaaaagtcttaaacaacagcagaagggcattcgagaaaatacaaggaaaaatataccagtgagatttatgaataattctaaatgaggttacggaatctcctctaaggaagacccttgcctctctgggatgcttcaggcaggtcaatcttagacagcatctgaagcggttgggtggattttggttccctccactctcttgtgtttccagctatttttcccatgggttacccagttcctctctggagcatcaccctaggccacctctgactttcctagtcaatacaaattttcattcacttctccttgtccttacatcaaactttctgtagatttgatagtttttacttatttaaataatcttttcagtagcagaaaatggatttctgactctgttaactgtatgtagtcttttttttgataaactcttccagttttcatacataataaattatatgtatatacatcaaatacatcaaaatatatatataatttcatattttattttgcccactcaatattattttacatatcccttctacatttatcttaggtgtagaatcacaatcaaatttctgcttaaatcttgtttaatgatttttctattgacaatttgaactgtttttgtattttcctttaaactgctgttataaatgtctgttcattaaaaaaatctcaaattatttacttagaatgaattccaaaatttgaattattaggtcaaagacttaaacatttctatgtatcaggatacatatgagcctgcatgtgcacacacacacagccaggtgtccttctcaaaataataaacacatttttatttctatgagcattaaatatgtattatatatttggctcataaaaccctcattatcctaattcctgaggctttaggaaacaaaaaatttgactaaagtaactcaaattgatgtgtaaatagcagatggacttttccttcctcatttgggaaagaaattctaagcagtatgtgtgtgtgtctgtgtgtcggtgtgtgtgtttgcatgtgtatgcacaaccatctgaatatttggggcaagtgaacttctggtatttagattgctctgtatagcacaatgccaaatttgcttacttagggaggccagtttaagcagagtgtaggtagatactgactgagggaaggcaatagacgttactctcagcattatattataatgagaaatagattggttttgcaggtgatttgttacttctgcaaacattacgtacaagatactgagtcaggtgctgtgggaagctacagggatatataagccacactcacagccctctatgccattccagtcaaataaagaagataacacatgaccacaaatcaatgaaatactaactaggaagtgatgttttatccaaaaaaaatgggagtcaattaaaaaaagagattactttgatgaagtgaggatttaatttaaaccaaaatattcaacatgagtgatatccagaggaaaaaaaatctactttcattcccattttgaggccataagagttatttccaaactaaattatgtaagcttttctgcctttatcagttgcattgacacatgaaaatattcgagaaaccttatgaaattccaacatctgtgtggaaaacaaatacactgtaatttactgaaggcatttatttatcaaggcatagtctcttttgggggattaatgggagaactatcacgaattttaaaattcatgagttggtatttgatctttagcatgacactaagattaattcagtatattgtatgtatttgcaaatgaattaatcaaatatactgaaattgataaaaagaagacagaaattgactttgacatgctgtttgatagttgccattaattaaatgcccaacaagttcaacaaaatacacagttaggcagaaataaaacaaaggggaaaatccaaaagtggcactttatttaattctttcttttataactgttcctaattaaccttccacagcttctgtagaatccttaatgtatcagattacttagaaatagaaataaaagtttcacttctttagaattatcaccttattctaattcacactttaaatttggtcactttctccaagttaaggctaaattttactgctctcttctaaacaggcaatcagcattttgagattctcttaggttgaagcgctcatagcctgaagtgaattctgtattttaatattcacagcacaaaggcaggaaagttaaaagctttcttctgtgtatacattgaacacttgtaagtggagactgaggaaatccaggatgccacaaaactcactgtagtaatcagtttagagtgcaagtgatgggagtcaaactttatatacttaaggctaaagcaatattcaccgacctacacatcaagacacgattgaaaatccaagtctcagccaagctagggatgcacaagccctcaagaacatctgaagctggggtttatactggccaggttctcctttgggtacccatctcaagtcctttcttcatgtcagctccttccttccttccttccttttttctttccttccttccttccttccttccttccttccttccttccttccttctttttctctctccctccctccctcctctccctttccctcccctcccctcccctcctctcctttctttttgactgagtctccttccatcacccaggctggaatacagtggcataatctcggcttattgcaacctccgcctcctgagtttaagcaattctcctgcctcagcctcctgagtagctgggattacaggaaccgaccatcatgcccagctaatttttgtatttttagtagagacggggtttcaccatgtcggccaggctggtctcgaactcctgacctcaagtgatccacccacctcagcctcccaaagttctgtcataacaggcgagccactgcaccccacccagcttctttctttctgactgaaaaatgtggttgccacgtggctgacaacagaccactagtggctcctggattttatgttctaacaccctgccatcaaaggaggatggattttaacaatccattccccaatttaagaaacccagaaaaaatttcttgttagtctagcttaggtcagaagttaatactttaatatggactaagaaaataatgaagtactttctgtcagacactttaaacaacagtcttaagcactttgaatgtatttttaacctcgtttcccatgacaacttatgagatgggatttatataattttcatttgatagatgatatatttgagacttaaagagttaggtaacttgccccttcaccagctagctagtcaatttcagagccaggattttgatccaggatttgattctggatctggctttttccagagctctgctaccctccactgtctatgtctgtgattaaccttgtctgggccatgtgtgctctaattcattgtcaggtggtgtagctatgaaatgtcaactctgagaagtcagatggggaaacattctagaaaagaggacagttttacagatgtgctctacattcatactatcacccacagctagtgctgattgtcctgactggtatggggatgcatccgcaggtcacttcgttcatgttcagtggtgctccatgtgttttaagaatctgtgctgtgtctccgtgtctgcaatccagggttgcaacttcacttaaggtttatttgatttttatactagtttattcatttatttgttagatctaggagatgtatttgtttcttgagataattttgagattattcagagaatggtatgcttttcctcccaataaaatggattaatctttctcattagaatgtgtacaggtaacaaataaaacaaatacattaacatatacatgttctgctgaagaactttgcaattgcttgatggaaataatgcttcttatttcaaaatttaagtacagtcttcctttgacattcaagggggattggtttcagtccctcttgcaggtaacaaaatctgaggatgttcaagtccctgatataaaatggtgtagtatttgcatataacctatgcacatcctcccaggtacattaaatcatctctagattacttataatacctaatacaatgtaagtgttatataaagagttgttatactgtattgtttaggaaataatagcaataaaaaaaggcaatatagacaattttttttttctgaatatttttgatctgtagtttgttgaatccagggatgcagaactcgtctatatggagggccaacttcacacaaaaatttaagaaaaaattttttctttaaaaaagactcaaatcaactgtatttttaatttgagcataatagactgaaccacaagacaagcttaaactatttcctatttctctttgatactataaagttttgtcaacctaattctttgtaaagttacagtgaaaacaacctggaaaaatatggagtggttaagttcaaaagtgattccttttggctcacttaacaatcttttttgctaagggttttaaaatttttgtcacagtgtgtctgctgtatagtttctcactttcttccatttttccccttctctgttacttttaggggtaaagcacaacaaataattgtttgctctctgttgtgttaagtgttaaatgtgggccattgctgatacccatgcacgactgctttactgttcactgtgacagctgtccagcttaccccgtaagcctgtctgcctcactcatcatttttgttattctccttcaattttcaaagagccttagaatcgggatgatctagcacagtttgatatgatgttagatttttttgtatttttatttccccacctcccccccatgtttaatgtcccagataatggattggtaagaatccagtgctttaagcatggattctctgcttacattttagccacaaaaacatgctagtatatgcagtcaatgatttccaagctgatagctaatgtaatgtgcctctagaaccacgtctctgcttttgtttctggaaaaggcaaggcatgtcaaatttattacatgcaaaatttgccttccaaccttgtggaaactttttcacaggtaaattggtatcctgggattttttttggttgcccaggtcaaagagaaaataaacattataagttaactcattatataaggcaaggattctttatcttttttgagtcatgcactctttttgcagtttgaggggcctatggtcttctttttagcatattgtttttttatgtgcatagtacaagattcagaaatagttctaagaactattataatttcaaagtagtaatgagaacaagtgatattttgctatatatgcaacacttgtaatgtaaaatatctatgatttttataggtatcaatgtcacagatagtgcctaattctacactggttgattgattatattcataattgaaggaaatgttaaattccagttagagattaataaaaacaaaacataatatatttcccatcatggacccattgaatgctattcatagaccccttagacagaactaagatgaatactttagatagagttaagacccacgtctatataatgtaggtgacttaatgtattgattctctcataggtatttgcatttttaaaaagatcttcaggaggagagaaatggtttacataaaaataataaatttataataataaaatatcaactactgtatggtcttctattatgaggatgcatctgctttgcatgcatctgctttgctgtaacaatggtatatattttaatgaacatgacaaactttaatatgcatgaatgctgtttctatcaaagttatcttcaaaaagaaaaaaaaacaaagttatcttcataggctatattcatattgcatagtattgctaatttcaaaaacttcctaaagaataattatttctctatttttttatagctggagtcctaatcttttaagtctcttgagacatatgataaatcattgtttttcaatagtggattttagttttagaaagagctaaaagtaataatgagttaacctgtttaggattttttttaaaggtataaatttaaggcaatggaaccaattttcttaaaaatataaatgacttttaaagttaattcaaagaagtttcaaaaatattttgagggatagcagaaacattaagtaaacatatagattgtccctggtaacatctttggcggtaatattcatatgaatatgtttgtttttaaaaaatcttacttcatgagctatgtcttgtaattttggaactgctcctataaaattcataaaatctatcaggaaaaaagagagagaaatgaaaataaaccaagcctactgcacatgaaacattagccatgaagtcagcttgctctctgacctgcttcttcgtagttctttggtgcctattgcctcacaatcatgtagaccctattacagaattacagttccccttaactgttccacagataacagcttgaacattataaaacattaagttttccctttgatcatttcagagaaacggatcatcctgatgtttaccagagcaataggctttagtggcgaaaaggtcttgcatactgatgaaactactaacgccagctgattccagtgaccccccactgataccagctgatttaaaagaccccactgactcagctggtctgaaggaccccatgaggaactgactcaccaaaaaaatgcagttttcacatcctgatgatttcatcaccctttccctgaccaatcaatgaccccaattttccagcccctcatgctcaagaaaccttttaaaaacccaccctagaacttctctatccccagaggagatagatttgaggatctccttccatctcctcacttgatggtttgcaatcattaactctttccctgctgcatttctgctgtcttagggtaatgggtctgttactgggcagtgggcatacaaacctgttggtcctataacaatttggagatagaggaatcctcccactgaacttggaaatcctatgattcaggcatctgtcttctctgtttcagaatgacactattatagttctggctcctgtagagtctgccatattctgagtgaaatgaggcactgcttatggtaatgctcattaatattagtaatagtattctggagtttcccaagattctgctgcttgaagcttactgtgatttacaatgagttgccactgtgatatccttaagcagattagaaacatcaagtgttgtctgagtctgtcatcagaaataatcctgctatccttccgtctgtgaatattttgtgtaaatgtattgactgattgatgaactaaagctcttcaaatttcattcttccctgcttacaaatgccagaggaacaaatggcctacagatgcaaagagatacttttcaagcattccttttttcttcttctgcctcagggactgttgttgactttgtcagcttcttgtgggaagcagtagatttgaaatttctgtagacttttgccacccccttccctcaacattgctccacatgatcagaagtcccatggcagcagtcctcactcacccttttctgtctgatgggacccattccctgcaactcctcccctgaagtcttgcccaactttcaaactctgtccttccctgccagtggggttggcctgaaagtgggagtaggagagctggggggtggaacttggagttcctttttgcagttgcaagctgatccttcctatacctcaaccacctttttgtatcagctttcaggttttcgtagttaacttttctgaaaggacattccattaggttacctattaaatagtgttttcagtatgatagcgctaagtttacacattgaattggctttgtgaattagactgagaattttagtacattcatttagtctattatggaaaaacaacaacaaagtattttgcaaatgaacttttagtttctgcaagtagagaattgctgtaatttactttttttcggttagtcctaaacgcatgtactttcatcaatttttgtaaactagatcacccaagtttatggattttagaacagtgattgtcagattttaaaatttcccaaaagcttgttaaaacatagtctcctgagccccatctccagagtttcttatttagtaagtctgaggtgaggcctgagaatttgcatttctaacacattctcaggtgacgccatgctgctgatcctgaaacagactttgaggaccactagcttagaggacagctcacaaatctgaaactactatgaatctttgcaattcttaacataactgaaatctcaaattttcaagagaatgtgaaatttaaactcctcttgcaaaggcacaactaaatgaaggtatatccacattcagttcacttattatatttaattacttattttcaaggcttatcagatcagatattaactccacaatttataataaaaaattcttgcaagcagcaatgggctagtattcatgaattaacatttttaatctgtgctaaaccaatgtaagttttacttttttgagattgatttatcttacagtgatttcttttgctttccagccgcattttgttgggtaatgtttttcaacagttttaaacgctaaatatctaccacgttcattatctttttagtttgaaaatgatgtgttttttttgaagcactattgataaatggctcccagtatgttcctgttgtgataggtagaaatatgtaattgattttatagcacttctgagtgctcagccctggaacctgcctacaccttgcagatgtgtgaattgaattggaatggggaaattctgctgctaatcactacaatcctccagacttggtgtgggaggtgagtaagcatgggactgcttttcttttcttgagaaaaaataaaattaacgcgatgatttttttttctgttggctgtcatattctccttttaaaaaacgaagaccttttgattacagtgcaagtatcttagttccattgccttcctgaaagatcaataactttgatattttgcggtaagaaggtcagcaaataagtgaaaatagctgaggtgtggcttaatttatgcaaattaataggtgtatcctcttgtgccggtgtttaacactggaaactactgcatgctataaagtattcacacagctgctgaagctcagtggcatccaaaaaatgaggccaaccacggggacaccagtcttgagttcgaagcccaactgtgtcatctgttagttatgctaacttgggcaaatattcagttttgctgcctttaaaatgggggaaaatatggagcctgcatgtctgtgagggattagaaacactagatgcgaaacacctggtacactgaaagcagtcaataaaaggaagtgatagggacagaaattcttaaattggctaatttcctaacttcttcatttgcaaaagaacagctgctgcatttgcttgagaaaaaaaattcctggccaggcgcggtggttcacactgtaatcccagcactttgggaggccgaggtgggcggatcacttgaggtcgggagttcaagaccagcctgaccaacatggagaaaccccagctctactaaaaatacaaaattagcatggcgtggtggcacattcctgtaatcccagctactcgggaggatgaggcaggagaatcgcttgaaccggggaggcagagattgtggtgagccaagatcaggccattgcactccagcctaggcaacaagagccaaactccgtctcaaaaaaaaaaaaaaaaaaaaaatcctaaaaccctgaataataatcagggaaatgcctatgtgcttcttactgaatttttattcaaggtaatttatgattatttgtccttgcttttctctgctgtatctaggtggatttgtgattggttagttgaattttaataacctcatcagaacttttaccaatttgatcaaattcttcaaggcaacttttaattatgcagtagttataaataggttgctaatatatgagtctgttaaatattgaaaatccttaccaacgttgcctagcacatggcatttactccatagatattagtgcttattgttagtaactgcattatttggagattctgtcatatatgcttccagactggaaatgtttaaaaaaaagtcaaagtgctattttttctaactaacatttctatgggtctatagtcaggatgcaagtccagatatcagctcagagatatctcacaaagagcagtttcctcttttattccatatgggctcctggtctctcaggtcaccaaggtagttttcctggtgattaggttcccagcaccaaagttgctgcctccaaaaaacttctctgatctgccaggtgacaccctcagaggtcagttcaaaaccaatctaagacttccagttgtgactcaagttttgctacacttaatagagggcattgaatatgtatgtttcatcattacggaaccattttattttctttttatgtttgacaaatggtacaaaaagcatgaaggagttaaattggattaacactgttgttcaatattagggtgaattatttcattggcttttaacctattaaagcctattgctctggtaagcatcagtatggtatgtttctctgaaatgatcaaataatctctggaaaaacaattgtctgtctctgcaacttccaatcctctccttccccatgagccgaaatcaatagatgtgccaaggagtgggtcaggatgaggaaacctaaggccctttatcataatctctattaaccttcccaaagccactccaaagaagcatacatctaactaaaggtcatgctgattgtgcaaacattggcaatgtgtagacaacatgtagacccaattcaaaccagactgatgtctctgggctctgtctacacagagtctcatttggtatcttcactgctcttccttccacaactgtattgcaaaagactctggacctataatttggaaagactactggacctgtttctgaaggaaagtgcatgtagggcattgcaagtggggtttaattagtggaaatgcaacataattctcatattttctaaaatgaggcatgtctgtagccactgtttgcaggatttcctgttggacagggagagtagcctaattgcctctgggtggctttttccaggcttcaaagaataaattttgcatagcattttggaggcatcatcaaaatcaaagcctgaatacaattttatccaaacagcaaaaatattcatctcctgtattcccacagtgaacatacatcagcggatcatggggacgggttggtattgtttctaggcttgatttaggtcaatgttttctaggggtgagggtaagatttgccagaggccagaactttaaaggatttttggttttaaaaagaaaaaaaaagagacagaaataaaaatggatttggatcgttaacctgattcttacagcaactggataactatttccttgctctagtccaggagcaaaggactagggtgaatgatccactgagaacgtcttgtgttagaacaaatactgagagaacctcagcttcatcaaatttactttgcctgttgctttgccagatatttttagttttgcagtgttttagactttatatctctctgctatacaaaacctaaataatcaaggctgccatactatcttaaaaatatgcaaaccagctcaggggagtaatcagtccccttgactgttggtaaatgtctatttaaagcaaagttgacaaatcttttgtgtaaagggtcagatagtcaatattttaggttttcttggctgcaactacccaaccctgcttttgtagcaaaagacaacaggtaaatggaaggataaggctgttttccaataaaacttcattaaaaaaaaaaataggtggcagaccagcattggtctgtgaatcttagttgcagacttctaatttagaccattacttgcaaatctatgaaaaacagactacattcaaagctttaatattcaaaacaattacacataattattattaataattacatctaatacgtgtttcaagataatttgcttgaaaaacataccaaactcactgttttctttaaaaaattaaatagagcaaggggctttaactgaaccctctgtagaatttgtaaactctgtatcttattaacataaaaaagaggcagatgccatgtgtcagtgtgtactgggactgatagctgcataaacttaaagcattgattggtcttggcataccacttataaagtttgcaagcaagcaaattctttaagaagcagatgataaagctcagtcaagagcacttatcttcaaaacacatggctcaagatatgtgttttcttgccagacatatagttgaattatttaaactattattgaggattatggagcattttttcgtggatgagaaaatagctttacatgccggtcaaaatcaagtttctatatctagatactactttgctatggttcaggttgttctcattttcactcagcaatttgacagaaaaatgaaatgatgacctggataggttgtatgcccacaagacttactgtcattttggtggaaatgtttcaactggcccaatttacctcccctgacgggcaggaggttcacctactgcttcttactgtcatcgattaggttaacagtgtttgaaaatggatttgtaatcagtttgttttctttaatttctacctaaaattttacatttataaaatatcacacaggcagtaataacttaagcagttctctagcactcgttaagagtttagaaacataggcatagagtaatgtcagcagctaggcatggtggctcatgcttgtaatccccgcactttgggaggctgaggcaggcaagatcgcttgagcccaagagctcaagaccagcctgggcaatgtagtgaaaccctgtctctacaaaaaattagccaggcatggttgtgcacaactgcggtcccagctactcgagaggttgaggtgagcagactgcttcagcctgaggctgctgtgagcctgtgagccatgattgtgccactgcattccagcctgggcaacagagagagaccctgtctctaaaaagaaaaaatcattgccagatttagctaataaaaatataggaggcacaatggactaaatctgaatttcagatatacaacaaataattttctttttctttctttcttttttttttttttttgagatggagtctcggctcttgtcacccaggctggagtgcagtggcatgatctcagctcactgcaacctctgtctcctgggttcaagcaattctcctacctcagcctcccaaatagatgggattataggcgcctgccaccacatgcagctaatttttgcattttagtagagatggggtttcaccacgttggccaggctggtctcaaactcctgacctcaggtgatctgccggccttggcctcccaaagtgctgggattacaggcatgaaccaccgcgcccggcccaagaaataattttctagtgttaagaatgttgcacaaaatatttgggacatatctatactaaataaatatcctaaatatttgaagggacataattacactaaaaacttatttggtgtttttctgaaattaaacttgaatgaggcatcctaatatactgaagcaggatctaggaaatggagttttcactagatactatattttctatcaggtatgactaaaatttaaaaatgcaagtgcctctagttagacaatcctcatgggtgaatctgtttaggtagagtatctactcctatgccatgttactagctgggtgagatttggcttaagcaggtaaagcacctctaatgcaagcatgggaaggatactgttgctgtaggggtatgttttcttaatttatgatgggtgggaaacatttaaaatgatgacttgagctcattctctattttaataatgaatttgcttttattgtgtcattctgggttttatagtgtgttatttggaaattataaaagaaacaaagatgctaatacttactcatactttcattatccagagcaaaccactgtaaacattctgctgtttattggtccagtctttcacatatataagtagggcacatcagatgtcttgaatattctaaatcactttacctctgaaatgtcatctttacctttaatttccagataaatgagcttgattcctttccccccaccatattgtgggagtccatggctcctagaatatttaaaaagattcaccaaaagcaatagtatcctcagcttggtttcacctcttgctccccattcctcctttattggatcctccatcatccctgtatttgtcctgcctcctcttttatgttatctaatctcatagtatcagttgtccctcttactgccttcctccaactaccgctccacaaaactgtcctacagagttgacgtttactggaggttagaaagttagtggaggtggactgcagcatagcacgggatgggaaggaactgagtatagaatgccaggcatcctgttcttagaagttcctctggcatcaccagcagtggggctttttcacctgagctctggccactttccatgctgtaatttaccaaacctaatactccttccccagaacttttccactgggtccctcctctcttcattcaacagtcctgacaaactctttcatggtcgcctttgcttcccttacctcctctggactcgaaacctgcaaatgtaccttactgtattattcagagctgtagacaccttgtttaaccccctctgccatgctggactttcccaggagtctcagactttctcaaacaaaaaaattatatgtttatataaacatatagactccatcttcaccccccaccccagttttaggaacccctaaacctctcccatcacagaaaatgaggttgacaactgatcagacctcattaattttatactgtaaaaagctttttgaatgtgcatgtccttatttttacaatcatttcactttctatttaatatcaatggactaagcttcaaaaaataattgtaaatgatcatattcaatattatacagcgatagttttgcatttgcatataactatacccatgtgataaaaagacatacacattttttgtctgagaaaacatatttttatatataaattgttacatatgcaaatttctttctataaaatacataaatttaatataagtaatttatataatatatatatttaatatttaatctataaaatacactatataaatattatatatctgtgtctacatatgtatatacatatatataaaagccaagtacccaaagggctagaggaaacttttaaagtatagttttttttttaacttgagccagacaaattcttgggcaagaatatcttcatcacccctcatctctgtgggtgaaagatttattctcctctttcatgtccccttcccctcaccatcctcaccctgacctcacagaatttttttcatgaactgtatttcagctctaagattcatgattttatgattctgcctaagtgcccttcaagactcaagccaagggctgttttattttattgttgtatttttcagatcagctttctcaccttctcatctccccagtaccctctgacactgatgcctcattctgcacccctcttgtttattcactagtctctctgggaacttcctcgcaccatccttggggaggtgttaccttcacaaccctaaaatacccgcaggtctccatggtggcggtgaagagggggccttcaattcttgtgcaaattacatagaatatttggtactagcaactgggttcagttaggagtttcagtgcaagaaaatgaggagaaaagcagtggaacctatcaatcaatgttggggtccacatattttttttttgtttgtttgtttttgttatttgagacagagtttcgtttatgtcgcccaggctggagtgcaatggcgcgatctccgctcactgcaacctccgcctcccaggttcaagcgattctcctgcctcagcctcccgaagtagctgggattacaggcgcccgccaccatgcccagctaaattttttttgtatttttagttgagatacggtttcaccatgttggccgggctggtcttaaactcctgacctcaggtgatccacccgccccggcctcccaaagtgctgggattacagacgtgaggcaccgcgcccggccagggtccatatgtttttatgagaaaatgttaagacactgacctcgccccagcagacttttggatacccatgattactcaccttcattttattaattttactttcattgttctttatctttaagtaggactgtttgttcttttacctgtgcttctgtcacatttttcagcttatttgtttttaaaaatatttcagacatatgaccaagacaaataatgaattttcaatattaattgaaacttcttgtgtagctctccctgtctcattctccccaactttgcctagtgtttactatgctagatttagtgtttctaattctcattataactatatataaatttatatatagttgcttctgcatttcttgaaacattactcatatgataacatggtagttattcttttgtaatttgattatttttagaatgtttctgagatgcaggtatgttaatacatataattctaggtaatttatttctttgtactatttcatggaatgaatatattatatttatttatctattcctctgttgatgggcatttagataattttcttattttcctatttcttctcatgaaaaacatcaataaaatattcatgtacacgatttcttgggctaggtgcaggagtttggccagtttggaggaactgccgaacatgtataaaaccatcagatcttgtgagaactcactcactattgtaagaacagcatgggtgaaaccactcccatgatccaatcacctcccaccaggtccctcccctaacacttggggattacaattcggattacaattcagagatgagatttgggtggggacacagtaaaaccaaatcagacgatgtatccatattcaccttttttggaatattgacaagtttctctccaaagtagatttaccaatttattctccctttagcaatatgggacctgttgctccacattctcactagcatttggtattgccaatttggtgggtagaaaatcatatttcattatgattttgatttgcattttcctgattactagtaagattgaatatctttcattttttttttggtcatttgtatttctgtgaatttcctcctcatataatttgcaaattattttatttaaaaaaactgaattatagagcacttaatatactttgacttgcaaatcctttcttgattttattactgcaaatatattctccccagctatagaatactgtagtatttttcataactctctagaagcagttaactcatgtgtaatgttttgtatttgtctatctgtttttctcataagattataagtgagaacagaaatagaatttttcatttttatttcttcagttcctggcatatccaccaaaactgtctgaattaatttgagagtaccagttaatttaatgtagaagctattgtaaggttgagtttcttacttaaggctttctatttgaaggcatttctgtcaaccctaagtcatgtaatatatacatatattaatatatactaatatacatattaaatgtgacatagtttttgtagccaagtcagattaggtccttttttaacttttaaaatagagcttccctcaatttccaggcaaagagtttctcttagaacactgctaaggtcaagataggttaatatattcagatgggattgaaataacagatgcattgctatttccagtccagagttgttggggaagcagggaggaaggagggcataatttgtacagtgctttgtcatctttgcagctcatcaatatcagcagctgacacaggcaagtgtttgtcaatgagttctattggctgacactgaccttgccgttacaaccactgctttcttgacatctgctagtttgacacgtggcaccggattccatgtgcagctggtaccttggatttgaatgttctgtgagttctatgacattattagtacaattccttgatactgtcaccctgttatacatttaacatcaatgatagctgtgtactgtctttgtatttcttatttcgtattgcagtagttatgttttaggtggcatggctgtttataatggtatcagacaacagatgttaaattagctgtggactaattagcatgctcaactttagaattgctccaggaaaagttgattttactataactttatataatgggaaataatttaggtaaattgttggtaggaatgagtatcatgaatctgaaaaattgctttgcatttaagctgctactttttaggactaaatttgagattatatattttttaatttaaaaataattttaagtagaacaaacttgggaatgtaaaaatgtatcatgattttaatgatttgatcttgaaataggtttcaacatgtaattctaatttcttaacatagtctcagttatgctttgtgactatgaattacagaagccacagttctactttttcctctttgtccttccttgaacttttttgctccccctatcacccctcccttctctctttcctaacctggcatcccagtatttgtacactctttagttgaagcttaggattccacatgtgaaggttcattacttattttttttccagtagtgtccctggaaactatgaattatccacagtagtaattgaagataacaattttgtttatggtgctgaacatgatcacatttactgctgggtgtgtcaagcctacgatgatggaataataaatgggtactgaacgttcctgcaacttttatttgcaaggcattgctcttgcaatcagggtcacattacctagatgtcagtgaaataagacagggagagggtatttatttaatccaccatgaatgcattccagagtgacttaattgcttttctatacctcaagcaggtggatatgtgtacatatacaatagctgggaacctttttaatttgggttaacaaggagaaaaaagtactctttgcaaattcaggaattatttttttctttttgaattcctcaaatagggaagattagtatattttcattgcattttttaagcttgttgccccagggtagcacagctttaactgttcccaatatatccctgttattgtaaaggcattttaatctaagagtcacgggagcaaatggatggtggataaaagcttcaaaaatttggccattgtgaatttctgcaaaatcttcttcgcttcatttactttctgtctaaaagttgtatatgtcgagacttgaaggccttttgagatgattccaggtgttactctaggaatgtgttccaattttgtagcaaacctccacttcttgaagacatttcttgaagcatagatagaccagatttgaaatctactgtgttcaccctgcaggtagtttttcactaggaattgcatccacgacaggcttttcatctttagcaagtcatgggcttcaactgagagttccttaaatggataactgaggcacaaggccaggctaagtgacagttacaacttcatccttctcctctctcctgacaccagccccaccatttctaactggctgtggttccaagtggcacctctgagaggcattgagaaacattgtgtgacaatagttaagactgcagtgctatggagtcagaaagacctgtgcctgagtgctacagctattgcttgctgtatgaccttgggggaggttagtgaaccatttttaagcatcagaattcccacttattaatagggattatagtcgtacctatttcaaaagtttttgtgaggattccatgagaaagtacttaataaatgtctggcacacagtaaactttgtgtttatcatgatatcatgattgtcttcatcatctctggtcatgtcagaattcttggggggatatttgaagagatcatatttctcatttgtagctaggctacaagtaaacaaaacgaatcagtgagattaaagggtggaagcccagcagagtgagcctgaacagttttacaaacccagctgcagtgtcctgttagaagccttcaacttgccaagcacagatccattcctttgaaaaggtcactgtgtgaagagctgcctaccagtggctgactcacacaagcatctattcacgctcattttcctacatgaatagttccagggttaccagagttctagcctcatctcaaggccttcatttatttattttcccagagcagtctcatcaggctatgaagttccagcttgctttatgttgatgactgctgagtctacatctgctgctctcacttcttctgaattctgaagaagaaatttcttaggctgcattccaggccctttgtattctctcccagacctgccatgacagcctgaatttccactgctcagatttatgtgtcgtatgtcctggaataactgaactattggttattttctataaatactccatatttttcagtcttcatcctcctcacatttaccacctctgcatgtgtgttcattggttctttatctacatttactccttggctaggtaatacgattcaatctcaaggttgtacatgctctctatatctttataacttccacatttacatctccagatgtgactctatgtttaaattctaggctcatatatctaactccatactcagcatatttacttgaatgtctaaaagacccctcccacctaaggtgtccacaattgaacagtggttctttctcttcttaccccacctatttatgtgtgtatgtttaatttttagtattactttgtgcttttcttgactgaaatttggaatcagccatttctgcaaggaaacctccttcattttaggggaatatagcataaagaaaccaagatttgggtgcttaatatgctcattgctactggagagtgagatcatgtcaccactttgctgtgaatatttcaatagtttctcatctcactcagaataaaagccaaagtccgttatagtggctgacaaggccctagcaatctggccccttcttaagaatcttgccacatcccttctggctcttccccagggtcattttctccagccacaccagcctctgttcttcagggatgtcagatagcctcctacctttggttcttggcttttgctgttctctcttcttggagtattttcacctagatatctgcataatttatttcttcacttccttaaatcttcttcttaaaagtcacctccaaggaagccttctctgtccaacctattgaaatctattgtgctctcacctccatcttctgctactccctgtacatatcttccatgcttagttccttctcagcacgaccacaatattctaagatattatgtaacttattttatttatcatctatctctctcttctaaaatagaggttacatgagggcagggatttttttgtgttcagctcactgttgtatccccaggatctaggataacacctggcacctagccagtgctcagtcaagattttttgaacaaacgatgagtaaatgaatattatgatatatggaagtagggaatggtttctggaagtctattctaatatggcatcaaagccaaaacaacaacctatagctgtgcctcttctgtgactatgagcgtagagggcaaggaggtgttacaatatctgccttaggtatgtaaactgctgaagaggtggaagtttcacatttatagcaaatagccttggattcagattgtttgtctttatctattaatgagtccattctgatgactcaatgactaaattgaagtgggtggtttcgtagagggaaagtgtttcaagaaaaagaaatgttatttgatgcaaaaaagaaacataaaaaaacccacagaaatcagggataaaaaatagtggcaaagaggaatgaatctaatagaggggccaacacatttccagtaagtcaggctatctttgaaagcttggtgactccttacttgcatgccttctccttcctctgggggccactgccctcacatgtgtgaggggccatgagaaggaagaggatccaagctgtggacctgcatgggttgtgagaacattactttgtctaaataaaataaagtagattttgcttgggtgatgctgccatttactgaactgtttaagaaaaattttaaaaaacaaaatactttaagatgcttatgggaaagatactctttttttttttttaactcctccactgtttgagattcttgctctttgccagaagatccatctgccaggcagcgatcaggctttctgaagagcctaaagctctacctggggaatgtgtccagagggagaacacctgggcaggctgaacctactcatgatttagtgcaagttactgagctaaacagcttccttttggagtcttcagaaacggccatggtatcattttcaagttagctcttgttcccaaaaggaaatttgcatattcttatgcttatgtgttttccaaacttgacacatttagtttatgcaaggtggtttcagaattgaagtaaaatagtttgtcttttctgaagaacaagccaaggaaaagagagaaacttatgcttaggtctctgaggcctcaaacttcctgaatatgtcaaaagtcagatgctggaggttcagggtaggaagaagtgagggtctggcctaagtgggagcaccaatggataaatcaaggcatacaaatatagtaacttatgaaattattgacttattttacccttctttgctttccctgaggttctgtagtaggtgagacaatcttgatgccagagttaaacgaggtcaaagagtgtggccggccacaaagactgtgtcattatttaaccttagaagataaatgtccctcatccccatatctctctagcccatacttttaattacagaggggtcaaagaacattccaaagcacatctgtctctcaggtgttagagcagactggcttctcaactttggtgaccgttgtttatcagtttctatgaagctcaaaaagcttgtcatataaaaagccacaatgcttgaatagcttattatacctgttacagtggtctcataattggtaagcaaatctcgcggttgtgccaggtgatccattagggtatggagaaaaattagtaatctgtgtttttattttcaccttttaaatttctatttaggtgcatgtgtcacattatacatttgtccaccagcacatatgcatgataatgaataaataaattaatagatattcttatagtagaagtatgtgctcaaattattttattgataagtccatactccagaaaccttgggggccacctttttttccctcaagttcaacattttttgaggtctatagcaaagaatttttactgtttttagtggaacctggaaaaaaaagtggagactaaaatatttagacttacaattctggtggattttaaaatactttgttcctataacgacatacaacattagcctctttcttttcaaagaaacctgttttatttttggtgtgagtttcagttgaattgataaattgattcaggatttaaaagacatatacaaatttgtagacattctctacatatgtagccatgctgggttacatagcattaatcattaaaatagaaaagcccctttacaataataacatttcaacaaggctaaaatacctattttcaggatataaattccaccgggaattaccttaagctaagtttgaatattgggccacctggtattttatgctaactgattagttttatatcccaaggccacaggataattttactcccaggattcaaagctgtactttttcttttcaaggagtacagaatgtcgctcaatatacatttcgattttgagcaatgacaggttagctgaaagacttgggtttcaggacagttctatatctgatggatggcttatatgacatagctctaactctgagactgtccctcttacagaatgcttatacctgaccctttgagcctttcagcgacaagaatcagaatccatctcaaaaacaaaacaaaagaaaacaaaatcccataatgccaaatatacgtgaagaatttgctaaaacctgagttgagcccaaatattgagtttattttttaaactcaaatttgtattgaacttacttcagaatgtttctaaagtacagcctgaactgctgccgatcttcaacattttcaaaactatggtactataacaaaattaggccatcaatatattctctgaatgaaattggacttgatttagcacctctgtcttaagtctctgaattgagctttcttatagcagtagggtcctcatcgtctgcatacaccactaccaatttgtttattaatcttttctgacaatacctctcccccttttaaatagccttgtttctaatttggaagtgtcattcttagtgaaactaaaatgagttgcaggattgatcagtttttgttgatcagttttgttcattttctcatttttttctttcttatgcttttggatattaacagaagaaacataagcagcagttcgtaaactgcctctcaagcatcagagggaatttgatgctgtgagatttaggctttcttctcaacttttccatgggtgataatgtccccaccatgactcttccagcagaaaatgcccagacagctgtatggagtccatcagctatcttattaggatgtcttgagatataaaagttatgcacaatagttaagtggaagatacttactttgttagactctactaaacttagaaattacttagtttttcccaggaagataatcctacctccataactagttagcaagtttgatagacattctaggcttcctattttaacttattttcacattctgtctagaacaacttccctttgttattcagaaattaatcctactgacttcaagacagtcattttgactcgctctatttcagcaaacattagtgtgagaaccagccttcatattgtcataagcatcggttgtgtgcacggcattctatctatgttaagtattgtatctgtgtgtgtgtgtatgtgtgtgtgtgtgtgtgtgtgtgagacagagaaagagagagagagagagggacacacacacacacacagcacagtggattttggcatgcataattttaacattcataagcaatcctaaagttccaagccatggactcatgtagtgatttgtaattttgcttagcatgaatttgaatcccacttatttgagattaatgtaggggacaaagtgactttgttaatgaataagtcaactgtacagaccaaaatgtatcattgttctaatcatttttcatgtttttatgggggctatactgtaaagcagtgtttctcaaccttaataatatcgacatttgggccaaatatatcttcgttgccaggaaccgtgctgtgagttgtaggatatttagaaacgtcccttgcctctactcactagaggccaggagcacacctctcccactttttatgacaaccaaaatgtctccagacattgccaaaggtaccctggggggaaaaaatcacccagaattgagaactgcttctgtagagtaaacccctggttgatgagtgaaagctgagccatcataaattgtacccgtatttcctatagtgtgttgttatacattgagattttgtttctgagagcaccttccattcataaaattacaaaattgatttaaaatttctacagccacttaattaaatatggaaaattatggaaaattatgaaatctatattccttttaagggagactatcttttcctattgagttatcagcatatccaatataggcatttcacttaatactgtctgagagaaattatttagcaattgaagatgggatgaaatggtaagtgagaaaattatattcaaggaatctagctgggagactgacttagtcttgcctataggatagaaggaaaggtgggttttcaagatcacgtgggagaaaaatcactgagttcctaaaatgatcattattactgccaggtaaatctagccattccccaattgcagtgaaaagcaagcaatgacttgatcctaagtgtctgagaacagctccctgagctcagccacagttcctaggatctattgtcatgatccttctaaaccctaggcctccagttatagatctcttttaattataccaacacttgttgtttcagaacttgtaaactttcagcccatttaaacattcttatttactgtctcacttttttgtaattaactaattttatgatttctgctattaattctttggttttcagagtcatttctctattcaacaagattgtctctaaactaagcgtgtgtttctgaataccacttcatgaaggtggttttcagaagggaaattgcagctaagtgaagcactgataatttgtcaacctgggtagtttttacagcatgacttgactaggatctggaattaaatatccaagagagaggattaaaaataggatgggtttcaatatcagaaagtgaatgcttgaagtgtctttcctgtccttttcattcaatttatcacacgcactggcactacagtttctgcaaatgagtagtgtttcctctagggcttccagatttaaatggaaccaaaagggctgagttcttttggctggatcattctacatgcttgtgaattgcaatttcaatgcaaatcataattattggcctagcaatagcatatactgtatccctcaaatgaaaacaagaactagaaagttttgccccttttatatatcttggtacaagttcaaatcatttcacagtagtcctatgtttgacaggctattaacatcttatttaatattattgttttattcatagataggcaagtagtaccgtaaaagtcaggcgagttttgcagaacatacttctttattgatcatattttcccaacaaaatatatttaaatataggtataattatacccacaatatagcaaaagtatcactactgttaattaatatataaatagtggtataactatattattataatgatataaatagcattataatttaattcataatgtaataatatttaaatggttttaatattaaaatggtttatttaaattaaaatggttttaaatcttctcaacaattgcaagacgaagtttctgagaggattgataagaattatagtcccattgactttccatcacttcagtgtgtgatttgagtggttttattgcagggaagatgggctgcagagttattgaatctattttttttttcttttgagagagagtcttcactcttgtagcccaggctggagtggtgcagtggcatgatcttggcttactgcaacctctgcctcctgggttcaagcaattctcctgcctgggcctcctgagtagctgggattacaggcatgcaccaccatgcccagctaatttttgtatttttagcagagatggggtttcaccatgttggccatgctggtcttgaactctgaaccttaggtgatctgcctgcctcagcgtcccaaagtgctgggattctaggtataagccaccatgcccagcccgagttattgaatcttaaagctgcacagagctctcagatcatctggtccagtggctttcaaatttgtgaaccacaaatacagtgtgtgtgtgtgttcatatatatctgaaacagagtctctgaaatagtgcttattaatatattttcgattaaattctattctattctattctattctattctattctattctattctattctattctattctattcttcttttatctaattcgttttttaaaatgccaaacaggactcactgatagtcatgacttgtggttggaaaaacacggatctaggctagcagctgtgttttacagatgggaaatccagagtctggcaacacaagtgttgtctaaggtcaaaaagctcattagctgctaaaacgagggggctttttaaaacacaagtggaatttcaaattcaagtcatttagcatttggtgcttacaaaatgatttatggctagtccagaaagcactttcggattgctctattggaaatcaggagacaactgtgacccattactcctgtgcatccgcacaggcacacttattccctctgctactggccctgtgacccaccaggctaaaggctgtattggaacataggcacacctatttctttgcatattttctttgactgcttttgtcatccagtggcagagctgaagagctgtgacaaagacggtatggcccacaaagcctaaaatgtttactttctggccccttacagaaagagtttgccaacttctgggaattgtctgataatgaatgtaaagcacttacaatttctgacacaggataaatatccaaagaacagtagctgtttttaattttaaagtggtaatggtgattaagaggataagaattacaattattatgttggtaatgatagaaataataaattttgatggtgtcaatagtaatgataatgatgatggcaataatattaataacagcaataataataatattttatttagctaccagctttgaattcttttatcttattgtagaagccactcctgatattgcctaagtttttccttttccctggtatcaaaattcattttcaaggaagaatctgaaacttgctgtaagataaaaaaaaaaaatgaagctctacatattgaggcttaattggcaggtatggagaagtattttgagagaaaactcaggtcttcttgtccattgttgcataaagcagcctcagtctgcatatttttattttattctggacaactgctttgcaaatatttgcagagtattcacaagggatttctgtttcttcctaagatcacaccatcagcactgtcaaaagctcttacttgtgtggggcttgatggtgagtcctggcagttttcccatatcccacaggtgtcctgggaaaatatatttgtcttctttctgactttttttttttttaatttacaaagctaagaagaagaaagacattcttgttttgtacccataatttctgtgctacactaaggtttcctaaattttggagaatttgctgtctatggcctaaaaaatataaccctcattgctgccacccaccgaccccaaatgtgtcttaaagtaaattagactcactcagaaacttagcatctgtttctcttctcagttataaattcacaaataggatgtttctccttttaaagtggtttccctagcaactaaaccaaccttatatgatcagagcagtttgtcacttttgaagtttgactttctgacaaggccttctggctcagggaaatgaagaaaacaacctccaaacacaaacatttcgaaaacactcaagtgatgatttacaaatgaattacatttgggtgatttttctgtagattgtgtgtcaaccaccatcaccaccacgctccacagccagccagcaaagatagccatctcttgaagtagctatcgtcatagcagagaacagatgggagtgattcttaaaggggctaaattaccataaagatgtattttgggaagcggtgggtagacagagatataggaagacttgcagcaggcagccacacaaagcgaactcaccttgtgattagttcatcttgcttatcttgaggctaaagtaaacatattggtcacaattcaggtacatcgtggggaagacagacttttgctccctctactcagaaggagtcaggacaaagtgagaggaaggtgggtctcagctaacccaccttagactgacttttcatttattttcattattttaaaaataataataactgttatttgtctttcgtgctttttttccccactgttgctgtcctatttactgatgaccagagttaggacctcattcaattctgggttttcctttcccttccaatccctttctgactcctgctgtaactggaatgcagttggggatggatagagtgattggggtaaaaaagaagggtacaggaaacaggacaactgtctgctttctaatgacattttctattgacccctcaacaaggggaagagagaaattatttatgagatctgtagagacccccaaatgagcttcgagtgaaagagcttatgagagaagagtaaaaacaacagcggaagcttagtcagagtttgcagagtcagaatctctgttctcagtttgaattcatgaatttgtttgttcatgaatttgctttcatggtctcaagatgaattgcaagttttcttccttggaagattttccccgagagcacggtgttcctcataataagcaagtcaaatgggcaggtccctcccacttgctggtacttcagatggagtgtgactgaggctctagcagcatctagcaggtaggcgatgtatgaagtaaagtaaaaaaggcatgttctgcacaacaaaaaacttatatcttatgcaaagtaaataccaattccaggaagcagaagggaaatgttttgaaaagatttgttcttacaaaggaactttttaaattttttggtcagatgtgtggtgcatgcctgcagtccaagatacttggaactttttaagaccttttttgggggcacaggaaaatttgtcttctgaactttgtacagattatatttcttataccaagcttggaatacattcaattgaagagttctgtaagtatttatcaaatacttactataggtttattattaaaattggtactttggaaagagaagcataaaatgctgacatagtatggtagacacagaaatgtggtgcccagatcccgttttgagaaaggtcttgctgttgagctgtggaaggtgtggttggcaggtagcatccaactgtcacctccttcagggtcaacctcatctgcagagaggctctccactgagtgtaccttctcggggaagcccacagctggtgaagccttggctactttggctggatatgggaagcgcttatgggcagcacttcctaataccaagtgttagggagctcctaagctccttacccaattagcccaggctccattgggtctgcttcatcacccaacttctccctctgccaatcctgcctcttcttcttacttcccaccagctgctctctcataaatatctggcaccctgaattttgtctctgcatctatctccagataatccaacctgcaacatccagttattaatgattttgcaaacaattcaagagacaggactattctatgtgggtcattgatgctgtggcacagaatgtaagtgctacaatgtttttagatgagacggagagagctgagcacttcaaacattagagaagactcctggtagatctgaactcctgacctaagatagtggagggtgagaagacaggaaggacaggaaatggagcaactgagccgaagcaagtagtgcggctgtgaggaagttggcctggctaccaagaaggctacatgttagggaagagttagaaattgaattgttgttaatttacttaagattagatcaggctgtgcaaaagagagaaaaccccaaaatagatgtttgcttttttcttacattaagaaaaagttcagaaatttagttttgttcttgtttgagatctcttcttgccaatttattcatgattctgtcttctttagagggaagcccttatcatcaggatctaagatggctgctagagatccagccatcacatccaaattccagacagcagaatggaggatgagataaagaagggcatgtcacatcattttaaagaaacttacttttaattacttctcattggttacaacttagttacatagccatacgtactagtaaaggaggctgaagagtatcccttcgactaggcaacaacatacacagcttaaaattattgttattttaaaattacagttgaaatatatgaccactcagatggtggaaacaagtgagacaaaataataaaaaagctaaaatctagtgtcttgaaaatgatggtggcagtaaaacattcctagaaattacagagaagagttattttatatatgtgtgtgaaatgtcaaaagatttggggcatatttagttggaggttaatattaataatcatctaacgtatgttgagggttttctatgtaacaggcattatttcaaatgctttatatctattgcataatttaatggagcctaacaggtaggtttttataaatggcctattatatataaggaagtggagattttcaggaaggaagacaattgaccaaggtcacacaaactgtaaatggcagaacccagcctcacactcatgtttgtcaaattccccaatccgatgacttgcaccatggttgctcaatattagagtcagcaagagaaacatcaaagaggagaagcgggagctcaggagagagcacagacctggaaatgcacgttgaaattagccagttctaatgagcactgaaaccatgagagtagagaacatgagagaagagagtcatggaggagagacctcaggcaatggaaagaggaggatgccgaatgttaagtcttggggatttttctttctttttttttttttttttttttgttagagacgggatctcaaaattttacccaggctggagtgaagtggcacgatcatagctcactgcagccttggacttctgggctcaagagctcctccacctccacctcccaaatagctaggactacatgtgcatatcatgccaggctaattttttaatttctttttttttttttttttgtagagacagggtttcactctgttgcccaggctggtctcaaactcctggcctcaagtgatcctcctgactcagcttcccaaagtgctgggattacaggagtgagccactgtgctcggctgggtctttctcttgaaggaggaggggaagcagggaggtcactggaaaagaaccagggcaggatggtgtcagggaggagaaagactttcttgaagatgaaagggacaaacaatatttacaacaccgaagttcaggggaaaaaaagtcaactatttgagtagcaagaggccatgcattgcttatctttagagtgttgaaagaggatgtgggaataggtagaggaaggtggaaaatagtgaacgagctgtttaaaacttgtaatggcaatcctattgcaaataataactgataataggagttaatatttattctgtgcctactatgtgccaaatactgttccaaaggcgtatgtaactcatgtaaccacaaccttatgcggtagctactcttattatccctattttacagatgagaaaatcgaggcagtgagagagtaagaaatctgtccaaggtttcactgctattaagtgggaaagctgggattgaagcccaagcagtttggctgctgagctcatgcttaagagtctagaatatccaaagatttctttaaaaagtaatgactttgcaaaaatccacatttattcttctgatataaaatctcagatacattttcatagaaactgtcaagtgtacttaatgatcatctattcttctttaccaaaaaaagttgttttgagaaggaattagtttgttgtatatttcccatgtcagctttgacaggaaatattattatttaaaaaataatttaaattcaatttgaagtcttgaagaaaaatttactgcatttttaccggtaaccttactgagaaaactgaaatgatacattatggaccttagtaaatgtctccaaaaagaaagaaggctttctgtcttcatagcaaaacattttaataactatgcactgaaacaatgattttttttgtgtatcaaattcctttatgcctacaggctactcaattgaatgtcattagaatatctcaaagctattttcacatagtttgaaggctcgcccatctcctacacagtcacatgttgatttggaaaaaaaaaatatatagctgtgcatcatagagtatgggcagcatattggaatctaaggcttatagattgccagcctgctcagcgtctctaacccttttcaggtaaccaaatttattaatgccaatgtgtgctttcaaaagactgagaagtgattcttaaaatgttttcaccagggatatcacagagaggtttttaaataaaatagtactgtgacgttcaaaaacaaagacttctcaaaaagtatttatgtttttagaattggtaattagaacaggcagatttgaaggggataggcttgctttccatgtagacttatcaattaacaaaatcataactgagaatacagcttcattttatgaagagatataagggtataaatgtaaaggcaagaaaaaatgataaaagttgatcagagaaaaaaggaaatcaaaatgctgatttaaaagaaaagtgctttggagtacattcagtaatcgtttttatgaaatttttaaatgatgatgatgtcactggcatgcattggttctacgtacacacttaatgttagatttctagttaccttggaaactcaggattataatatgctgctacaacaataataactaatctcttttgaaagcttatcacatggtgctcatcatgttggagacgtcccatgtataattttatttaattcttacaaaagctgtaagtgttagataacctgttttctttatggaagtgatggagccattctttgttgtgtttggtagtgtctttattttaatttgtggacaagcttgataagtacataaagtgctttttttctggtaagatgattgctctttcagtttctctttcatgatatacaaaatacctttatataatgtattattttagtaacttgaaatttttccttcttccatcctatgttactgctttgttacatgccatgagaagaaaatttttaaaaatgttttcctcatattttctatgttgcttcttaatatctcacctttgaaatactagtcatttctgtcctagaaagctttctattaactaatgtggttagtcagagaagtgctactgaggggattatattatatttgcagctactgacttaccacaaactaaaaaatgctttgtcctttatctactattcctttatacttgacacgtagcactgtcttattttctctgtggtaggcacacaaccattcattcattcaacaaatatatattgagcatctactaaatgttaagcactggggatgcactggtgatccaaacaggcatcattaattcttgccttcatggatgattgcatgtgttgggccccagcacacctcccagactgtgaaaacacattggcaaactgtagacatcagctggtttgttttgcccaggatgaaaattactgagtgtcaaataataaaatcaagagaaaagaccatcccagtgtaatttgctccacctacaaatcttcacccacttaattaatcttttacaaatatatatgtatcttcattcaaaacaacactttggtctaaatggtgattggttccagaggatatggagcaaatatttagatcaattaacttgccactgattgtcatgtaacttctgatgagtaagatttttagctattgtggacaagagtcacagggtttgtaaaaatcttttggatgatagtagacaagggtcaagattcttagaaggtgcctttctattttattttggagtaaaaatattaaggggggaaaaaggaggaaatagtgtaagtaaacatggtaatattctgatactcttatcaattagaaatttttgttcagtctcatacatttactctaccctaaaaagaaagagagaaatgaatatttattgggtacctactatgtgccaggccatacactagggctcttatatgtcacttaatttaatttttacatccatcttatgaggttcagatgcttttattatgccccttttataaaaatagaactaaatttcatggaatttgagtaagttatataggattatccatgaataataagtagatttatgtttttgaacccaattctgactctaaattccattgtttccattagcagaattaataagtagatgctataaaacatcatcttggagctcacatattaccttggatattttggaagatgaatattgtttgctaactacttatggtaatcatatgtagccattcaacaataatttcctgtgctcatgttgtactatccatattgaaaagtatgtagctttagcactcatgctagtgacaatataattgtattctttgatattcttcatctcatttctattttaaagttatattccaaaataaccatgcattgcttttatagtaagagaataacagctttgaacagtgggaaactcagcctatacagccatattttgagaatggatactggaagcttgagaaaagtattcctccgagtgtagttctcctgggtaggaaccatattagaaagaagatcctggctggctactgcgttgttatatactctgtatttctgcccttcttatcaccttcctataaatgtatatctctaaagtaaggctggcagaagcagggagcaaatgaggtgcaacatgaacctgggttctagccaggtggacctgagttcaaatcccattgtctcatgtgctggttgagcaagttatttaatctccctgagtttcatttttcttacttgtctagtggacatcgtaattctcttgctggcttgtgagaaatagaaaagataatatattaaatatcaagagcagtatcacataaaactcattaaatggtatgtatgtgtaggatgaaatttgctcttggtttgagtgggttaagtgtttgaggtagccatggtgacagactatggttgccaacagtgggaggagtgatctagaccagagatgcttttctcatctttctttatgtaccctggcctctcacacaaccctctgatgctggcttccttcatagattcctaaaacatccaaagctctggcattcagattcggttgttatttttatatgtggtatatcttcaaagtgacactttaaagtgacaaaattaataagtgtttaaatcactcttattttgtgacagatcctgaaatccttgaaacagaaatccctcctgtcctctctgaatcttccatacatctagcataaagcatgcaaccatttacttaagaaatgtgtattgacctcctactatgtgacaggcactgcattaggtgctggggatacagcaggaaacaaaacaaatacatttcccatcacagtggcatttatgttccaactggggagccagacactaaataattcactgtatagtcatataatttgaaagcagtaaatacgatgtagaagtacaagtgctaagagagggtacaacaggaggttgtatctaacccatggagccagggaagccctctttaggtaatgattttataaagtgtgttgtgtgtcagaaattatgttaacctcatgatgtaaattaaaatattcaccatggaatctctgagtttcttagagctcagcagggcaaagaggaattaactagggagagagctgtgggagagcattcaaagcagagggagaagcatgccttacttaatcttactccattttaaaaagataacacaataagcccctcatcttgtcccaacctctaaaatttctaagtatgagaagaagggaaataactgttactgaacatatgtatgtgtcagacttctaaaataacatatgtcatgccattttaaccctaatggggtgagatattatctaaatattgcaaataagtagtctgattatgtcttggtttgctcaatatggttctatcccagggcaataatttataatgctccccttttcactcttgaaagcgtttcagtttgtgcgataaattctatggtcataaataaatgaagctcagagggattattaatttgccttgggttacacagctagtaagtgcagagggtgatgtgataccacatcggtgctctctgatctaaagcccatgctctcaactgtgtattgcacacacaatttgttggctctactcctgtgttcctctctatgtaattcttccaatcacggttaggtagcccaagactaaactgacaaaaattggctttctgacatctgccttcactaattctgctgagtcatgtatttctataaagtacaaatgaaaagaaatgaagcactaagattaaatatgaaacatgtatcgtaagtagtagttcttttcttggtatgcttatctttatacttacatttagcctattctttatgttgcccaagtatgtggaaactaatttaaaatgcagttgcttctgaaactcaatatgtgactctaatgacaaaacattggctatcattgttcttttctattatatgataccttgtgggctagggaggttcgtgacttgccctggtgagctgagcctgagtgtaagaagtttagcacttcttaaaataatcaattaaaccctcttatatttaaggcatcttaataacactttctaacacagtttttatcttggtcaaaactgagtaatacaggtaaatttttttttcagccgaatatgataaaagcttttgaaagcattcttcatatgtaaatatatcaaaagcatggaataggatgctattgcttccccttttattttaaacaaaaaatcagattatgccaaaatcatattataagtaaatattacattattttgttcctttatggaatatactgttacctcaaaagatgctggcatcactctgtctgcttaaaaacaagattttatgaagtatgtcatgtgttagaatttgtttcctttatgatatatgtaaaaatggttcactatggaatctctgaacatgttttattaaatagtattcccaactgtttgctacataccttattagtacctctttgaatatattttcaggtctttcagtcaatctatcattcatttattcaattcatattcctgtgccactgaatatgttgcttgtgcaactgctgttagcacaagtggatttatacttagtagaccggaaatatataccaccttccttccttgctttctaactcagagaacgtctcctgatcttcatctagctcattctgctctcttcccagccaagaccacaaatagaattttatttagtaattttgtggaaactcccttttttttcccccaaactgtcttcttttcttacattcatcaaatattatggctaaaagaaggctctgtggactgtgcagttcagcacttctgtcacactgtgagtgggatgacagtgtgcattatgaaaggaaagggttctgtggccaaataaatacgggaaaccacgggctaaacacagcttaaaaggccttttgactgtgagacacctccaaatataggatatggaatataccaattcctaaatttatttgaccacaaaaacccttgctcaccgtttgtcttgcaaggctgatattctaagaagggcacgttggataacgctgatctagaacctcattttataaacaaattgcccctgagaaaataagtgactcacccaagacctcacagctatttggtggaaaatcaggagaccagaacctatttttgctgcttctgacctaagcaactggacatttcacagccctgagaatcctgctgtctcttcctgcatgcatttgtggatatgacttacaagatggaatctgactgctgttacttgcgtcctgctcctttctttagcccgtatacgtttgactctttgtaagggctgtgaacgccagtgatttcctattccagtggaactaggaaagttgacattaggttgattccattttcttctgaacagtcaattcaaagtttaccaaaattgtctttttcattagaaaaaaataagtttatatgataaagagttcactttcagtcaaaaagttcattggacaagtatttattgaatgcctttacatgccacatactactctagttgctacagaaatagcagtaaccaaaacaaaatccttgccctcatggtgattaaaatccaatgaaggaaatcagggaagaaacaagcatcagaggttggtaagtcctttgaagaaaaataacatgggctaagacgggtagagagtgctggcaggggggcaggtgtgggattgcaattttatataaggtggtaagggatctttcactgttaatgtgatatttgggcagagacatgaggaaatgaaggcatggtaaccatcttgggaagaacattgtggagagtaggattagcatgttctagaaatacatgaaggtcattgtgtctggagttgaaggagaaaaggggagagtggtaggtgtaagatcattgggctataggttgttatgagaactgatactcttggtaacacaggaatctagtggagagttttgcctagagaagtaacatggcctgacttctgttttaaaaggtttactcttgctgctatatggaagatatgcagattgggttcccaggaagcaggctctgagatggagattagcatgcaaagtttattagggagtgctcccaggagcaatacctgtagatgggaaggaggcagagggagagactgggctacagagtggtctcaaagcctagctgacctcatgaggagctctggaatggattcctctctagagttgtttcaagctggagtgagggggccaggattttatatggatgcatcaactagccatccgatgtccctaagaaggcagagtgactttgggcaagaagttttttttttcttgaagaagactgacagctgaccacagttacagcactcccagcagctggggaatacgtccttcagcctgacagggatacggatggttcatcagaccatccatatggtgctcatcagagcatccactcaggagtcaaagtggaagcagaaagaccaattaggaggcaatgattcggaaagaagacgatggcaggttccgctactgggatgttagaagtagaagtagtgagatagattcattttttggatttattttgaagggacagccaataggatttactaatacattgatgagcgattctgaaaaaccaagaagaataatatgaactcattatttttagcctaagcaactagaaataggtagaaactgtctgaagaagtgaggaaaattttgggaggtggggaacaacttcaaaagaaatgcaattaattcagattcagatgtgctgatgttcagatatctatgagatgttccaataatgatgttaattgtgtgagtgaagtcatccagagaagccatccagtctggggaaataaattggaattcattggcttataaatgttatttacagctaagtaactggatgtgatcaccaaggaatgactcctgggctacttcaaagctgaggggtcagatggcacaaagcagacagaggagtgtccaggggataggaagaggactgaaaggaaatggattgcctgaaaccaagctaagaaagtaattcaacaaggagagagtgaaccacatacacttattcctaatggataaatgtttcttatcattgtctctgtgcctctttcaaattctaccctgtatagggcttattcattttttctgaatatcttgttaggtcaaacagtactttgaagcttttggtttactttaattaaggactactgatatctttttaaactaggaggacatactccaaggagaagagtaagcagtataactatatacctatagcagtatattacttataagttatagcggtatactactataagcagtaataacagaagtagaagtctgtgtccaatacagatgaggccaaatttagactgtaatggaatttcacatattgttgatgagatgtcaggattcactttaaatattgcacactcaattctgagcctgtgaatcgggttagtcctgattaggatctctggaatcacccattacctgagagacacggatacgaacacctaatgattcccatttttagaggaaaaagggctgagcagaagtgtcccagtgtttgccagaaataggacctaggagtgcaggagctaagagtgaaatctccccgaaaacaacctgacatgcattgcccatgcagtctgtgttcagcacgtgacttgtcatcctcctctgacttcattcactgctcccgtcacgagtgaaggtgtctctttaatgagactataagccatgctgagaacaggttccaagcctttattattttatgtcttcagagcttagaatcgtgactggcactcaatagatgtttattaagataaataaatgggacttctggtaccttctgttatcaagcctgaggcataaaaacagacaaatggatgtctgaatagccttggcagctggatctgtttaatcacttacatgtttcttggcaaacttgtggactaatctatttcttttttctcaaatttgtttcccatgtcaggaagaggattatttgttctgtattatttttttaaaagcaatatcttaagagtctttcagctgaaaggtattgcagtaatatccgtttagtaataagggtgacggatgcctgcttcagctatcatcaataatgccagattttaaagagaattttggattgtattcatctattgcaagctttgacaaactttgttttcctgtgaaaacaaaaaaaagattattcaacagagcagtttgtgtttgttagtgggagagagatcattaaaagtttgtgattataaaatgcttaagggtcttgggcagaccatagatgactttttgtctatagaaaagttgttgtaattagaggatagattctcttctcctctccactcaggtaatttatatgctcttttgtcatccaagactaggacccattttttgaccaggtgccatcactttctatttaaatacagaatggtttctatagaaattatccaaaatacatgtgctctttgaagctatatgtagttactatccagatggctgaagcatgctgttataatgcatgaccatttatgtgtttttaagtgaaaattatgacttctagtattataagaaatagtctataacagcaattattagttaataaaacaagggaaagaaaatggttagaggaaagttaccaataagacacagagaaaaatgtcaaaataataaattggttttcatgttgtaaaatgactcaagaaagaatctgagcagggaagagtaggggctgaagtattttctcttctaaatttgattatgccaacttgcataaatattgctttctgtttgtgggagagaatgagagaaagaaaagatcagagaggaaaggacagaatgagacatagaagaagagtttcatagcgtttgaatccacctggaataaactgattgaccactgacaaaaatctggactgtcacttcttcttggagaaccacactagaactttgcgataagagtgatctctaagatgtattgatactaccctttggtgttttgatttatatatataattttatgtcttcatatatatatatgtctttatatatataaatcaaaacaccaaagggtagtatcaataaatacatatatatttacatacatatatattcatatatatatgaatatttccatttctgttcttcactgaataaagctaaaacatcttaattcaagatctttgatgacctacatttaacctacttttttttgtcttacttgcctttattctcatttatgttatttataaaactagaaaacaacaatacccacaggagtaacgtgtattaagaatctgcctggcacagagctaagaatctgtggaaatcttacatgctgaatttaattgtaatcctcacaagaactctgtgaaatgagagctattctcatccacatttcacaggtgagaggactgagcctttaaaaagttcagtaacttgtctgagggcccacagccagtggatgatgtggctccagggtcctgtgctttatgacttactgctcttgctgtcccgataggtgccttcaatccagccctctctctttgcttgaaatacttgctattccatcccaccttcatagtttccctttccccgttcttctaagtgcagcccaaatgccaccatcttgaattactgccctccaggtggctgtaacatcgttctctgaaattcctctgtctttgctactcaaagtgtaacacaccagcagcagatctggggtgtggctcccagggcatctactaggagcttcttggaaatgcagaatctgaggccacatctcagatctccacacttagaaagtgcattttaacaagctccccaggggatttatgtgtgcagtagtttaagaagaactgcagtatagggctttcttttctttctttctttttctttctttctttcttccttccttccttccttccttccttccttccttccttccttccttcctttcgttttttctttttctttttttttttgacggagtctcgctgtgtcgcccaggctgtagtgcagtggcgcgatattggctcactgcaagctccgcctcccggattcatgccattctcctgcctcagcctcccgattagctgggactacagctgcccgccacaacgcccggctaattttttgtattttttagtagagacagggtttcaccatataagccagaatggtctcgatctcctgaccttgtggtccgcccgcctcggcctcccaaagtgctgggattacaggcatgagccacggcgcctggccagtatagggctttttcttgttttcttttttcactttgtatctttgttatttgtttacctgttttatattctcaaaccattagctttttgagggcaagaggcacttatattctcttttgagtatccataaatatgtgtaaaatagaagaaggctcatagttttttttataacacggcacttatattcagaaatttagatcatattctaggtctgtgttgtttggaatagttcctcccactgtgctaatagaatcacttatagcaattattttactcattatgtttccataatctcaggcttttgataacatcgaaaatgtgaagaggcataatctaggtttctaaaatagtaattccttcccatagcctttgatctatatctagtcctttggatacaacacttttcactgccaaagcacaaatgtagatattacagatttggagaaaaatcaatacttagaaaatagaagtactgaaagctgaagactccaatcaatttcacatatgaagttttaaggtttgtctgcagtcaggattctcactgtcttccaggaaccttggaatgaaattctgttttgacaaggatttgattccaagctttattttagaggtgattttgttaataacataacttcagtcactacagatgctcctgtattgttgcttacaatttatatactaaggataaagttactgatattttgaaataactgtgtgttttctagttctttatttggacacagtgtttgcatgtatttatacctctaaatgttctctatgagcatgaccaactgattattgagattggcaggtgctagcgcccttcaatcagcttctcattgctgcacaatctggcttttctcttcttttcacagaatatataattggaatacatgcatgaaaagaaaagagggaaaacacatatcagtggctttttttctttttctttttctttttttcacttctactgattccatttcagcagttagtatgacctctcataatgttccaaatctaaaaattgtcaaaacagaaatctactcttcggagctgacacaattcctcaattttggaatgactctgctttacctctttttagaatttcttctttctgcgtgagtgtgtgtgtgttgttttagtatgaggctcccttcccacctcagtcattggtttgctcgctcccttatgtgatgaatcaatgctttcagaacaggggcttctgagtgactgcgggaacaattacttccaaatgacctcgtgcatcttatcagggagcattcagaccacaccccaggtaaaaggaagtctttgcttaatgctttcagtaacttttaaaagcagtgtacggtgctggtggtatttgctgcaaggatgtgagggagagctgcccagtgaagataaatttgtatgtatattgaaatgaaatgctatcttcacttagagaaaagggtgagctgataaagacaaaactgctcattgggcaaagaaaatgctcaggattgcccttggcacagtgataatgtaagataccctgtaatgccttaacaggaggctagaggccatctgcgagtgtgggtgtcaacatctgaaggaagagaacttttagggaaatataagaaaggaaggcattacagcccaaaactgagcaaaggagctgttagcctgcgtggcatgcgggaaaacagtttctcaaattattaggctatccggtgagaagatgacgttcttagagattttgagcatttcaaagtgtatttagaaaaagattttaatccttttatctcatatttctatgactaaattagtttcccaaggatagaaactaagatatttaaataacattgacaactgaaagtgttaattggcaattaacaagtgcaatgctgttaacatgcatctgttgctgctttgtgtggaaaatggtttttcatcaccatagcaattcattcttaggctacattggaacttagccacagtatgcagtaaacagcaaatatttttttgttctctcctaaacaagggattaaatagtctactggctaatatgtggctctttatctgaatgttgcattgcatagttggtgtaatttcaaattcttttccaactgaaattccttgtgaatgagtattagatccttggtaagttaaggatgctaggtaaaggtggtgaaaagagctaatattgtactgttagcttaaaagcgaataccaaatgattgccctttttgtgattattcttctgaagatatgtatgtggacaggaatttatgtctgatcttgttattctccaacagtaactcaggaagatgaataagtctttagttttattagatttcctgtttctgtgttttctggaatcacatcatgtactggttcaactaaaataaaaaaaaattgtttccttacactggtgagaaaattttatgtaggatatggatgtttctttaggaaaatataacaataaattagaaagaaataggttttcttcttttcagttgcctttattgtcaggatgtggttatgtttagaaattttttaggcagtaccgttgtaaaagcataccttattcattgaagcatcagttttcattcatactttgtttctactttattcactgaaagttatagctgtcaacttttaaaaagttcatagcatgtgacataccagttgtggagctgtatttgtatcttagatacttaagtagcattgaattatacaaattgtgcaaggtgtttgaagaaataaattttcatcattatatatgctttagaaggtaaagctacttactgcttataatggttatatgtattttgtaaccatggggtgcttataatgaagactttcatatattattttttaaattttatttggatggaacataagatagacctatagtcatgacatggaaagataagggaaggcctagttacagaacctggggacaaagttgcaatttcacctctttactcctaaaggattatctttatttcttactcaaatgaaattatgggatggattatttgaactacttcagtaatttccttgccaaaaccactctcctttctatcatgatattgatgagattagttatgtgatgaaacagccctagaagataatacatctagaaggcctgttgtattacgtattgttgatagataagtgggctccttaaatctcacaagggatccttcctacaatataaagcactgatttattactttttgatgataaggtattttgacatggatacaatgaggaaataatgacacatatctttaaaggcgaaaagaatattgaaaattaaaagtttttaaaaccctgtcaatattcttgtctcacagttccttgatcttcacaagctcagtgcccttcctttcatatactcagtcttaatgccaaagcctggaatttagaatcatctggaattatcatacttctaattattaaattaataaactctcatatcatattatgaccccatccattctctcaaacagtcatcatagtatcaactctgtttcctgagcacagagacctctagttccttcaacttgagggttcttcctccttacctatacaaactgaactccatggtcaatcatttgctctactctcaccagtacccttaatttccttatacttgccacatcctgccaaaaccagcaaagcattccttgagagactatcgaacagccaagcaaattgcctcactgttcctggatttatatttggactggttcctcagtgtagactgtgagaaattttgtttctggtcagccctctttctgactactgtcagtgatgtttcagccttttaaaatcttccttaaaacgcccaggccaccttggctagttcttcctcagctggtggatcactcaatgttagagtctgtagggtttggccttaagcctcttatttttctatttgtgtttacatctttattgatctcatctagtctcctggttttaaatatcatctatgggttaacaaccctagtaattttatccccagcacagaatttcctgtaaacttgactcatactcacatttccacttggttgtatattgggcacacaaaatttgatcgttattctcaaaccagcttcaactattgtcttccccatttcagtgaataatatctcatttcttgcagttattcagttcaaaatttgtctacccatcttgatttttgtgtatctctcatattccacttccaatttttcaacaaattttaagttttgtctttaaaatgtagccagaatcttaacagttcttaccactattactgcagcaaactacattcaactcaccagtttttctcctatgggttattgcaatagacttatagcaagtcttcatagcatttatgaaaatagtactacatatgttgtttatttatttgtctactgtctgtttccctccactagaatataaactccatgagggtagggatttttgttcactgttatggcaccaacccctagaatagtgcctagcatttagtaggcatttaataatacctcattgaataaatgaaagtaagtagaaggcaaagtattacagtgagggttggttttactaggagcatagtagtaggactgaaggccataaaaaagggcagagatgcagatgtgtgaataaatgtggtgttgggggccttgaaaattcttttctgattgcttccgttaccttaacgaaataggaaacaaagtcatcagctccaagtgagaatgtgggagagatgttagaggtttgaagaaaggggaaaaagtgtgaaagagttttctaggccagtggaagagtgaatgggctatggaagtatagtacgattgttgggcagcattgaaaagccttcttgaggctcagagtggtaaatatgaagtgagatcagtaggtgtggttgtgtggtttcccccaggcatgtttaccttcctggttcagaaatagagtaggtaggggattagacttagtgagggctgtaatgtactcaaacaggatgatgatataaaggaggacaagggatttgaggggtatccaaaagagtaactgtggtcaacttggtttttgaagctggttaagaagacaaatgtaggaaaataattgtggaagaatcagtagatttaaatcatggtgaagttaaaaaatgttagagttggactactagggggatagtatggagcgataaaaagtgatggtcagagaatgaagaaacaaattacggaaggtttgcagctattgggcaaggctagggatgtgaggggcaaggaagaatagaggtcaaggaaatacaatattataaaaaatacccattgagatataatactgggtattatacaaagcattgggttaagaagcgtggcattgaaccagaaactgaatctttaaggaaagaagcatttaatacgggtgtggaaagatgactgcagctaagagagattgtgaagggtatagactgatgacatgagattcaaagctggaagtttttagacaagagagaagaatagtctggaagcagtaaagataagcaaggaggacacctattttacttccaggcccattggtgcaggagtgtgagagaaaacatttatcattgaaatagagtccttcagagagaaccatgttttagttataactagaaagtgaagggagtattttgaaaataagatacagatatgtaagatttttttaattgctcactgaattccagaaggtatacagtgaaaaggttttgagagttggagcagggtgcaagatgggaacagaactaggaatgtgcatagcatacaggaatggagggatgatacagagcctagggtttctcatgggcactgacatgaactgggttaaaaggcgtgctcataaggtcataaggtctgagcagttcaaggcataaaagggtggcagggattgaagggagagggagtgagagacttgccagggcatgtcatatttcttctgacaggggaatggaggtggcagggcagtgttactctgacaagaagggactgattttatcatgaaaattaattatatcaagagtgattgctcaataaaacaaagaattggtttttggaaagataaatttgacaaatctttagacaaataaatagaatcagagaataaaacggagacattataatttataccacagaaatacaaagtatcatagaacactactgtaaacaattatataccaaaaaattggataagcttccagaaattgataaactcttggacacatacaacctattgagaatgaattatgaagaacagaaaatctgaacagaacagtcatgaataagaaagttgaatcagcaataaaatatctccattgaagaaaggcccagacctgatggcttcactgctgaatcctaccaaacatttaaagaagaactaagaacatttctcctctaactatttcaaaaatattaaggaggaaggaatacttccaacctcattctatgagacttgcattaccctgatgccaaaaccagacaacaacacaacaagaaaagaaagctacaggccaatattcgtgatgaacatatatgcaaaaatttcaacaaagtgctagtaaactgaattcaagagcacattaaaaagattatttaccaagatcaagtgggatttatctcagggaggcaaggatggttcaacaaaatatgcaaatccataaatctgatacatcacattaactgaattaaagacataaaatgtatgattacttcaatagacgcagaaaagcatttgacaaaatttaacattccttcatgataaaagctctcaacaaattaggtatagacagaatgtacctcaacatgataaaggccctatatggcaaatccatagctaacatattgaatggggaaaagctgaaaggttttactctaagatttggaaaaaagacaaggatgccactctatttctgtcttttttttttttttttttttttgagatggagtccagctgtgttgcccaggctggagcacagtggccggtctaggctcactgcaacctctgcctcccaggttcatgctgttctcctgcctcagcctcccaagtagctgggactacaggcacccgccacgacgcctggctaattttttgtatttttagtagagaaggggtttcactgtgttagccaggatggtctcgatctcctgaccttgtgagccacccacctcagcctcccaaagtgctgggattacaggcgtgagccaccgtgcccggcccactctcactatttctattcctcacaggactggaagtcctagccacagcaattaggcaaaagaaagagataaaaggcatccaatttggaaaggaagcagttaaattgaccttgtttgcagatgacaggatcttatatataaaaaattttagggccgggtgtggtggctaacacctgtaatcccagcactttgggaggccgagatgggcggatcacgagatcaggagatcgacaccatcctggctaacatggtgaaaccccgtctctactaaaaatacaaaaagttagctgggcgtgttggcgggcgcctgtagtcccagctactcggaaggctgaagcaggagaatggcatgaacccgggagtggagcttgcagtgagccgagatcgtgccactgcactctaacctgggtgacagaatgagactctgtctcaaaacaacaacaacaacaacaacagcaacaacaacaacaacaacaacaacaaaaatcattgatgaaagaaaatgagaaaggcacaaataaatggaaagatatactgtgttcatgaattggaagaataagtgttgttaaaatgcctctaacaccccaagtgatctacagattcaacgcaactcctatcaaaataccaatgacattcttcacagaattaaaacataataaaattcttatggaactacacaagagcctgaataaccaaagcaatttgagcaacaagaacaaagctggagggatcacactgcctgaattcacagtatactactacaaagctatagtaaccaaaatagcatgatgctggcgtaaaaaccaacacatggaccaatggaactgagagttccagctgagagtccagaaataaatccacacacttacagccaactgatgtttgataaaggtgccaagaacacacaatggggaaaagtcagtctcttcaataagtggtattgggaaaatgggtttccacatgcagaagaatgaaactggacctctgtctttaaccatatacaaaacattttaaacacttaaatgtaagaccagaaactatgaaactgctagaagaaaacatagcgggaaagttctatgacattggtctgtgcaataattttttggatatgacttcaaaagtataagcaaaaaaagcaaaaattgataaataggattttagcaaactaaaaagcttctgtacagcaagggaaacaatcaacagagtgaggagacaacctacagaatgggagaaaatatttgtaaattatacatctgataaagggttagtaaccaaaaaatattaaaaaaacctcaaacaactcaatagcaagacaacaatccaattaaaaaacaggcaatacatctgaatagacatctctcaaaagacacacaaatggccaacaggtatatggccaataggtatgaatgaaaatgatgctcataatgaaaaagatgctcattgttgctaatcatcaggaaaatgccaatgaaaacagtgagatattacctccctcctgttagaatggctattatcagaaaaacaaagcataagtgttggtgagaatgtaagaaaagggaacacttacacacattggtgagagtgttcattggtacattcattgtggaaacggtatggaggttcctcaaaatattaaaaatacaactaccatatgatctagcaatcccattactgggcatatagccaaacgaaatgaaataagtatatggaagagataactgcactcttatgttattacagcagtatccacagtaactaagatatagaattaaactaggtttctatcaatggatgaatggatagagaaaatgtagtacatatacacagtggaatactattcagctatgaaaagaatggaattctgtcatttgcaacagcacagatgaacatggatgttatgttaagtggaataagccagttatagaaagacaaatactgcatgatctcactcatatgtagaatttttaaaaagttgatctaatagaagtaacgagtaaaatagtggttaccagaggctgtggttggtaggagggaggggacttgaggagatgttggtcaaaatatatataattacagttagatagaagaaataagttcacaagatctattgtacagcatggtgactatagttaatgacaatatattgtattcttgaaaaatgcaaagataatagatgttaagtgttctcaccaaaaaaatgataattacgtgaggaactgtatttgttaattaactagatttaactattccaagagtatatatatttcacaacatcatgttgtacatgataaatacatacagttttatctacaacaaaagtggttctcatcatcttcccactctttccatttccaccactttaccacgtttgtgagctcttctacatcttagtctattttctccagtctcaaaggagagcatgttccttttgttgttgctgtaacttatttcacctgcttccttcagggttttgctcccctttccttctctactctcacccatcccctagtatatagatatgttcagttcattataaaacaaacaaaagcaccctgttgactctaatttgctctctaattactctcaacctctctttgtacttctcatgcaaacttcttaaaagagaaatctacagtactgtcttctctttctccctttccatttagtcctcaacttatgcttttggctttttattcttgtgtctaggcttgcgacttcttttttttattttttttttttgagacggagtctcgctctgtcgccaaggctggagtgcagtggcacgatctcggctcactgcaagctccgcctcctgggttcacgccattctcctgcttcagcctcctgagtagctgagactacaggcgcctgccaccacgcccggctcatttttttttgtatttttaatagagatggggtttcaccatgttagccaggctggtttcaaacccctgatctcaggtgatccgcccgccttggcctcccaaagtgctgggattacaggcaggagccaccgctcccggctggtttgtgacttttaaaactagattttatctatctacaattctaatatgactatgtcatttttcaatcaacaatgttaacagaacaaagtccaagcttgatacactctccactgctgctactttccatgctttcactcatctccttttctcagcttgggatctccctatcctccttttcaactggacttaaatttcaggtactacctattatgaagcttcatgggttgggtaggcacccttcatcactgttcccttagtagtcttatcttttttctgcttgtgagtagtctactgactgtttcctgttcaccgttgtttccctacctcctgagtacctgtcacacagcaaatacttcatacaattatttttgaaaaagtgaagaataaatgaaggagaaggtatatctttaagagtagcattggtattctgataggcatactttcaactttaaatttgtattttggcattcttgctaacgataaatgtggggattttcttgcatgcttattgattatgagttaataaattgaaccggctaacccagggttagatggatgaaagccagttttgaaacagaacagatgatgagtttgtgatgaccccactgaggcagaaatgctctgtgagattccagctgatcagcttgccaacctgctgttttatgccatcccctacaacaggatcttccctgggtggtattgttttctctggtaaataatatcataaaaaaggttctgattctttataaccatttttataggtgtttactttggcagccatatacatgatcacaggacaataggcaattcatcaaaataaatgagataaatatcatgtcatatggagaataaaggcaagataaacctttgacaaggctgaaagtctaattaactacatgtctcataggtctctgctggtggttctgaagccaaacctctgatcttcacatttgtccccactgtcagaagactaccaacccatactcagttggctgacacctctaaattccttgttaaaattccagaagaatcaagtgataagagtccagaaactgtaaatagggtaggattatttttattcttttttaatttcaaacaattatattaaattttgataatgatgacttggaaatttgtgtatatttcctgtgcttaaattaaggtgactgtgactctaagtttgactaaaaatataataatgcaacagaagcataaatgttatcaaattgcatgttctctctaatgcattatcttcaatttttttcagtttgacatcctattgtttgctattgacatgacaaattctgcctcctggcacattctctcaaatgtttcttaagaaaataaaaacaaaatttaaaaatgtttaaatttatctcaaaagaaaatataagacaaaacagtgagatattattatttacaggtaatgaattagcaacattaaaaaatgtaatacctgatgttgggaaagttgtggaaatattggcatgcttacactttgctgctggttttgtaaatttatacaattttggtggaaatactttatctatagttataaaactgtttataacctttcaataatctaactctttgaaaagtatcccaaggaaatattacaaaagaagaaaaatgttatgtaggtaaataattagggaaaaataaaaaatgcctaatatctaacaatcagaaaagttaagaatataatagtacctcactttggcaaagttatactgatggtaattagataattccatggaaaatgttaaccttacaatattaggtgatataatactgtgttcatatcttgattgtacctatctaaaatgagaccaagatgggaagtgaaattacacaaatttaaaaatcttgaaaataacttgtgttagaataacaaaattttgagtaaaaatgtttttctctttaaaatgtgttttaacattgcttacttataaataaaatgagattggggcaactttgtgttattcttgacacaattagaaaggagtaaaataatcagattcaccttgtctacaagaaaacatcttatctagaaaatagtaatatttccatgatcctggggttttcaatgctgctatcttctttcaaagactaatggggccatgaatactatatatggcacttctagatagtttctttcctacagcactcatttacataatattaatgagatcctttgtaattaggccttatgagtggtgtgagactgtagctacataaaccaaccttggttgcaagcctccagagcttcctaagatgataatatttatctgctgattgcaatgatatatatacaaccacatctttaaaagatttttcaccctatctcttagacagttcaacattaaaatagtgtaattcctcattcatttatattcttttttttttttttgagacggagtctcgctctgtcgcccaggctagagtgcagtggcgcgatctcggctcactgcaagctccgcctcccgggttcactccattctcctgcctcagcctcccgaatagctgggactataggcgcctctgccaccgcgcccggctaattttttttgtatttttagtagagacggggtttaaccttgttagccaggatgatctcgatctcctgacctcgtgatccgccctcctcggcctcccaaagtgctgggattacaggcttgagccaccgcgcccggcttcatttatattcttagcaactgtttactgaacatatgttattctcttgatgattggattccaactgaataaagacaattcatatagcttacttgttatcgggaaggcaggcaatgaaaaaaatgaaaaaagtatgtaataaaatccatatagtgataaatacaatgaaaacaatatcagagtaaatagggaaagatgggcagagaaattttaatcagaggcaatttgtgttttatcctgactatatcctcattatcagctgaataatgtgggtgtataaaatcaactttttagttatatttaatcagtgatttgacttctgtcttcatacatacaatacatgcacacacagtacacattaaattgaccaccagagttgaaattattagcatattttcatttagtggcataactctctattttgaaataattttagccttacagaaaagctgcagagaaaagaataatagtaaccatagtgtaataataaaaataagaaaattaacattgggtcttttaaacacaatctcagtatacatggctgtcatagttttagaaaaagaagtttggtagcttgataaagctatcttgatcctggtcttgtaaactatgtattcacagaaaattggatgggaaaagactgagaattacaaatccaaaataaaacagtgaaagatgctttgtactaaaaatatctgcatcttttttggtgttctatttatgagttctccctaattaacttagattgttttgtctgactatgcattttgcccaattttatttttcctttcagatttttagagagattttgtattattttagaaactttcaatggggatttccttcctcccttggcttttaaaggatatacagtttgcttcaccattaactaaacccttgcccaatccccatttgtttcacaaatgtcttcacggaaaacattgctctctccctctctctctttaaaatgtcgtatcatgacttacttgaaaacagttaggtttgcctgttgatgttgattactatcccaaaattgtttgggcttagaccaggaaaaacaggtgggctagtgggctagtaaaaataaactgctaacttcaacccaatctctttcttatgtcaacctaatttaatatatttttgaaaatataaggaggttaagcttttcagtgtacatgccaaaaaagaagcatttattaaactaatgtcaatgcttttatctctctacatctattacagtctaaatccaatgactacttgaccttgaatgctgggagccaacaagagagagaccaagcgaaattgacttgtccttcagaggtcagtggaacgattttacaagaaagggaattcgaagcaaacaaacttcaagggatgcagcaaagtgacctcttcaaagctgaatatgtccttattgtggactccgaaggggaagatgaggctgcaagcagaaaagttgaacaaggccccccaggggggattggcaccgcagctgtccggcccaagtctctagctatctcgtccagtctggtctctgatgtagtgcgtcccaaaacacaggggactgatctcaagacctcatcacatcctgaaatgcttcatgggatggcccctcagcaaaagcatgggcaggtaggttttgtgttcctgctgtccataaggaaaaaaaaagcgtttatgcaccctttgtcttgggcggtctgcaaaggccatcctgtttaaggcagacaaaactttcaaagaaaaatatatttaaaaaaccattatctcagggtaataaatcatcatagtgtaaacacagataataaatatataagataaaaaggattaagcaattatgctgtgaattggctgaagagaaaatgtaaaacatttagctggagtaaatttgggagaatactacctctttcctttaaataattcttggagaaggttgatatgaggagtttctttagtcaagaagagtgtgcttggtgagctgggtccatcaagaagcatatttcagacgtaagaaagatctagtgaaaagacggtaattggacattagaggtagacccattgattttaaattagtaaaagactagtaaaaggataaactaggaaataagagtaagaaaaataattttcccctgtgtatcctaaggaaaacatcttttgtggtcctggaagccacaaggctggggttgacctcagtgagagggggaaaatataccaccccaaaacttagtggcaagattgaatggttcttttaaggtagagagagtctggtacaataggagaagacccacatctgtgatggcaggaaagaaaggatgcggacaaggaggcattttgaagttgaaaaatagaataatttgccattgactggctatttgctataatgaaaatgtaaggtgactgacgaagtgtagttagaatgttaggaatgcagacgctggctttgagagtaggtaggtagtggatgcagagctctaacttcttgacaatgaccacgaattgttacccagatgtcccatttaggatctaatagaccaggcatttgcaatcaacccaaagtagtttaaaggacatttttactggcgtgttggtctttttgcattactaggacaggaccaatgcaaaatggtagaatgagcattggagttttggtgccacaccatctttatttctgtaggcttcactgagtttctgatgctgcatttttattatcttcaagcatctagtatcttgtattgtcttctggtagtaaaagacacacactgcggtactcacatttttactgggctaaaacatttatttcttcttgaagttcgttcttagctaggtattggaacaaaatattataatcatataattaaatgtattcccaatatgctgtgataggtttaaatatttctttcttgcctcagaaaagataatgaaatagttggagatgtagaaatgtggaaatttccattgttaggggaggacagctttaggtgacttctctgagaagaaaatgtattaataaaaaattaacaaagcaattgttgggtctttgatttactctttctccaactgatagttttttcccctgaattggccatttatttttatttttgtgtgttcaaatatacagaagtgaatctagagactgaatatgtcctttaaaatattttttccaaaaaaggttatttaggagcaggttatagttcatgttattagagctctaaataaaaaagcagagctcaacctcatatattaattgtggctgaagattatgattaccagtagtggtggaatactagatcctaaagtgtttgaccaattaccaattatttgaacaattaccattgctcttgtttccatttcctataataatccacttgagtgaactgtaggtcatcatgaaataaaaataagatgaccattgccacaagtgtaaactaaggagaaatgaccagagcaccaaagaaagcagtctggaagtttaatatagtgaactgtaatgtacaaagtctaaaaaaaaattacacgattgggctgcttgatgccaacaatatcaaatttttaatcagaaatacagtcaagtaagtaaatttctagtctacctggtgaaaatgaatccatatatagaattgtctgtaaattacctctattggttagtcattgataagctattcctaagaaatgtcttcacttcttagtctggcctttaacctttccatgacctagcctaggtgtctttttctatctacatcttttacctctcttcttcagctctcctgaacaatcaccaaagtacatacttcataccttcccatctctgagcccttgattcctctggtcaaatgcttccttctttccctagctcttctccattttgacctaggctacttgataatttaagctcagttcaagtagcatctcctcttaaagatgttccctttggaaaggagttagttcttgttcatgtttgtgattttctttattattttatagcttttagtgggggaaaaaattctccattataattccttttcattctgttgtaataatttacttttatcttttttcctcactggctgaaaactacattaaatcaagttctggtcccttgttaatttctgtatccctagcacttaatgcagtgccttacatataaagggggttcaataaggtgagtgaaaaaaatgaaatattcaaaagattgcatatcttttcaactgtgaagtccttgctcagatattgacaccttcatgaagctgttttgttctctcagtgaaagcaatctctctcccaacattattctgatagctttttttctgtacctattttataattatcataggcagtactatagctatttagatacatgtcttatctcccctaagagattgtaaagtttttacaggtaaagcccatgttaaattcagttttattaaactttttgtcccctacagtggttagcatattatcagggacatagtcaatataaatattgggttgaatgataaactccccaagtgcttcctgaagtggcatgtttaagtaaaagtatcttacgttaaaaaaatcactcaataatttcaaagcatgtcaaaagtaaacatgttatgtaaaataagctgttgaatcaaaatcctcttaaataaaattcagaaaaaagagacttgaatgttcatgtaaaagtctaagaattttctaggggtagtattagagttacgggagaggtgaatacacatacaacacagtgattcgtctgaaagacctatgataaagtttggagctaagatagtgactgtgggaatagacagagagcctgatgaggtagaattagctgaacttgttcattgacaatatatgggaaaaattaagcatgaatgaagtttattacctcattggatgaatgttggcatcattaattgaagaatgaataacaggtcttgggtggggatgggaagagattagacatctgatgttgagtttgagatgccttggtggcactatatgatgatatctagaaagaagttggaagtatgaatcctggacataggagagagaagggagactggagatattcgtcatataaattaaagtgatgggaatttactcagggagagaaggtaaaagtaggaagacaggattcaagccaggaaacagaaaagtataaaagcacctatgaaaaaagagagccaatgagaaacctaggtgtctttttctatctaagaggtgaatcaaagatgtctgagagagtggttttatgcagtggaaactaatgagactttccaaaaagaggagtctatagtagaatataaaacaaggtaaaataaagtaggacccctgagtccattaaatcttgaaataaggaggtcatttggtgaccttggtgggaacagtgtgagcgagattatggggacagaaatcagtttgagaaatggatggaggtaaggaaaaggaggtcatgcattggaggggtgatgtgggaaaaccaaaatgagatgggcaattgactggctatgttcctctgggtgagttacttgaaatcataaacctcagttttctcatttgtaaaatgagttgataatatatcaaccttccttgtgaagattaaatgagataatacatgtaaagtgcctagaatagtgcctggccagtggtaggctctcaataaatgatttactgtatctaagaagtctgagatggcagcattgtttttttttggagggggggcacaaagtcaggaacatgtggagaaggagagtttcacacctttttcaaatgtagctcagaagtaagaactggggagaggaatgtggaacatgaaaataagaccaaaagaactgactggggctaaataatgcaggtcctgacatgaaattctgaggaatttggacactagcatatatgtttattaaataactagatttcatggattcatagaaaagggattacagtaagttatttggatggggcattagacatagaaaccctccatatacccccaggcctcaactttataatgaaataccctattcataccagcatacttattacaatagccttcatgtgtctgtcttaccccactagattcctgaaccccttgaacttgacaaaaaatatttttctcacttctgcttcccatcacctaatacaatgcctggaatactgtgggtgcttaaaaagtgtctgatgaatgaatgaataaatgaatgaatgatcctccttttcacatgatcttctgatataaatagagaatagacattacctaaaccctcttagtgagcattcaaagctgaaagaaaatgataatagagtatggaagagcacctaggactcctgccttagagttagtgctgttgctcttacttaagcaaataatctatagcttctgacccgagagatttagaggttgaaaaccttgaaagaagctgggaggttaaacgttcatgttggattcagctaactgctggaggactagcttggaatgccaaagtacttgctgaaaattggcacatttatattaagaagctgggaggtgaagtgttcatggccatcagctggatggctctttgaatgcagaacagagccacctggggcctgactgtgcaagaataggtgagaggtgactaagtagtaattcagattctacatgggccttcttggtcatataattgttttgggcagttgggtaggattaaaaatttagaggccctacattcttttaggcaatggacaaatccctgaccaagtgatttttttttaaataacttttctccagtgatcttcccactgctacctctccatttcgtttcgtgcttagggtgagtacatgattccctctttttatcttgttacctttcatagtgaatgagactagatgcacttaggagaatttttatgaatcagtgagaagctccaggctctgctctgatgctggcagaatccctatagtccctgaatggtagcttgttatttcctctgggtgggttaatttgtaccattaaccaggtacaaaggaagaacatatctggaaaatcaagtcgctgtgacaattccagcagaaagatgatgtaggcttttaagaagagagtctcctgacttgttgatgtcagaacttaagaacttgttgatgtcagaacttggctggggaggtaacgactgaatcagaggtcagaggcaatgttcttcctaccacctgcccatcctcactgcccagagtctagagcagaataagagggggcaattgctgagggaggggttagaccctcttcaaggagaaactatgtttccgcttctgcatccttctgttccttcatctgctagacattttatttatttattttttattcctgtatgaaggtagtaggctaggcactagacactaggggtacatagacatatgatctgcctttaaggaatttaaaaagtgtatgtgcatgctcagaaaaaaaagtgtattaggttgcatgttcagaaaagtgggaagcctacggggaggatgcctaagtcagcctggagcatcagaaagggttcacagaggcagtgttgctgaaatttgaaggatgaatacatttttggcattccagaaaggtaatagggaaggaagtatcagcacataagaacagggtggaagatgagaagaaatatgaaaaggactcatcaaaagataggaaatacactaggaaagagtaatgaaatagaggccataaataaaagttttgaaaaggagtgagagattagaagagtcaaactctgaaaagaaatcagaaaaggtaagcgattcaagtgcctgttgggtttaggaaaaataaaccattgtagatgttagtgataacagttttccatgtaagggtggagaagaaatctgttaagaagttagtgggaagtgaattagttttccgttgtacaatagcttaccacaaatgtagtggcttcacaaatttacctatttctcctggtttctgtagatcagatgtctggatatgtctgagccatgttctttgctcagggtctctcaccaggttgaaatcaaggtgtcagtcaggttggcagaatttatttccttgaggctgtggaattcatggcagcttgcctcttaaagccagcaacagagaaaaagtatctctgctgctttgagtctctaattccaaagacctttttttaatttttattttttttaaagagctcacttgattaggtcacacccacgcaggataaacctcccttttaattaacttaaagtaacctgattagggacctttgttacatttgaaaaattccttcacctctgtcatattctatcagttagaagcaagtaaccgtttccacccacacttaaaaggaaggaattctataaggctgggactctttgggtagtcattttagggtgtgcagactacaagaaataagaaactcagtgcagtgattatattgtacagacttgactgagaagaaaacaacataggcctgtaattatgggaaatataggatcaagaaagagcttgggatatgtatgtatatattcgtttttgtcagttagcttttgttgcttaacaaaccatgccagcatttagtgttttaaaacacaatattttatttagctcaaaaattttttggtcaataatttgggctgttttcagctaggtggttctgcagatatgggctggattcagttaatctttactgtgacctacccatgtcagtgattggctgttgggttagctggtggctggttagctgtctggtggctgagtagttgtgtgctgagacgtggtcttgtatcttccagtaaactagcctgagctcattcatattatggcaatgttctgcacgtaacaagccagtaagcctcaatgcacaaatgtttttcaagatactgcttcttgtattgcatctgataatgttgtatgggccaaaacaagtcatttggctatccagattaaaaggtggaacaaaagactgcgtttatgatggaatgaatgggaaagaacagagaattgtgggtactttcactattcaccacaatgatatttattatcatgtttttaaaagattgagagaatttctgttttatatctatgttaggatcagggagctaggaaaaaattaaaaaggataagtacataggttatggggaataactgatgaaatgagatttctaagagggcaagagctgctgtgattcagagtacacaaggagaattcaccttttacaaagcgaaagtttttttcattcatctttccttagaatgagggaaagggaatgaagatgatactaccaaaattcactttcctggtaatctcaattttccttggagtaaagaaatctaggccatctgttgagcataatgggagaaatagtaggttaagggtttgtggagaatgtaaagtttttggaaaagctgttcatcagaacagtagaggaagccaaggtccaaacaacaacaacaaaaaagaaaacacaaatcaaccaaccaaaaaatcgagaggtgcaggacccagctgagactatagacattgaacttgtgctttcaccagtctacagtgactcagccagcccatatgtgaattgagaaaacctccccttctgcaggggaattcagtgcaggggaaaccagccccactcagcttgcgcccttgtacaggatggtttgcaaaataggtgctgtggtcctattaaaaagtggtatcaattttctttttcttatagcaacttttggtagactaggtctagaaacataatggcagttgctgggattggtttaagaatgaaggtttgctaagttgattggcaagagaggattggcaagaaaccacaatagctagaatgttggcaatgctggcaagaaggttgagattgaacaaagtattactgaaacttaaaaaataggggatgaggggtgtgagactggatagcaagagaggggcttcgtcatgaaggaagtatctgtagttcatggtagacacaaagaaaccagtgatgaggtcttgagcataggtgatcagattttaaaagttcaatctggtgataggttaaataggctgcaactacaagtaagaacaccagaaaagattatttaatgtgttcaggtaagaaaggctgagaatcttccctgtagcattacaagcattcatcagagagaagaggacaaatcaataatagctaagtttaggaggccgagctgccattatgcaatgattggtatgtgacgacaagggagaatctggggtttctgcctcatgtagctgtacagattcaggaggaagagcacaactatatacgatccacatctggtgctgtcagaatctcagaaagtattcaagatactaggtagcagatcagtcacttcagtttttattcaaatgctttgaaatctcatagaaacatcagggaaaattgaatatatatacaggagcagtttattttagatttacaggcagtaaaaatacaaggcagttctacaatagagattggttgttaaaataattgatggtctctattacataggatctgagggtgaatttatgattaggatcatctacttacctaatgataggagcacatttcatcttctgttactgagattattgtgaatgttttccagagttccagatagcctttctaggagaagagagttttgaaaatgactttagagagagtgtatggcaaggggggctcagggaaccagcatagttctgggtattggaaaacatggtcattggtagctctagagaggtgtttgaagcaaaggaatcaataaagatgaggtaagaaataaatggtaaagaaaacctagaacagccttgagggagaaggagttagagcatcagtaacaaaccttgagaacaacatagagggttatgaatggtagaggaagaagagatggaaataatttgtgttaaatagatgccaatagggaagtttgggatcactaataagggatttacaggaagaggtaaaatgaaggactgattctgagctactgactgagaatttgacaggtgcccatgtattctttctgcatacatattttcatgcctttacttcctctttttaaaaatttattaattagagaaactcaggaaaatcaatctttttataaaaaaagaatccttcacccctgagaattttataaaatatggtgtcacatttttatattggtacaaattaggatacatcgtggcatatttgcaagttagaaaggaatatgttgcatatacttattaatatattaagaaaatataataaaaattatgtgcagattaatataaacatggtaaacatctttagacttttcagagcctttctcttagaagttccttaaaaatcaatgttttaaatatattaaaaagtataataaaattctgagatatttatattaggtaaaatattaattaatgtagtagaatgtttggtcattagaagccatagttttgaggaaattggagaggttagtcttttcctctgaatgagaccctaacagttacagctctatggtcttagcatagtgataatttggtgaataatcaatcagggtaaataactgagtttgtcatatacattaaagttatttggaaacagcagaactgaaaaggtaatgagagttttgtgactgctgttattaatttacagaattctttaccaaacagctattccaggcatagtacaacatgcaaagacacactacacagtctagaaatgtttctatattcttttcattaggagagatcaatcataggaaacaattagagaagacttttctttgtggtaaaaaaaaaaattccctggatacactatttaccctaaaagaacaatttcttaaacattaattatgtatttaactaaaatgattgcataactccaaataagacattgtcatgcttgtagtgacagaaacattcagctgcccagctagtagtgtttggatttaaatatatctctaaccaaatgcatcagttacataaacattggctaagcagagttgtttctaaataaaacttatacgagtgaattgctaagctttcttcttccatttgattcaattctgcttgacttttaattatctctgattttcccatattctgggttacgccaatatattcaggtgttatttatgtagcaagaattcttccgtgttgcaaagatacaaattcacatataaaagaaaagaatattttgggtatgtttacttagaaacttggaagtttgggatgagtgtttgaatttgccagttttaaatatttttagagattaaaactatatgacatgaaaacctctgcattaggtctgatggaaatcttaaaatgttataagcaaaatcaagaaatatcttttactttatttgtaaagttttgctaagtttgattgttatgtttatatacattttcctgctatgtgcttaatgaatatctatatgtaaatcttaatatttattgatattttgaatgattgatattccctaaattctttattagacatgcatgtttattatttcttttatatattgacataatcaaatcaatgacttttaagggaaagttctgtttaaaaggtgttcaaagtatttataacttcagtgcttatcttaaagtactagatgatttttaaaatggcacaagactacctacatccagttgtttcacaggctctccctagcttctcttgtaaaatgatgaattgttctttatttcctctttatttggtttctttatttcctctttatttggattggtgggtttccttgtttcaggtggattgtatttgtaaagtgttcgggcttcttttgacacaaaagagagcctatttcttccagcatgacccaaatcatttgttaaatgttcattatatgttcatgttaaatgttcattctggcaaataattaggaaaaataagctaaaacttcctgtttaatttggactttgctttcactctctcaatttatcattctgtgttgacattgggtgtttcatcatttgaattccaggcacttttccaagttcacagcatgtaggagttaagtagtagaaactctcagaattttaaacacttgaagtgtgttaaagtttttttaagacttgtagtcgttattataatatcatcctttatattcttacaatagaagaaaataattttccaaagtgaaatttgcaatttatactgatggtgatttaaatctttccaaatcacacaattcaaaattaagataactattttagatgctgtcaacgaattatcttccaactatgcaatacaattttacattgatttcattctgtgggataaatgaggtataggatgtaatgcttcacagcttatttgtatcttatttcgaattcagagcaaggcctcattagcaaaatagaatttccttcatttttgtggaggtttaagatgcctccttttgtgtaaattgtttgtataatcgcacaagtgacaagaatattttgatcgtttcacaaataatgtcctatttcaatctgtctatttctctttcctctagttaacttcttctcccactacctctgagcagcttgcctgtaaaccacctgctttctcctttgtttctccaactaatccgaacacaccacccgacccagttaacctcgagggagcctctgtcctagaggagttccacactaggaggctggatgtcggtggggccgtggtggaagaatcagctacgtattttcaaactaccgctcactctacacccttttctgcatcgaagggcacctcctcgacgttactgtttccccattccactcaactatcaggttctaatttacccagttcaactgcagcagatccaaagcctggactgacctctgaagttctcaagaagacaactttaacctcgcatgtccttagtcacggagaaagtccgagaacctcttcttctccaccgtcctccagtgcttctctgaagtcgaattcggcctcgtacataccagtccgcattgtcacgcattcactctctccgagccccaaaccatttacctcctctttccacggctcttcttccaccatctgcagccaaatgtcatctagtggaaatctttcaaagtcaggggtaaaatccccggtgccttcccggcttgcccttctcactgccattctcaagtcaaacccttcccaccaaagacccttttcccctgcatcctgtcccaccttctctctcaactccccggcctcttccacgctcacacttgaccaaaaagaaaagcagaccccacccacgcctaaaaaatctctctcaagttgttccctgagagccgggtcaccagatcaaggggaactccaggtttctgaattgacccagcaatcttttcacctgcctgttttcaccaagtctactccgctttctcaggcgccctccctctctcctacaaaacaggctagtagcagccttgcttccatgaatgtagagagaacaccatcacctactttgaagagcaataccatgctctccctgctacaaaccagtacatccagttctgtgggtcttcctcctgttccaccaagctcttctctttcctctttgaagagtaaacaggatggtgacctcaggggtccagaaaaccccagaaacattcacacgtacccttctacattagcctcctctgcattatcttctctatctcctcctattaatcaaagagctacgttctcttcttcagagaaatgtttccatccttccccagctctttcaagcctgataaacagatctaaaagagcatcatcccaactatctggccaggagctgaatccttcagctcttccttcactccctgtctccagtgctgactttgcctctcttcccaacttgaggtcctcctctctccctcatgccaatctgcccaccctggtgccccagctcagtccctcagctctgcacccacattgcggcagtggtaccttgccttcaagacttgggaaatctgaaagcaccacccccaaccacaggtcacctgtttcaaccccatcacttcccatatctctaacaaggacagaggagctgatttcaccttgtgcattgtccatgtcaacaggcccagaaaataagaaatcaaaggtattttttgcatgttgcatggtgcatgcttattttgaaacagggaagaatcttttttttttccccaaggcagaaatcaataattatagtattaattgtactcctacaaggaggaagaaaaagtgcaagacggtaccaggacttggtatatttgaatgtgtaaatgaattataatctgtatagaattatgtgtttcagtcaaatcctttgattttgaaaatcctctttctcttcctaacttcttatatctatgactccaagggtattatttttcctcagacataatatgagttatatcattggccctaatgacagaattaaaagcaagtagtagagattcaggactatgatatgtttctgattgtttattaacagggaccctagcatccatccaaatatcctgtactgatggaatagtagacaggattaatataaaatggaatattatcttagatctaggcctgtgacatagccaagcacgttctcgtagcagaaagcaactctacactaaggcatgctggcttcccaactattctcaagtaattcagattgtggatcacccatacccagaatttgatagctgttatatcaataaaacaaaacagttaaagtgcctgcataagaaggggtggtgattttcagctcagcacattgaaataatgtagttttagagctttgaaataccatggagagtatgtttcactgtcacttttcagatgatgaatgtcacgttgaagggataaagtgaccctcattatcttgtaaatgatgtcacaaaacaattcaagtcaaaaacatgcattaaatacctgctatatgtgtaccactatactagctttctttagagtgtgtgtggtttcttttaaagggaagtaagagattttttttgtcttagaataattcaattttaatcagtagaaaaaaatatacacaatttggagaggctatatacagttattaaatctacagtacagctagaaaaccaatataaggcaaaattaattgtgtaagtcagattataaataatcatcaactgagttcaatataacaggagtaatgtgatggaacatggttagtaagggaagttataaaaaatgtcaggcctgtcggaaatatttaggatttaacttaatgaagaggaaagaagttggcatttcagaaatggaaaacaatctgaccaaatatacagaagatgatctcagaagtctgtgtgtggagacataagacgattagccttataatctgacggtaataatagcagcaatatcaaatgctttctgtgagtcaggaactatgctagtatacaaaatagttgaaaaattaattaaaatggattacatcagttaagttttgtaactatatgaagttgataatactattttccctattttgtacaccaaaaaactgaagttcagtgaataattgtccaggtaatgggtctgtttcggagctgacatttatgtaatgttaagtctgttgattcttgaagccatgttctttattactatcatttattgctacaaagaaataactcatgttagcaatttagcctgactttacaattctcatgaagaaaatcattattaaggaattataaccagaattcccaatttatataattttggggtcatttaaaaaatgtattggagattaagtccttgtattttaaacattcaaagaaaatgagatggataaaatttaactttttctgtgattctcaattgacaatcctacttatttgaggtaaattgacctgtttattatattttaaatacatatatgtgattataaaatttatttgtagagtatttaaaacgaactcacaatctaatcattactgtttcctgagtgcattaactatcattttttgaaccatgatgccatatacttattctttttttgtgaaaagtgatttcactctagaagctttttcaaagcatttctatgtgtgtttcaccacactttatgttttctcctgttttggatatagtcagagagttggaagagggtgagccccaaagggcttttgatacattaaaggcatatttattgaagacctattgttttggggctctcttcctgcacccaacattgaaaaattttcagcatttgctttttactttttaaagaatttccaagtaaagaaaattcaaagaaatgcaaagtaaatttgatgaacaggaaaataagaatgattataatttaactaccagtaaaaatatcaatagatttctttgaacagaaaaaaaagcttcttatcatgggtaaaatttataatagcttctgcaaaaatagaatagtatggactatgagacaatgctattctttttcatgtttattttctccttgcatcttgctatattatctctttaggtaaaaatcagaaagtcagcctacttttttttattacaatctattattttcagaaatcgtatcttgagtataaaaaacttattaaaatggatgtggaatagataaatcttatcccaagctcttttgatgtttggctagtgtttaaattggtaacattattttacagaatgataggaagaaatagacaaatgctgtgtgatattgaagaatttatatgctttcatgggttgtttcttgtcttgctccttccagtgtgatgctaagctgagcacaggactctttttgaaatcaaagagctttagatttaggtcagctttactcactctgagattctgaaataacagggatcatagaatacagatggcatctaattaaaacatgagtgcttggaggatattagtttaaagtctgggctctactgtcctttgatattaaaataaaatggatcaaccatagtatgctgagctaaattcagatataaagtgtgtttgatgttcctttttcatacataaaatcttaaggttctgaatctgcttgcatttgtgtgatataattgctatgatatgttaaattcagatgtagtttaaaatactatttcacattataatcattgctttagataggatgggcatctgaatgctgctcagcctgcctttttttttttttgagacacgtcccactgtgtcgcccaggctgcagtgtagtggtgtgatcttggctcactgcaacctctgcctcctgggttcaaatgattctcctgcctcagcctcccaagtagctgggattacaggtgtgcaccataacatccggctaatttttgtatttttagtagagacggggtttcaccatgttggccaggctggtcttgaacttttgaccacaagtgatccgcctgcctcggcatcccaaagtgctgggattacaggcgtgagccaccatgcctggcctactttttgatcaacatctatattgtctgagacttttttttcccatgcaaaagactggatattacaaaattcacccatggagttgtgtctgggtccccaatctgttctgccttcatttataaaagaatttaaatttttatcctagtgaattagtatggtggtccatatggaaattagggtaagcatttcatcaaagcctcgtagagtctgccacttaccgaagacagtctgaagattagttccaattataaagactctccattcatgggcctgccctgggcttaaagctatttggacacatagcttatttagggaacaagttgagagctattttatatttcataaaactttataactggtgttttattcacaaaagtctccttcctttaagacatcaaaacattcccaaatacatcacactgaaaacttagtggcagcagtctatctgtgactttcttcatttctgcagaaccacatgtaatttggaaaatgagcaatatggaatgtgtctgcctgagataaaatagttaatctgggttcaagcaaatcagtcattcaataaatatgtattgattacctaataggtgtgcttttcaaagctgtgaggatattgcaataaataaaatatgcaatgatgcctgttcaaagacagtttatattctttggtggaagagaaacaatcaataataacccctccaaataagtaaattattgtgtgtgtcagaaggtcatatgtgtcatagagaaaagtatatccctgattctcaagggaaatagagaagggatggtgtcacaagttatgttggggtattgggataggtttctttgagaatgtaacatccaaggaggtgatactccttaagagagtatagtgaggaagatgctctgaggccagagagtgcttgacaggtacaaagaacacattctgggctagcagtgaggaacaggatgttgaggttgtcagagggagatgtagctgggagccggatcctgtaggagggtcttgtgggccactctttagtctttgatttttactttaagtaagacaggaagtctttggagggtttcaaatagataagtgaccatcttaactatctcactgctaaataagaatagaccatgagagggtgaaagtttaagctgggagaacttagaagtctattgctaccatctaggtgagtgatgatggtggctatggtcaagttatagcagtgaaggtgaagataagatttccattatgttttgtaggcagagtaacaaacattcaccaaacatcagagccactacgtgaaatgaaaaaaacaacaacaacaaaaaaaaaacgctgaaactagccttatgtgctttcttattttgtttttctctttttatctcactgtcatttactccactcccttcacaaagttcttgagaatccttgactttccaggcttctttcagctatgctatctgtcactcggcctctatactgaccagttctgtgtaccactcctgtgcttctctccagctagcctctctgaattgatcctagtaacggttcgcactcaggtgttcaatgattgacaaaagcttgtcttcctctctaaccccgcactccctggggggatttgctttttttttttttttttgaggtgtagtttcgctcttggcgtccaggctggagtgcaatggcgcaatctcggctcactgcaacctctgcctcccaggttcaattgattctcctgcctcagctgggattacagtcacctgccaccacacccagctaagttttgtatttttagtagagacggggtttcaccacattggccaggctggtcttgaactcctgacctcaggtgatccgcctgccttggccccccaaactgttagaattataggcatgaaccaccacactggccaggatttgcattttaattgaggggagtgtgcagtttaactcaaacaagagaattgtcaaaggaaaaaacagggatcaagataatgcagcaaatgttacaggtttacgtcatgaagaaaaatgacttcaaaaatctgtattagaaatgttctcagggcatgcttggagtggtggaaggaggtctttaattagccaggcttgtctaggacttgaaccatagacgaagaactaaaaatttgtgttttttcatgtccttgaatcttattgtaattttcaattagatatttcaagtcaacaaatatttgctgaacatcttttctctgccaggtttgtattaggtgttgaaaataaatgaacaaataatataaaatctctcctctaaaagatctagcaggcagatagggatggcaaaatattataataaaatgaaacaaaattatgcatttaaggtgttagaggaatgaaaagataaatgagggatgcagtggggtcctgggaagggacctgtcctgggaggttttctcagttgctacctcgcccatctgctttgccaggcagtttttgacagttgtatcctccacctctagcttttccattatcaggatcattatagattgtgctctgccagtaatccagatataaggaagtgtctgggcaatccctatgaacgggatcagggcttggttgagctttcatctcaggactgatgtcagggagattctgactcaggtaagacagacgtgatcaccgaggagcagaaagtgtacatgtagagtgatgctctcatctctgcccaggaatgcttctggaagaagttggacatggtggtagtgaggcccttcaccatggtttcctcatcctattgtttatataacccaagtttcttgcatttactgcaccggtccccaacctttttggcaccagggaccagttttatggaagacagtttttccatggattgagggtttggggatggttttgggatgaaactgttccacctcagatcatcaagcattagattcttataagggacacacaacctagatcctttgcctgtgcagtcacaatagggtttgcactcctatgagaatctaatgctgctgctgatctggtaggaggcagagcttaggcagtcatacacgctcacctgctgttcacttcttgctgtttggcccaattcctaacaggtaccagtttatggtctgggggttaggggcccctgatttaccacacttaaagtgtaactgtgagtccaaacccctgatcctcaaagcaactaacatagttcactttgtgacctcatggatctttattactagagcctgtggtgaaattttagacatcagcaacaggatatatgactttagtggaaaatattttctgaaggggcagaatgtgttcttgctatccttaccttcaaacccagaatttatattgcagctggcaactagcattgcccataaacaggattagctctggtaaacataagtaataaaatgccattttgttttccaaacctaaactttgacctgcaccatgcagaggatatttaagaaatattttttaaatgtttactgaaagcatagattacaaattggagagaaccaataggtattattgccttgtttgccagattcaggtttaggccaatcatttttacctcctatgattagctaatgtttactctaaccctgtaattccacattagaatgattagtaattttaagccaaagaggaaaataaatgaatttggtttagcacctggaagccttgaaatgcttaagaggaggtgtgtttcaaattagaataaaaaattcatatttagatcgagtacatattgttaagagaacccagaggaaaaacagtggactcaaaatgtgtctttttttgggcaataaataggatttttatactgaaaaggaaagggtatgtatgtcttagaggagtagtgcatgtcatgtagtaggtactcaataaatatttcttggccaggcatggtggctcacgcctgtaatcccagcactttgggaggctaaggcaggaggaggccttaaacctaagaattcaagacaagcctggacaccatggtaagaacccatctctacaaaaaaaataaaaaaaaattagctgggtatgctgccacatgcctgtattaccagatgctctggaggctgaggtggaagaattgcttgagctcaggagttagaggctgtagtgagttgtgatcgcaccatggctctccagcctaggcaacagagaaagactctgtcccccaccaccccctcccccacaaaaaaaaaaagaaaaagaaagagaaaaaatttcttgaataaatacgttagttgaacaaccataaatagatttacaggatcagttaatgtccaccaagttgggagaccccagtggcaggagttcctagtccttagtatatgatttgagtgaagataaaaatgacacacctaacaaaatgtttcatgaaataatctaaaatttcttgtcttcattgcttacaatgacaaacccaatctaatcagataaaacttgataaagataatgcctaaagccctgtttttgggtataaaaaggtataaataagcataaatataggatggaattattagtaaatgttttgaaaaaagatgaaaggattaggaatttaggtgatagcctactcagtgtgatccaacagtatgaagtaattccaacctcctttcttgcatatttttaaactctccacaaaaactaaggagatgatcccaattattatcttcattacattaattgagtttatcatcaatatcatggaggtgatgatttgatgattatattttactatgtgctaaaaacacatctattaaacgctttttataattttaaggaatattatcagaggagagcaatgagggtagtggaattcttcacttgagtatcagggagttggtgaaggaagcaatataattatgcagaagagagctcttggcatgagccatgatttcaagaggggggaaataggaccaatgagataagttagcaggaagcatattttggctcaatgtaggggagaattttgtactaattctaacacttagacctgaatgttctgccttgggaggcaagcaagtgttcatttggctactaaacagaacagagattcatgtgtcagatgagggagttgaaccaaatgaccttctatatcacttcttatggtaagattctttgacattttgtgtgcaataacaagatatgtctctgtacaggctttcccagctatattctttagggaagttgaggataggagaacaagcactgtaaatgattacacatcctgaaatgagaagcaagggcatttgtagatatgtgcatagttgttgggataaagtgcctgtgtccaaattccagccaggactgacatgcactatctggtgaccttcgattagttatttaacatttctgtacctcagtttccatatataaaatggggatagtatagtatctacctaatagctttgttgtgacaattgagtgagttaattcactcaagcttttagaatggtacctggctcatagtgattgttagatattgttattatgattgcaactataactacaattaactattcataaaaccatcatagagtgagatggtatattttattctgcattacatgtaggcttaggtattctttggaagaaaatattatagagaaagcacgtatattggacacaggcaggctctttatgggctgcgtggtcttggacaagtcatttgacctctgcttttcttaataactgtctagttataggacttctgtaaaattaaatgagtaatagtaataaatgtcaacgtagtaataaatgtcagctcccatggaaagatagtatttcaatttccgtcctttttcaaatatcttgttgtctagagaccacagcagtgcagggttaatgtagcaacttagggcttgaagtgacctgagacatcttctagcaattgccgctcatgtaggagatgggagtgtaggttccttaagagttaagagacttgcagaaagcgacgtagcttcttcctatgagggagaagagctatatggaggagagaaagtggaagataagtaaacattcagagtacttttttgggaaaaagtgtgcagcttcggagctcttgtgcacgttttgctgagtgcgtgtttctgaatgattgtgtgtgtgtctgtatgtgagtacatatgtatatatgtatatattcatgtgtatgaatcagagtgtgtaagtgagcatgtatttgtgggtgactgattatcttgctagtgtgactttctatgacacttgctggcatgcaggccttgggttgctaattccttttcattatctaactcagtataccaagaaaagaaagaaaacagtgaaaaagagaatgcattctgctgttagctggatgctgactttcttcttctgggtctggcactttgattcctcatgacttcaactttttcctaaggaaaataaatgtgctagcctcttaccttcaccaccccactttaatgaagcttccttcaattacatctataaaacccaaggtttaattttatttgatgacactgtcttctgcagacactttgttttgcttttgaagacactaagatagcctggagctctgtgccaatttcctcactggtactggccactggggaagctgcctgagacaagggcatctgaagtgacaggagccttgaactcagttcatcagctggagacccagagcagtatcaaaactgagtttttgattatgcatatttatcctgatttctacagcttcctcatgctcacccatctccctcagatattctacaacactgaactgtattattctgagttgtacttaacacttaggaaattttaacatttgcttcattaacataactgttagaaggtgcagggggtgatgaggtttaaaaaatgagtttaagatcaagagtgtgtactttttgtttttctttatggagttacattgctgatattatttatgttcaaattattgactactttgctgcttgtataaaaaatggctgctaatttttatgtattttgatctctgtttttacggatgatgcaagaaaatgatcaagagctcaattacacttattggcataatatttgttaattgtgacactgtagaaaagaaacattcctttgaggatcaagcagagccatctcctgtcctcatgtatagaatagtactcccattagggaatgctgccaatgaaaaatttatatataactttgtgtaaaggaagtttttaagctctgaaatggagtggcatatagttgcctgtaatctctaggctgatattttactgtggcatttcttcgcttctcattctaataaaatattaacatggtaagctaattgtttctgtcagaaacaagttgttcagcataataacccttttcttcatttgataacgtatcatttaacttggtagaactgtctgaaaattatgtcatattctttcccattttcatctctactcttgctttctggttgcccattctagcaatacaagaccaagtcaagctacaaggcttttgcagcaatccctacaaacacattgcttttggaacagaaggtcagtgttggctcaaaaacagtgaattttacatttttaatgtgatttttaaaatgttttctaaaatttctgttgggaagatttctgttttaaagttctgcctttactaaaataacattccattcttagtttaggatgatgtggtgaaaacattttggtgaatataattggagatattattggtttattgctagagactgaatatgagcctagggatgtttagtccactgtcaagctactttgggaaacttgattcagatttggatagatctccgttctttggaattttaaataattattatattcaaaaacttccatatcaagaactttcatatctgtccatattgatcaaaagaattgaggtgaaatgggattgtttgtgaacagttggccaccttgggttgttgactggtaaagacttggtgactaacagtggcttccaccattgtactatactgatactcagatattatagctgagtattcaacttagcctcatagattccattgtggactaaacctcttcacccacccattcttgccagccagtggtcctactttcatgaacagaagggaagactgagatgactctcagtgacccaactgctttcacatgactccaagagatttttgctttgctattaagggtcattaataataaaattataggctgttacataagtaggtaaattaaattgaagcctcttgtttaataaatatgttacgcatgtttaaatgaaagccaagtagaggattgatatcagaatcaaagtgaaatgagttaccaagtctatgaaattattcatttcatatattatttttatgattatgtatttagtcaatttatttctcaatgcactaagtccatttttttctgtgtaattatggtgtttcaaagactatcatttatcaaaacgttgtttgccaaccaggtggtattatgatcactggtttataaatctacattcttattcttttagcatgatctgaagagtaaaacctttgtatgatctcttatctaataagtaggaattgttagtggaacaagtagtgtataggtggacattaattccacattatacacaggtagtgtccaatccatgttctgtatatgtaagtgctttgaactggaggttcactaggctgcaggaaaatctgcagctttttccctagcatctctcctgaatttctaccccttattgtctgttaaaagatgagatgggactaaaatacggatttcaggagacttctggaggttgtggaaagggacacttttccattgccccttattccacactctggggccataatggtgggagatggtggcagagttcccacaccacagactctctgcttattttggatggcgatttctggaacctggtcacaagtgtgtgctttcacagatgtgggagaatcactctccatcagcagtgaggcaaagaggagatgaggagcctgtttcatgctcgtctttccctcatacttgtctcgcctcatctaggcacattcttctggaactatgttctgctactatgtaaatttcctatttagaaaaatgaaagttaattctttctgaaagtcttttgtgagataagactagatgtcagtactgtttccagaatctctgtctgttaggattgtttccagaattctcttccaattaactaaattattgagcttataatttattcattagtcagtgaaaatgaagagtcattagtttaatttccaattttattacaaacccatttcataaatgtgtatggtgatattgatgtgtatttagcctattatacaagttcatgtgcaaaaggttttgtgtttttaattttaaataaaacattctgtaggaaaattattatgtctattgttcatacaaaaaatataaacatgatatctaaatttaaaatagtgttattctagagggtgctgcattattgtataagggctagtgtaggttgttgtctcttggctagtataatttttggaccataaatatttaacttattcaaaggtctcagatgttaagtgaatttttttttctttaggtcctttaaattattccacatactttctgctggctttcccatgttatgtgttcctcaataagaaattttactttgtaagaattttaaaatatcaaagccttatctaaaggttttatgagttacctccattttcaatagtattttttgaatgatattgtattgttcctttcagtgttatagttttaaaaaataaatctgacaatttaatcatttatactcatctgtttatacaatagactttatcttaatgccactgaaataaaagggatttatttctgaattgagtgggaaaattaggactataatcttgaggaactcttctatttatggaagaataaaaatcttgcaatattttaaatcacagaaggttttctgagatccctttgatatcacacagaacaccacaattcaggggtaggtaaggttgtagactcattataatacttgggtagggtccatgctgtggaatgccttgaagctggagctaacaaaaataattcatgtcttagctatttcaacaattatctctccaattggattaaacccatgatgggtatcttatgccacattcttttctacagcatatagtataattaatgagaaaccagatttactttttaaaaaataatgctatttttaaaagcaagattttttcctaattgaaataccggcatcccttgcaatgagatgttaagctctcgttgaattactggattggtttcagttttaatcaaccctggatgaagcccatcatttttaaaagagtacactttgttggcagggaacatgaggtttctggtacttctgttctgtaatttattgtctgcatcaaaatttaaatttatatcttattccatattctatcatttttcccctgtgaacctttaagaaggaagcatttatagcttaagtcttaaataaggatttctagggagagataaatgtaaggtatgatttttattgtgttggcttcatcagggtccttggcttaacctcctgccaataatcatcttctccaagaatgacatgaggatgaaatgcaaatgattataaagtaatcagattacattgtgactgtccatagactttattacaatatgttcaacaatatactaaggtctgtagataaaataagttgatatggactttatttttagtctttgtattaatctgttttcactctgctgataaagatataactgagaccggaagaaaaagaggtttaattggacttacagttccacatggctgaggaggcctcagaatcaaaggcacttcttacatggtggtggtaagagaaaatgaggaagaagcaaaagcagaaacccctgataaacccatcagatttcctgagacttactcattatcatgagaatggcatgggaaagactggcacccatgattcagttacctccctctgggtccctcccacaacacatgggaattctgggagatacaattcaaattgagatttgggaggggtcacagccaaaccatatcagtcttgtgatatatcttgatgtgtactgtcttttttagagaaagttaaaggtctcgctttcattgactagtttttcttcttatcatctgagtctgatagcaataggtaaaaagttaaactgtttgacacatattaatattccaagtaaatagattattatttttatcatgtagttgttaaaggaggagagaatgaagaaatatttccataaaatcaaagaatatgcatctttattgtcttaccaatgattaatatttttccatgaaaatataaattttttccttgaaagtaatttaaactctctgtttacttcctcataagtatttctgaggataaaattagggctggggctaggtacaatgttcctaataaatggcattactctttgccattttcacgatacatttgattcataagaagtgtgtacttaagagaagaattctggagcagctcagttttataagtagcaaaaaataattacaggtttaattctttaaatggaaagttataggaaaaacatttttttttggtgcaaggaatataaaattagttattttaacaactaataaaaacgacggcataaaaagaaaaaggcaaaattttgatatatcctgtcaactgtcaagtctatttattctaagttgcctctttgatttttttgtttcattttttgagatggagtcttgctatgttgcccaggctagatttgaaattctagtctcaagcaaacctcttgcctcagcgtcttgagtagctgggactacaggtacacaacaccacacccagctaagttgcctatttaattttttaaagcatgagttgctaaactccaatcttattaaagatatttccttaggtgagaatattttaaaatctctttatgtcttggcagggcgtgatggctcatgcctgtaatcccagcactttaggaggccgaggagggtggatcacctgaggtcagaaattcgagaccagcctggccaacatggtgaaaccctgtttctactgataatacaaaaaaaatttaactgggtatggtggcagatgcctgtaatcccagcgactccaggggctgaggaaggagaatcacttgaacctgagaggtggaggttgcagtgagccgagatcgcgccactgcactccagcctgggtgacagagtgagactcagtctcaaaaaaaaaaaaaaaaaatctttatgtcttaaaaatttaacaaaaccttattgctaatttagcacatgacctatattagagaaacattgcttaatttagattctagtgcaagaggcaaatgtgttcccaatttctttaataatggagaagagtccaggactcaaatctatggtaaatggttctcgggtagttgtctactatgtgcataatttaaaaaaattatcaaattgtatttaattatgcatatttattgctttctttctctatcttgaacttcttgaagaggcagatatactatattctttactaaatgttcattaaataaataagtttagtttggggccagataggtctctaaaatttccaattttattccacaggctcttaaggcaaatttttgctcataagcataaaaaaaataaagtagactactgtatgccaatcaaaacaaaaatagcaaaggatctttctttaggacagaataagcctcatcaattctacttccatggaaaagcttatagaacagccttctgctggaggggaagtaagctggcacttttgaagattagacaatacaatcacaaaggctgccgtattgaatactctagtgtatcagacattgagctaagtgcgctttcatcttcacaactctgtgaagaatttgatgctcaaagaagccaagtaaattccctaaagcatcaaggttactaagttgctaaattggacctcagaggagctctgattggctctcagccttccctgttccgtactgtacagtgacatcagctagctacagtgaattattgagtaagggatgctcatatgggatccctgcctacaacacttgttttcattacttgctaaaatatatttatatcttcattaaatgagagcaagaagagtattttgtttttatgtggaaaaattaaaagaaaatgggaaataatgtggctctgagatgacttgagagagtgatggattacaaaccagctcaattccttgagctactgaaagagatgaggcaaattacagtgaaggaggtgcttctggaaataaagaacacccttctgacatccttaattgaatgcaaaaaagtatagattcccctaccattgagctttgctggaatgggtttgaaactggttggaatggtttgcaaaaactcccttctctgtgggaggaacaaacatttaactttccaaagctcttgggagtaaaatcaccaactagagttcttcagttcttgatatttttaaaccaatcatgtaaaaatattttactggcaaatattcccagatctttaaagaaaccctactttatatacctgcaagctcctttggtttgcagtgtactttttttccttttcttcagtggtgtatgttattcagacctgaatccccaactagacaatcaaagtgagatttatttttctaacaatatctactatcctacacatggttttatattagtccggtaagtattttgtagtccttaggggatttattctaccaaatagcaggtcatattaacaaagtataggagaatttaggctatacataattttgggggattgatttgatcgttactaaaatctaataactcaggaatgaaatttttgaaattcaatcaaatagatagtctaagtataacaaaaagtttacagattctgttagatcattcttcctttggaggcagtttactttccaactccctacttttagaacttcatcctatattttaagggagcaaattagactaactccatatatttgactaaaaagtgtttgcagtttcatcagggacactcataactgggaatacccattacagtttattggcatacttttacacaaggactttgatttgcaatgctttttcatagttcttggctcctaattttaatgtagtgctaagttcagaaattcttttctgctatgagatttatttggtatcttttcaaaagctgggccccaaagttggcacttctgaacaaactaccaacacttgtaatgagagtatttctgattatttgtattagttaagaattctttaagatgaatgagctcaaagaatattccatttatgcctcaatttctgtagtccaatttggtagaaaatgtatatttttaataacaataatttattagataatattttaagagacttttacccgaaatgaataaatctagagaaacaatatcttcctgctggctagcttgccaaaaagcaatctctggtcagaattcttactaatggagatttaaagtatgcttttaagagaaaattttggacgatagaaaaagaagctactttttatggttgctagaagtggtgtatatcacaatgatacatctgacaagtaacgcacagtcaattaaaaaaatcaattctagtaaatttcaagactatttaagttcaaaataagccccccatccaatttttaaaaatacagcctgagtattttgtgccatttcagaatttcagcattactgacctaacacctgttatcttccatagttttccaagggacctgagtagatagttctgtcattctctgagtgaatttcaatatcacaagtaacctaataaaagttatgtttgccagagtaagtttccacagactaattaaaatattagtcttatttggtttggtttgaaaaaggaaataatcgcattgcactagcattgattatatgctcaaatctttgatggtaaacaaatttaactgtaatatagagaaagatatagtttatttgtcaattaaattactcaaagagtttaaatcacttctctagagcattttaccagggagtatttaaatcatattacttctatgattcatttattaatttaacttaacttcatttattcattggtttacccagtgattcatcataaagaccttcactaagcacctatcatattctctatcctgggcctacaaagataaatatcatattttctgtagtctaataggacaaatagtccagtagggtaaagatatagtttaaaaagtaattatgatgcaatatgcttaagatatgtgcaaagtgatatggtgccccaaacagggaatggctgactttgcctggtgtgaggccaagaaagatgttataaaggagtttgatttggatcttcaggatgaataggaattctgtaagtgaactgagagtggatctagggagagttaatcacatgtagttcaaaagatcaccaaaagttcaaagaactgaagcagttctttgtggttaaagagcagcctttgagtgaggagcatatgaaaggcactgttggaatggtgagcaagggccagaacaaaatcctgtcctgaggagctggctcttaatcctggtctttaatttctgacattttttgtttccataattttctctatagtagaggtcgcatgtggtgtaaggcctaaaagtaaggcccaatattgtgtgctaccttgacatctgctagaattgagagagcctcaaatggcctaattgcaagttcccctcttcactctgctcctgcagataaggtcctctagccaaacaaccctccttatccaactgaccaggtggaattcctgagtatgccttagtaataggttccagttcaaacaagccaatcatatcctttggtggaaccaggggtgcattactctctggatacccacaacccctggttgttccttattgtgacctccatgtggccctgcatgttttgtggcatcccccttccctggactgtgagtatatgtgactaacaaactgttgtggattttatctgtacagtgtcaacagttatgtaaccttctatccctgtaacacaaggaaaggaacctctccccctttaacaaggtgaacaggaggtgattgaaacaccatgccaggaaaatattaaaccatctgaacaccagtgaagagttatttttatgaaattttcagttcctgccaatcatttctcatgattaatcataattttaaagaatgatgaaagaaagcacaaaatagatttttgttatggtaagaaagaagcaatattgaatgtttttattagattatcataaccaaccttccaaattttgttatttaatacagagaagtggattttgaaaacaaaatttccagacaatatttacccttatgagctattaaaacatgggatggtaaaattttatcttttaaagtcacttttctgaattcttagggttatatcccatgccaaaatggcagttctagcatctggacctggtacctcttggtcaaggctaatagttctggatggagatccctggttgttagaaggaggaaaagagattttgatgagcaatggattccatggtttcacaggtggcataacaccttctgtcaggatatgtctacctcagaatgggaataaagaaatgagaaataggtggcaaatctaaataagaggagaagggaacctgtaattctaaaaagttatataatacatgacaatagagaactgaatctttgattttttctgtttacaaatctaccagaacatatatattcaagcgacgatatttctcttgaaaataactgtcttgtgcctacaattgcttattgcatttttggtaacctcttttgtaactgtcttcagaacccatggcatatattttttgtgtaacctttctagctatagattttcaaactttgaaagcatattgaaactagattgcttgaaaaacttcctgttgtaaaatacctataatcgatgatcaatttaaaaatggattaaaaaacaagtcaagccacatgaaattgccatcttggcaagtatttttcagttgaatactgacaattttgtgtgtgttcaacccagtataaagctgagctcataaaaaaaagtgggggaaatccccaagggtcaaatactaaaagcaggctgaaattcagaacgtttatcatggtgctgatgctctggtaagagagaactggagttgcatctccgttaagaatcaagatttttgaattgttacactctcagttgcaagaagtatgataaaaaaaaaaaattttcaaagggaaatgacaaccccgctttttaatttttattgttttagagacagtgtcttactctgttgcccaggctagagtgcagtggtgtgatcagggctcactgcagtcttgaactcctgggctcatccagcttcctgcctcagtctttcaagtttctgaaactacaggtgtatgccaacacattcagctaatttttaaaattttttatagagatgggatctcactgtgttgtccaggctggtcttgaactcctgggctcaagtgatccttctgcctcagcctcccaaagtgctaggattacaggtgtaagccactgtgaatggccataagattttcttatatcaatctaggcttagggtaggaaaaaataacctttagtcacgagcctaccctgagacaggtttgagactgaatttatacaatctctgtgataaagaaaatatgtgctgaaaatcgaaatttgaattaatttaaaattagcttgccttattctgcttctgcaaatagagaagtagcttgtattggaccaactgttttacagataacaatgataaactctggataagaatataaaaaactatctgaaggtactgaagcatgaccaaggcaggtagaaactgcagtagagtcaacgcttgcaagaaaaatatggcactaggttggtttctagattttatagtttttcaccttacgggtagtcccttatctggtcacaatgaagtagtgaaaattcagcaacaacccagcagacgtattagatgaggaaacagagaagagtgtaaggtcatacagaaaccagaaagtaggggagaatctggaaaagagagtgccaaaaggatccctaaatgttgtagataaactctgcccaaatctctggataactattgaatgtgcccattaggcccagctgaggagaaaacaatggaatagagattttggctagttcccatcattagagagacagagagtctgaagccaaattgactgcataagcaaaaagaacaaagctggaggcatcacactccctgacttcaaactatactacaaggccacagtaaacaaagcagcatgatactggtaccaaaagagatatatagaccaatggaacagaacagaggcctcagaaataatgccacacatctgcaaccatctgatcttcgacaaacctgacaaaaacaagcaatggggaaagagttccctatttaataaatgatgttgagaaaactggctaaccatatgcagaaaactgaaactggaccccttccttacaccttatacaaaaatttactcaagatggattaaacacttaaacttaagacctaaaagaaaaatgtcttcatgttaaagaatagctcatcaaatactgtaaatatttttttcttggaatattaatacatacaaggctttctttgaagatacttttctactccagttgtatgactagaagcctcatataagaactatttcatttgtcactaggcactagatgaaccagccaagactgaaagtgtctccaaggacaacacattagaaccaccagtggaggtaataacttcagattacccctgcttttggtatgcaattccaaaacttattgctaacccagtacctggtttcaattcttccagctctattttcctgcacagctcaggcagcaaactgaagagctctgtgctaccattgataaggtcttacaggattccttgtctatggtaatgctttagactagaatgtgcaattcaaacatttgctttgcttctcttcattttcctctactttagtatgatgcctcacaggcttgtccttttctttccttttctcttcttctttccttcctttctttttttttcagcattcttctgattctccttcaaggtccccaaagacattgttgggttctgacacagtcaaagtatgtatgtatttaatataatttatggaaccataagatttattagatcaatgatttccaaactgcaagtcaaggtccaatagtgaattgagaaataaatttagtgaatagcaatcagtcttttttgtagaattttaaagatagtaaatattagacttgatttcaagtaatgtataggttttgttgacatttgtttacatgtgcacatataatgcaaggtaagtgtatacagggttgcaaagtaaaatctatttctgtgggtccagttcaaaacagtttgaaagccaacatattaggctatgttttttttttacattgatgtttagaatgtataatgtgtggctcattctcactcaaattatagattcaatattatttatggaatttatagccacttaaaaatagagaagtaaaaaatgaagtagactaaagtaaaattagtattaagagctttaacggaagtattatttctagagtttctttttctttttgctgattgaatctatttcattattctttgactcaaagggaaataaaactggatattttagattgttagagtactactaaactattaattgttgtaattgagtatgtatttccttcttataaaatagttattttcatttgttaggataaaataatacatttctccaaattatttttttcaaacacttaagctctactcatccaaatttcaaaatgcgtatgatttttcctttattgataattgttagttattagctactgatttttttggtcagccttatttatttatttccttggaattagtatacttttttcctgtcctttcttaaaatatgggacactgtgtgtctaaagtaattttcaaatgtacagaactacacataactagaagagcaatcctaattttcaattggaatattatcaataaatatccattagtaatgacatataaaacccagtaatcaattattgtcatattaattatattttagcagaggactcacaggtggataattgtaatttctgtatttgaagtctattttgttgtatatgctttaagccttttaatctaaaactttgatttgtcaaatatattatatcaattttaaaatatattttttcatatttcattcattgaacatgtaaaagacctgtattatattaaatataatgagaataggatttaagaagttgtatatgaatagtaatctatattactggtttctttaacaaatacttaaggcttacggtgttaaaaaacccagtattttaggccactacatttaaggcaatttttcattcaacaggtatttattaagcacctaccataagtctggtgcagcaaggcactaggaacataagcaaggctgagtaacctaaggtataagctttgaatgtagtgatcaaggggtagaattcaagctgagacccaaagatggaaaagaaccagccacagaaattttgatcaggaataatagctttcaggtagagaaacaggcatgtgtaaatttcctgaagcatgaaagagcttagtgtgtatgaaaataaagaagttagccaatgagcttactgtccactgagctagggatgaacagtgcaaatgatgttgagaaactgggttaagcactgtgatttaaacccttatttgccatggcatgaagcttggattccaaagaaaatggggagacatagaaccatggtgggaataatatgaaaccgtagaagatgaaaaatatggctgctgtgaggaggctgctgcagtcagggaaacagtcagtgatggtggtctggatagggtgggttcagaagagctagagaagcatgacggtttgaggcttgccaagagtttgggtgcgggtagtgaaggagagagaatactgcaggtctctgttttgaggatagacaacagtgaaggaagagctgtatagtggcaggcagagggttatgtcaattttagacaaggatgagtttgaagtgcttatcaagaaagcttaaacctgtgtgtttgaagctgatcagagatatttgagggtcattggcacatagacaccgtgagcgtcctgtacagagttccaaggaacataacatcacaggtctgacaaaggaggtggagatgagcaaatgagaatgaaaaggcttttatggtgaggaaaatcagagcaatgtgatatcatggaagctataagaagagagtgtttgcgaatataattgtgttgattgcggccaagggtcagagaaagataagtctaaagaagtgtttattagatttgacttgtatattttgaaaccatattgctggtgcttatgtgttggcattcattctcgtttttgagtttttagaagctttatcagcatatataatcatttcttaacttaaggtttttctcttgagtattaaaatagtgactttatatttataatttctaattcttgttttcctagatgtatcttttactgctactttcctttttttcatacccttttgtctaattttctcagagcagcatatttctgcatataatttttacattcaattagattctatttaccagggactttaagccatttataattattgcaattcttgttatgttagggtgaatttttgctatcttatttcatgttttctatttaaaatgtttttatttctcttgtttttttctgctttccttaggcaattttgatatttactagtttgaacattttgaaaattttactttataccttgttacttctggtagttacatatacattattaaagacaattattatgcttaattttgtatcaattttaaaacatgtaaatgccttttcccacaattttgtaagtactatagcacttttcactttctacttgtttttaatcaacctgtatatacaaacacaagcacatacatatacaatttattagtattgttttgaactttatgtctgaacacttctttatctttcctttgtttggatacttatttctgatttagatccttattttgcacacattcaaagctttttcctggatttattgtttttcctgttggaatcttgcttcaagttgtataaagcaagatctttttgtgtagattttgtgaactctgttcatgataacatctttattttgtcttttcatttaaattatagttttgctgcgaataaaattgtaggtactctttcttcaacattttcccccaggcttctttgtcttcaacaacatacttacgaagtattttgtcagcatgatacttggtcctctgctatagagtgatcatttacagaattgctctatagtttttaaaactttatgtatgatcttacagatattttttatggtgtatttaggtatgcatttttttcttacatattttgattgttaccttctatgacctttcacatgaagtgttcaatcttttcttccccttacattttcggtaacttttgatcattatttttacaaatatttattcccacatgggactctcacaatactgattttgtcacttttgattctgtatttcatgtctcttactcttcatatttttctatttattattttctgattccttcaagaggaatccttgatctaatattccagttcaagattttggtcagtatctattctttccttcaattcctgtattacattctttgttgaagctaacatagctttttcttctaaatcagatttattgaggtaatatttaatcactgtaaactccatccttttagtttacagctctgagttttgacaaaagaatccaatcatataattactaccacattccaaacaaaacatttccatcaactgaaaaagttccttgtgctcctttttagtatatactttcctccaatccaagtcctgagaaaccacttatcttttcatgtgttcttatgcttttgccttttcaagaatatcatataaatgtaattatatagtctgtagtcactttagcctctacttagtagaaggcatttgaaattcatccatattattgcatggatcagtagctcttttttttttaattgctgattagtagtccactgtgtggatgttccatcctttatttatctgttcaccagttaatagatggctgggttatttctaattcggagctattactaataaagctgccaagaacatttgtaaacaagactttgtatggatatatgatttcacttatcttgggtaaatacttaggagtggaatagaggaaacattgttttcttttatagtttttaagtttttcagatgtcttattatgtttccatggaaactcaaatttccctgagcatgtcagctaagttgggtgtatatatgcctggtgcctggggtggcaggtcctgaagcccaagtcctagcacttgccagttctggtgaggtttatttatttattctttaagagcaggaggagcatgtgcttcagaagggagaagcgccatagtatcaaccagttcccacttgccacttcctctccaccctggtgaccctgactctatttctgcctccctgcacctctgcttatggtatattcttctcttccaatagctgtcccagtcgtcattgctgagaagggatcaagggaaagattcatcagaagctagccagttgttgaaacctatagttaactattttctccccaaaggctgaaggaccactttgatattgtcttcatcgttacctctttacaaccctcagattttagcccctcagttcaccccattgatctccttatctctgttgtttaaatgtgttgtggcatgagaaagcaggtgtagaatacgtaaaaacagaacaaaacaaaacaactattttgaaatgtttggccgttaaaaggaaaaggaaattaggttggtagtgaggtcaagaaagaactttttgttttgtgaagctgaaaatgacaagatcaaatttgcatactgtggcattggtcttagtagagaaagaagtactaattctagagaagaaagggaaataaaggtctgaatatttgtgccccacccacccactcagaattcatatgttgaaatatatgaaggtattaggaggtggggccattagaaaatgattgggttgtgaggatggggaccttatgaatgggataagttcccttacaaaacagtccagagagaaacctcttaccctttccaccatgtaaagacatgcaagatggcaccatctatgaaccagaagtggtccctcaccagacaccaaatctgctagtgcctggattttagacctcccagcctccagaactgtggaaaataaatttctgttgtttataagccacccagtcaataatattttgttatagcggcccaaatgtgctaagaccatttgctaagaagctggaaatgtcctccattgtaacaggatggaaaataaaggacatgacagctacagatgcaagaatgtttgtagtttggtggaagagaaataattttataaccaatatctttagttatttcataactaatacctttcaatgaagtaaaatgtaagatcattaaccaagattaaggggagaagttgtgatggggatgaatttgaaaaagttaaaaaaagtttatatattctactttcaattccttttctccagtttcctcttagatcccctttttttatgtcaccaaaacccctttttccaaggttcctgaagtcctctgcattgcaataaacccagtcctgagttgagatgacagcaacagaacttgagatagttgctcacaccctcctctttgatatattttcctctagagtattttagaactccgtagtctctctgtttttcctctatctcccttttttattatcatttcttagtctcctttgctggttcatcttcttcttcccaaactgttaatgttgggatgctctagtcatgagtcctcaaacttctcattcctctctatattcattcctttggtgatctcaccctgttttatgttataaaaactaactacatatatgccgacaactctatttctagtccaggattctttctcaaactgcagacttccaaatacctatcttcatttccatttatacttctaacaaatgtcttatcctcaatatgcatacaaataaaatctagattttctcccacaaaatgattccatatgttgccttctcatctctgttggtagaatttcgctctttcatttgctcaaggccgaaaactttggtgtcatgttttattcttctctttctctcacatttcacatctcttctgctagaaatcctatttctatagcttcagaatatgtcgactatgattatgccatggcttctgcactactgagccactgtgttttgttggatagtacaagagttttgtccctatacccctgactcacaatagtttattcttaacacatcaaacgcagaaaaccttttaaagcttaggtcagatcatgaccctcctctatttaaaaccagaagtgcttacgcatttcaaacctcagaatataagcaaagtcctcacaaggtcctgtatggtctggtgccccaatacttctgtgactggctttcttccaactctctcctttactcactccatccctggtagcctccttgttgtgccttggatatgtcaagcatgcccctgtcttagcacatttagtttcttttcaaatcagttatatcagtgatcattttatagtttctagcatactgtgaaaaattttcagcttaacctttatctccaaaatcatggttaagtatggttgttttcagtctggttctgaaaagacacatttcttaatctctgtgggtcttttttggttgtttattatttctgctcatcctcattcacattgtcttgcctttttgtgtatctgaatctgattgtatgctagatatcctatttgaaaatttcttaatagaaatggagacttcagatgatattaccttttatagaaagtcttttctttgtttctgtcagacattgggagcactagccagaaaaaactacctgaatttaatttaagtttctgagattattttttctagacagtcatcttcagatgatttgatatcaggctgaagaccatgtgtcttctgggtcactcttactcctaggggctcaatctgtttttggcaagtcctggttgactttctctctctatacctgtgagatatcaaaagtttgggttagcttctcaagcaactcatcattatttgcaaacatccccagggcaaaagcagttctgaaatgctgggcttctctcttcaggttcccatcctcttttgattttgcccagtaactattcactttctttttagttcattgatgtttttgattaaatatttttcaatatattggtcagattttttattgtcctttatggaaagattacttccagttttctatccaacattctcagaggagaaaatccaccttagaaactttgcacttgttccctcttgttggaatgctctttatctagaatactacctactcaactcccttactccttcaagtctttgaagtctccttcaaatgtcaccttctcaacattgatcatctaatttaaaattgtagactcccagcactcttgacctccttaacatctaggtgttccagaaaaatacaaggtattttgtagaagcaaataaatttttatctggaagcgtatattaccctgggcttcaaattatttctactctttttcattgcatttattcctttctaacatataattcacgtatttatgatttcattgcttatttcttttcttccagaatgtgaactcctcaatggcaggacatctttgtctcttctgttcaccaataagtcccaggggtgtagaacagtgactggcacacacagtagatacacaaatatgtattgagtggatgaatggatgaatgaatcaaatagctatttcatctcagaaagtgggcctacaaaagaaaaatttcgggcagtactgaatgcacatttgaaattgataattgttaatttaaaataaaattaattagtttgtttgaaagagtttctccaacaatgttttgcttctcagatacaagtatggagaaaaatggatggtaaggtcaatttagggttgaggtctttttttttttttttttttttgtaagtgaactggtcacaggaagagaggaagattaaaaaaagtgaaagtattaaaatggcttataatattaaataatatgagataagaggtaaagccagaataaagctgatgaaggtcagtgatttggaagtcccaatgatgtggatgttgcactagtagcactagagaaatgaagatggtggataggaggtagagttctgagtgtgggacatttgtaattgaaatttctgacagtttctgttttactggtgaaggtaaagttaaggagctttctgggagtgaatgattgaattggagtagatgagaacatctttgtaattgaggagctcaaaaaatggaaaagacagagatttctacatgaattttgaaataggcaaaaattatggaagaaacatgaggaaagaactattatgatccatgagttgacatcatcaataaataaggagaaattaccagaaagctgataaagtcagtgagaagaataatcaagtgatatcattttataaaataattttctaaaaaatgatattgtatagagagagcaatgtttagaaagtctcaattgagaagaaggtgaacacattccagaagttgagtctattattatttactttattatttcagatgtataattgtttttattttcatacagactcctacaactcttccaagagcagctggtcgagaaaccaaatatgtaagtacctttataattatacacactgcttttcaaatgggtgcctgtgtatgctttagagagaacactattatacagtaatttaaatagaattaattgtttttttataagttgaagggtaggatgatatgattgcagatacagaaaatcaggttatgtcagagataaaacatcaggtaagcttatcaaataaatttgtccttaagtgaggtctagttggattagtttagctaaatagaactgccacacctgcttcctgattttctagttatcaacacttagatgacattttcatttttgtaatggtttattatgcttatagaatagtcaactcatatacttgaaacattaagatttgtccatttctaatgggattgccagtttaatcaactttgactcttttgttgctttccttcatttaaattattaacaaataaaccaatttccacttatgagcaaaagtggatagatatagtggatagatatagactcacattcaattcaaataattatgagtagctggctctgagtgtgttagacataaacctgcatagcctcatcccaaggccagtgttcactcacctaataattgtattttccatcatgtggtcaacttctgcttctgaccaaacgtattctagtagaaacaagattatctccttagtaagtgtttagtgttaagtctaaaacaaattagtaaactattccatttaagttacacatttgtagtttttatcataattatgaagagtaaatagttattaaatgtgtattttgtgtcatatcatcattgtaatttttacagttctgccttcatttgaatctccccaaggcaagtaataaactgggtgaaattactaaattttatcacatccagaaaattatgtttagaggatgtgggtaggaacactgcttagagcatttcctggaagttttgctgttatttttcattattattggaagccatttggagtaatacttaaaaagaatgaaggcattagtagactagacccgagtttaaaatcacagtgttgcttttagataactgtctgattctgggaaaattactcaccattttacctttctgtgcctttgtttcttcatctatgaaatggggatactaataattttcttatgtaagatttgtattagctaatctatgaaaagcccttaatggaattctgatacaaaggaattgctcaataactaaaagcttttcctttcctttccctttttcctttattcatatctcctttcttctcttcctcttatctatctttggaagactagaaatatcttgatttaattgagttccttgagtcgttagtgggtacaagaaaagaaagtttcctaaaggtgtttctatactttttgtgactaatacattttacaagagccagaccccccaaaaaagttgctgcaatttttgctctctctccttcttcttttatctactcttgcctttcagcaaaatgtctctaattagattagttttcaataggttcaaagggttgatgtcattatccattcctctctgggaggggttaatttggtagcaattgaaatgattctggagcggcttcttcaatctccatagttagaaattatttcaaagtattatttactttcaatcaactatcagatttaattaaagtaggttaactttcatgcccttaatgttgtgagagcctttaagtcattcaaagctaagaatgaaccatcaaacaggttcagtataggctagaacaaatataaactctaatgcagataagattcttgaccttaattaaaattcgtttcctatgtaagaagctttgttttcactttattttacaacatgacatttgaattgttgtttgtggccactaaaacacgtccacgtcttttggaagaccataaaggatcattttacaatgaaaggtcaaaactagtttggcgccaactctcgggttagtcatatttgtacatatttggctgtagttattacaatttactaagtgatgtctgatacatttagtttgaggagaaaagattaaattttagagcagaagttcactttagctataagctttggtcttaaatgaacaagagcttatcttgtatgtcttaaatacaatatgttctgtttttttaaaagaatgatactgtaatattttcttctaaaaattctaatattcatattgactgagctatgggatgtctcactttaagtatgagtttactagctatgatttaattaattaatttatcactatatatttctctcttctcccatgaaaactaaaaagcaactctgagaagtctatttctgaaacatttcaatatttcatcatctgtcttcaaactttggagaaagttgtcatcttcagagtatataactgctgggattcagtgcgtcattgactttgtagatattcttagattaaactcaaaagcagggatcgtgcaggttaccaactcctatactacagagaaggttgaataaagggaagacataaattagagccaagaaaaaaaagttttgttacacttgaggatatcctgaacaagttagtactgactactgaaaattcctatttctgagagttctttaaaagtataatgtatctgattactacacgttgtatgtctcaaaacaccactatgcatcccatggatatgtacaattattacttgccaattaaaaaataaaatttaaaaggtatagtatataatctatggatcaagactatactagtcactatttctagctctgttattcagttttccacctctattcattgattcgacaaatatttattgagtgtctacagagtaccattcactgaggagtcactggggtgcgaagagtgaacacaatgacagtatgccaatttctgaagcatgtattccaatgataagacagatagtaaacagttaaaatagtaaatgagaaagacactttattgtagaaatagagaggaggtagccagagaacccattgatgttaaaaccaacttacaaatttgctagttttctgtgtattcataggttttccagttttcctgggataattataatggtttaataaaataacaagaaagtgtatggctaattccactttataggcctttgttgaaagactgacttctctggaaaaaaaaaaagaaaaaaataaacaaagaaaatcaactcaaaataatgtttctttctttgggtctttattgcacgtattgtgacatttcatacagtctgttttttaggatgagccaggtgcagtaaaagcaacactaattcagactaattaaagtaaaggttttctccagtccgtggtcttcttaaaatgcaggctattttacaataatttaattgagattcttttaagtgtaatagaattgaaactaggctaacaatatgttgaatagggagtgagccttaggtcactagcagggttggttaatttatcattaatatttcatttgattcttttaaaaagatgctgaattcaacaataataataactaatattttgagctcttaccttgaaaataaagcttggctatctcatttaaaccatatatcaaagctatgaggtgggtattcttattttaaaatctccattatacagagtgggaaaacaagcctcagaaatcacagagcaggcaaaacccaacccagattttcttcatgtcaaagtttctgccatttgatacttctacatacttgtagaagtataagtacatactggaaatagtttgcattctttaaatattttatccattcatatttatagcctgggtccaaattatttcttcatgcccaataaccttcagcctaaacttagaaggaataatttcatatttggtcatattaacatctaaaatgatagtgatttgctgtttccagggttttaaatcatgtgcttaaatgtacattaactcatatcagataaggtataagagttatttcttatgacactcatttttaaactttatttccttcgtgtaaataaatttcctttctaagcaaattttcatatttttattttgtgggtacatagtaggtatgtatggggtacatgagatattttgatataggaatgcaatgcataataattacatcatggaaaatggggtatctgtcccctcaagcttttatcctttatgttacaaataatctgattatactcttttagttattttaaaatgtacaattaaattattattgactatagtcaattattattgattgtgctatcaaataccagatcttgttaattctttctattttttttgtactcgataaccatccccacctccccaccccaaagcaacccccaccattcccagcctctggtaaccattcttctgctctctatctccatgagttcaattgttttgatttttggatcccacaaataagtgagaacatgtgttgtttgtccttctgtgcctggcttatttcatttaacataatgacctccagttccatacatgttgtagcaaatgacaggatctcattctttataaaggctgaatagtactccattgtgtataagtaccatgttttctttattcattcatctattgaaggacacttaggttgcttctaaatcttagatattgtgaacagtgctgtggcaaacatgtgagtgcagatacctctttaatatactgattttctttcttttgggtatatgaccagcagtgaaattgttggatcatacatggtagctctttctttttcattttctgaggaacttccaagttgttctttatagtggtcgtactaattggtggtgtacagtcccaccaacagtatatgagggttcccttttctccacatgctcataagctttcttattgcctgtcttttggattaaacccattttaactggggtgagataatatctcattgtagttttgattagcatttatctgatgatcaatgatgttgagcatcttttcatatgcttgtttgccatttggatgtttccttttgagaaatatctattgaaatcttttgccgattttaaactacaattataatactttatgatagagctgtttgagctccttatatattctggttattaatcccttctcagatgggtagtttgcaaatattttttcccattctgtggattatcccttcactttattgattgtttcctttgctgggtagaagctttttaacatgatgtgatcccatttgtccatttttgctttgattgccggtgcttgtggggtattactggagaaatttttgcccagaagaatgtcctggaaagtttttctgatgttctcttgtagcagtctcatagtttgaggtcttaggtttaagtatttaattcattctgatttgatttttacatatggcaagatatagggggtctagttttattcttttgcatatggacacccagcttccccagcatcatttattgaaaagactatcttttccttatgtgtgttcttgccacctttgtcaaaaatgagttcactgtaagtgagcaaatttgtttctgggttctgtattctgttccattggtctatgtgtctgtttttatgccagtaccatgttgttttggttactatagctctgtagcagaatttggagtcagataatgactcctccagttttgttcctttttctcgggatagctttggtgattctgggtcttttgtagttccctataaattttaggattgtttattctatttttgtgaagaatgtcattggtattttgataggaattgctttgaatctgtagtactttgggtagtatggacattataacaatattgattctttaaatccaagaacatgggatgtatttcattttttgtgtgtcctcttcaatttctttcatcagcattttatagttttcattgtagagatttttcacttcttcggttaagtgaattcctaggttattgcttttacttgtggctattaatgtacatgatagtactcttttgacttcttttttagattgttcactattggtatgtagaaatgctactgatttttgtatgttgattttgtatcctgcacctttactgaattcattgttcagttctaatagttttttggtggagtagttaggtttttccaaatataagataatgtcatctgcaaacaaggataatttgacttctttctttccaatttaggtgccctttattttttctcttgtctgacttccagttatgtattgaataacagtggtgacagtggacatccttgtcgtcttccagatcttaaaagaaaagctttcaggttttcctcattctgtatgattctagctgtggctctgtcatatatggcttttattatgtttagatatattccttctgtgcccagttttttgagagttttttaatcatgaagggatgttgaattttatcaaatgctttttcagcatcaatgatgatatggtttttgtcatttattttgttaatatgacatatcacattgattgatttgcatatgttaaaccatcattgcatccctgggataaatcctacttgatcatgatgaaggatctttttaatgcactgttgaatttgttttgctagcattttgttgaggatttttgcatcaatattcatcagagatattggcctgtggttttcttagtttgacgtatctttctggctttggtatcagggtaatactggtctcattatagaatgagatttgtagtattcccttctcctttgtttgtttgtttttttgaatagcttaagtagaattggtattaattcttctttaaatgtttcataaaattcagcagtgaagccactgggtcccgggctttgctttactgggagactttttattacaactttgatttcattagttgttattgatctgttcaggcattggatttcttcatggttcagtcttgataggttgtatgtatctaggaatttatcaatttcctctagattttccaacatattggcatatagttgctcatagtacctactaataatcctttaaatttctttggttttattccatgctcctgcataggaagaatcaatattgggaaaatggccatactgcccaaagtaatttatagattcaatgctattcccattaaactaccattgacattcttcacagaattagaaaaaaaaacgtaaaagttcatatgaaaccaaaaaagagcctgtatagacaagacaatcctaagcaaaaagaacaaagctgaaggcatcatgctaccctacttcaaactatactacaaggctacaggaaccaaaacagcatggtactagtacaaaaacagacacatagaccaatggaacagaacagagatctcagaaataagaccacacatctacaactatctgatcttcaacaaacctgacaaaaacaagcaatggggaaaatattccctatttaataaaaggtgctgggaaaattggctagccgtaagcagaaaattgaaactggaccccttcctcacaccttatacaaaaattaactcaagatgaattaaagacttaaatgtaaagcctctaactataaaaaccctagaagaaaatctaggcaataccattcaggactggcacaggcaaagatttcatgacaaaaacatcagaagtaatttcatcaaaagcaaaaattgacaaatgggatctaattaacgagcttttgcacagcaaaataaattatcatcagagtgaacagacaacctagagaatgggagaaatttttacaatctatccatctgacaaaggtctaatatccagaatctacaaggaacttaaacaaatttaaaagaaaaaaacaaacaaccccactaaaaggtggacaaaggacacaaacagacaattgtcaaaagaagacatttaggcagccaagaaacatgaaaaaaagcttaacatcacagatcattagagaaacacaaatcaaaaccgcaatgagataccatctcacaccagtcagaatgggaattattaaaaaagtcaagaaacaacagatgctggtgaggctgtggagaaatagaaatgcttttacactgttggtgggaatgtaaattacttcaaccattgtggaagacagtgtggtgattccttagagacctagaaccagaaataccatttcacccagcaatcccattactgggtatatacccaaaggaatataagtcattctgttataaagacatatgcaagtgtatgttaattgcagcactattcacaatagcaaaaagatagaatcaacccaaatgcccatcagtgagagactggatgaagaaaatgtggtacatatacaccatggaatactatgtagccatataaaggaaaaagatcatgtcttttgcgggaacatggatggagctggaagccattagcctcaacaaactaatacaggaacagaaaaccaaacaccacatattctcacatataagtgggacctgaacaataagaacacatagacacgggcagggtggaggggaacaacacacattggggcctctcgggagggtagggagagggagagcgtcaggataaacagctaatgcatgtggggcttaatgcctaagtgatgggttgataggtgtagaaaccaccaaagcacacatttacatggggaactaatctgcatgtcctgcacatgtatcttgaaacttaaaataaaataaaataataaaaaagtacataaggaaaaaaattctgtagtttcagttgtaatgttttcattttcatctctgattttattcgtgtttcttccctttttttctttattagtctgcctaaagatttgtcaattttctttcttttcaaaaaccacctttttgtttcattgatcttttgaattgctttctttgtttcaaatttatttatttctgctctgatatttattatttttcttctactaattttgggtttggtttgctcttgactttctagttgtttaaggtgttttattaggttattcaaagtttgttttttatgtaggcacttacagctataaattttactgctttgctatatcctgtaggttttggtatttcgcatttccattatcattcgtttaaagaaatctttcaatttctttcttaatttcttcattgacccactggtcattcaggagcatattgtttaatttccatgtgtttgtatagttaccaaatttcatgttgttattgatttctagcttaatctcctggtggtcagagaagatgcttgatattattttaattttttgaatgttttaagacttgttttgtgacctaacatacggtctatccttgagaatgatccatgtgctaaggagaagcatgtgttgaagcatgtatagctgttggataaaatgttctgtaaatatctattaggtctatttggtctatagtgcagattaagtctgatgtttctctgttgattttctgtctgggagatctgtccaatactaaaattggggtgttgaagtctccagctattattgcattgaggtctatgtctctctttagctctaatagtatttgctttatatatctgggtgctccagtgttggctgcatgtaagtttgcaatcattatagccttttgctgaactgacccttttatcattatataatgacattctttgtctcttcttacagtttttgtgttggtatctattgtgtctgatctaagtatagctacttgtgctctattttggttttcataggcatggaatatatcttttttccatccctttattttcactctgtgagtatgtttataggctaagtgtgtttcctgtaggcaacaggtgattgggttgtttttcatccattcagccactctatgacttttgattggacagcttagttctcacacattgaatgatattattgataagtagggacttacccctgcccttttgttattagttttctggttgttttgtggtatcctcttttttcttttcctttttcctgtctttcttttcgtgaatgtgattttctctggttgtatgctttaattttttgcttttttattttttgtgtatctgttgtatggtttttaatttgaggttaccatgaggcttgtaaatactatcttattcattattttaaactgatgacaacacttgacactaattgcataaacaaacatgcaaaacgaaaactaataaaaaccctacactttaacttcatgtccctgctttttaactttttgttgtttttttatgtcttattatactatgtcttagaaagttgtaattattatttttgactggttcatcatttagtctttctacttaaaagcagtttacataccacaattacagtgttataatattctgtgtttttctgtgtgcctactattaccagtgagttttgtatcttctgatgatttcttcctgctcattaacagtcttttctttcaaattgaagagccctctttagcatttcttgtagacaggtctgatgttaatgaaatccttcagcttttgttttctgggaaggtctttatttctctttcatgcttggaggatattttcaccagatatactattcttgggtaaacttttttgttgttgttgtttgtttgtttttccttcagcactttaaatatgccatgtgactatctcctggcctgtaatgtttccactgaaaagtctgctgccagacatattggagctccattgtgtgttatttgtttcttttctctttctacttttatgatcctttctttatcctttacttttgggaacttgattattaaatgccttgaggtcatcttccttgggttaaatcttcctggtgttctatagccttcctgtacttgaatattgatatctttctctaggtttgggaaatttctgttattgtacctttgaacaaactttctactcctatctcctacctttgtttctttctctacctcatcttcaaggccaataactctttgatttgcccttttgaggctattttctaaatatggaaggtgtgcttcattgttttttattcttttttgtctcctctgactttgcacattttcaaattacctgcctttgagcttattaattctttcttcttcttggtcagttttgctattaaaggactctgatgcattctgcagtatgccaattgcattttgcagctccagtatttctgcttgattttgttttaattatttcaatctctttgttaaatttatctaatggaattctaaattccttctctgtgttatcttgaatttctttgagtagtctcaacacagctattttgaattctctgtctgagaggtcacatatccctgttcttccatgattggtttctggtgccttatttagtttgttttatgcggttatgtttttctggatgatcttgatgcttgtggatgtttgtcagtgtctcaacattgaagagttaggtattttttgtagtctagacagtctgggcttgcttatgcctgtctttgaattatcaggcagagacttttggtttcttcccttactttctctcagagaaatgaagtctctctctctgtactgagctgcctggaactgggggtgagatgcatgcacccctgtggcaagttcccccaggccctccgcggttccacaaatgttgtctgggagacagggtttagagtcaaaaaccttagaaatttaactgatgttctatttctctgaagctaagctagcactcaagccacaatacaaagttctttctgctcttccctcccctttccacaggcaaaagagcctctccctgtggccaccaacaccaccagcacatgggctggggcggtggtctgctgggccaccactgatgttcactaaaagcccaagggctctttagtcagcgtgtgggaaatacttccaggccagggactcacccttcaggcaatgggctcccttctggcccagggctggtccagaaatgatgtctaagagcctatgcctggattcagggacctcaaaagcctgtttgttgctctacctccctgtgatcaagctggtacctaaggtgcaagacaaagttccctttacttttccctatgcttttctcagacagaaggagtctgtcactatagccaccacagctgagaacgtgatgggtcatacctgaagtcagcccatctcagagcctaaggcccatggtgtactacgtgggtatcattgctggttattcactacccaacggctctttagtcagcaagtgatgagtcctgccaggactggtctttcccttcaaggcagcgggttctctttttgcccaggatatgcctagaaacatcatgagccagggcctgtaatgggggcatcatagctctgcctagtgctctatccaattgtggatgagctgatctccaggatgtaagacaaagtcctctttactcttcattctcctctccttaagcagaagcaaggagtcacttttgttgctgcgagcagcactgtctggagttggggaagaaatagcacaagtactccctttgccatgccagctgatgtctccctaggtcatgtaccaccctagtctactggctctgagctcagtgcagtactaggagttgcctaggaattgcagtccttatgtcctagactttcctccgtttgcctagaatcccagagcacttttgcctatggtggtgagcctttccaagagagtcaacttccagctgctgggatgggcagttcccctctgtataggcctactccaaatgctctctccatctgtgggcactggctgagcccaacatagttttgctttctgctgttacaaggcagcactgagttcaatgtaatgtcccccagttgctgtgctcttcctttcccaagtgcacagactctctgtgctgcatggtcactactggggagtagggggaagggtgacattaacaattcaagactgtctctccaacccccttcaatgcctctttcagcaatatgaagttaaaactaggtactatgattgctcacctaatttgcttcttgagagggtggttttctatgtgtagatagttgctaaaatgtggtgttcctgcgggaggtacgaacactgtaagtttttattctaccatcttgctccacccctcagggatgaattatctattaacattctatttcattctattttcattctatgaactttgtagagggaattttttgtctttgcattatatgtgcccttctaaatgtttatcattttttactaactaccagtataaattcatcacatttatataattcaaaaccatagtatgctttcttaataaagaataacctctgaaaatagggtagtatttggtcctattactaatgcatcaaaaaactcttagttggaatcacattctattgataacaacttattttataaatcctctacattttataaattacttttaagtgcagaggaaatatctgagatggaattattaaatattagatagcatacaggtaagatctcattttagtgagcttgagagacagaaaaatgtcattacaatggaagcatattccttccaaaatatcagagtatattgaaaaatgtgtcaaactttattaataatattttccactatatatacagatattcaaataaaggtcatcccaatttcgccagctcacacactcttcttgttgttatgcttggaaacgttgctatgctggagtgtttcagaggtgatgtgcaataatgcagtcatagatcttaggacgagaggtgaattactccaaatcaggtccagatctgcttcaaggtaggatgatgccagagatttgatgagttttaggaagaactggcaacaatttaagcaagaaattccactagactgatcattacttatttcattttatatttgttcagaaatatttctgcattctgctagatgaggaggcagagaagagattgaatgagacaaaccttctgctttgtatccttttccttgccattttagatttcatcaaatgggaaggtgccttatttcagacaaacttctgcttgatctgatcttttatttccctatttgtacatataaactatgacttttactgatcacctatgcccacttgttccgtctaccaactatgttcatgacaagttagaatcatcattccctatcttaaagaatcaaacttaaaaaaatttctatatctactctttatattagatattatgaggggcgtattactaacttagaaatggtctttagtgagatatttagacagggtaagttttttttttttttttttttgagacagagtctctctctgttaccaggctggagtgcagtggcgcgatcgtgactcactgcaacctccgactcttagacagtgtaagttccatcgatagtaagaataagcagttcaaagtaaggaaggcatgatgtgtcataatttatctcatggccttggcgtctaacattttcaacatggattcattgttttgaccagtgccttatgtacaaacaataagaacactctccaggttaagagtaagacagagtctttatcattttataattttatatgtcctcaatgccaagcttagcactcagtaataactaagtgcccaattcttattttgagtgttgtctttctgcttagctgtacatcagtcttgagggggagaaataacataattcaattagcacattatcatggattagagctcttgaactttgagaaaggaagattcaggacagttagagtcaacagagaaaaagggaaaagaagcatcttaacggtatcaaacctgacattatattcaggtggaagggacatgactactgaaaggcaaaaaaagcatgctaaaagtagagtaccagagtacagaaagaaaaggcaactgtttaacactttttatctaatgcaacttgatttttgccccaggcccccaagatggtgtctgttagagtgatgccgaccaaagggatacctgtcatgaatgtgaaatgctgcagattgcaaggaatggaaaacctagatgatggataaggagcttggctgttctttgtttgcctttggcatcaagtctttgggagatgaaaaggtttctccaaagctggctttgggcaagtggtgccttgtgtaggaatttgtctttcaatggatttcaaatccttacctttacttggtctttaactcttttagtttctatataacttaattatttaatttatttttttgaaataaattttttttaccttcataattttttgactgctctattagttttttaagtttctttttttgaaggatgcagtaatggctaaagcccatctctctctttctctcattattttttcttatatgattaaaacaatgtcaaaggctgtagaatatggattacgaatttttatttcacacaagagccattcttatactcatctcaaatgttactcttcccagttggtgtaaaactggagcgatatgaatgatcaaaattttaatgttgttcaaatccaatttcaaatttatttttaggtacttcaagtttcttctccacctttattcaggtgatgcaggtgttcaaatgtagcaaccttttcccatcatctgcttagttcaccacacagtatctcctcacattttggaaaataattgctacaatattgatgacataattatagctataacttctaataaacagcattaacctgtattagacatgcacagggtggcttctcaaaggattggatgtaattggattcattgaaaaaacctggttactttagtgataaaacatataagtcactattcttcctctttgctaaggacaaatctgtaatagtattatgcatatccactccacattgtggtttacatttaattttgcactttctctgggaagtttctgatagcagtgatacggagttcataatactggatgaaataaaaatgtctgggggtgtctaaagcatcttattattatgtcatgattcccaatgaaggaatttgggggatttatagagattggataaaaagatatttagattttttcctaatttaattaatatgtttgagccttttctctcttttccccatgataataatttggaattatttagtacaatatactaaaaaatattagtaatacaaattgtaaagtgaaactttattgttaatatgtaacttctttcctataattattgaggtagaaatttagccttttttttcagttatgatgcatttaattcagcatatttcacagaagctattcatttaacttaggggatcaatagagaatgctttcattattgcaataagaaaaaattgttaaatggtataaaacctaagattttagaagaaatcattattattacctatattccattatgaggttaataatgaaaacttaggtgaactgacaaaaacaccatgatggatattctgaagggtaattttcctaaacctcagtgcacactaacctggcccacagcaattagagaagcggagcacttagccaagacaccctactgccatcaagcaaccaggaatggcagcaagcagtggtacctgtaaagaatgacatgagtcaaaacccagaaaacaaacattgttagacactgtgtacaaaggacttcatcatttgtacacaaagcctcatcattgtttggtgattcatactcctatatacttggtgataacatggaaccatgaggctttcagttttcagttattgttgatctctcagagattaaaacaataatgatacatcaaaataagctctgaaatatttgcaatttcaaaaatagaaatattttaggaacataacttattgtattttagccaagcatatttataattattcatctgtatgctgaccagttcctgtcaaaatggaaggctaagctggtgtgaaagtttagcctcccatgtaaatgcagaaatgctcgataaaacataagtaatccctggatgccataaatgaagtgggacttccaagtttgtattagcccattttcatactgctataaagaactgtctgagactgggtaatttataaagaaaagaggtttaattgagtcgcagttctgcatggcttgggaagcctcaggaaacttataatcatgggagaaaatgaaggagaagcaaggactttcttcacatggtggcgagagagagaagtgtaggcaagagcaaacaaccccttataaaaaccatcagcttttgtgagaactcactctccatcatgagatcagcatgggggaactgccctcatgatccaatcacttcccaccagttcctgccctcaacatgtggggattatgtggattataattcaagatacgatttgggtggggacacaaagcctgaccatatcaaggttagaatactaaaaagaacctaaagttcttgtagaacatgtgtgcatcagaccctaggtgccaggacccgagagcttaggttctaactttcactgtgtaacaagtttaagacctatatgggaatctattgcataattctataacctacaaggccatattgaccatgaagcatgaaaaagaaaaaagataatttaaaaaataatccctaccctacattcttgggtgataagaaaaagtcacccatgagaaaacaggactccaaacctatgacagtgtggggattatgtgataatgtggggatctgccatctagagatttaggaaaatcaggatgaggcaataaaatggtaactggtccagaacctgtgcaactcctaaggcccccatgagggcaaatgtactgcagggatggtttctaaaccagggcttcttggatatctaaagaaatccaaattaccaaaattactcaaaatagaaaataaaaagcacacaaaataactaaagaacatcatgagggagggacatgacagagaatcagcaaatacaagcaacatggtatttaacgaggggggactataacaaatctggaaaaataccatataaatatatttaaaacattaaacattataacgtgttatagatattataagataagctttgaaaaagaaccaagtaaaacttctagaagtgaaaagtcaattattaagacgttaacttcaattgccatgttaaacatactaacatgcagttaaagaaaaataagttaactatcaggcttatatgcaaaaaccatccagaatacagtataaagtgacaaaaatataaaaacgagtttgagataaatgggagaggatttcagaaggcccaaaatacagtcatgctttgcttaactatagggagatggtctgaaaaacacatcactaggtgatttcatcattatgtgagcatcaaagtgtatataccaagaccatcctggccaacatggtgaaaccccatctctaattaaaaaaatacaaaaaattagccaggtgtggcagcacgcgcctgtactctcaggtattccggaggctgagccagcggaatcacttgaaactgggaggcagaggttgcagtgagccgagattgcaccactgcaatccagcctggtgacagagggagactccgtctcaaattaaaaaaatgtatatacattaacctagttggtatagcccactaatagtatttatgtatctaaacatagaaaaggcatggtaaaaatacagtgtaaaagataaaaagtggtacatctgtatagtgcacttgccatgaatggagcctgcaggactggaggtttctctgggtgaatcaatgagttagtggtgagtgaatgtgaagaactaaggttattactgtacactactgtagacttttagctacattaagtttatgtttttctttcttcaacaataaattaaccttagcttactgtaggttttttattttataaactttttaatttttaaaactttttgactcttttgtaggaacatgtagcttgaaacacaaatgcattttacagctgtccaaaaatattttttacactcttattctataagttttttctatttcaaatttttattttttatttattatactctttaagctttttttgttaaacaccaagacacaaacatacacattagcttaggcctacacagagtcaagataattaagacgttactaggtgacaggaatatttttggctccactatagtcttatgggacccctgtcatacatgaggtccatcatcaactgaaacatcattgtgtggcacattactatatatttaatagaagatcaataactagagcttagatataatgggagaaaggcagcatttgaagagatagtcatgtaggatttttcagaagatatgcatactcagaataaaagaacataccaagacccccaaaacacaagaaaaagaaatctacaccaaggcacatcatagtgaaattacagaatatcacggaggtaaactttaaatgttaatcaaatttgaagacagaagatcctccaagttacaacatttatgccaacaacaacaaaagccagagtctgtgggacagcatctgcaaaagacagaaatgctactaccctggaattctgcgtccagttggactgtcactcaagaatgagaacatgataaaaacattttcagacaacatccaagacagtaaggcctgaaaaaaccacaaaaacctttactttagtaagaaggaaactagggagcagggggaaatgggaagttactaatcaacatgaagtttcagttaaacaagatgaataaattctagacatttgccatacaacattgcacctatagccaacaatactgtattatgcacttacaaacatgttcaaattacagatttcatgttaaatgttcttacgacaataacatttttaaaaatgaaagaaactaaatccagatgaaagggttgaaatataggagccaatgacaaacaatattaatctgctctttaatttaaacaattctaaaaaccaagtcatttttattctcaaatcataaaaactttgttatgcttttctttttatataacaatactttaaagaaatatctgttatttgtttcaatttgctttaaataaatagaaatagcaacgatgctggtatgtttgattaaaatgtgaagaatacaaagaatgaaatgttaggtaaccttgaagaagttttgatgtcatgatataatgcttatgttaagaaaatgagaaagaaaagcagcatataaacatcatattcactattatgtaggctgaataaaaatacataggaaaaatatttatggctatgtaccaaaaatattaaaaatcatttctttggtggcataaggatatttttccttttctttatacttttcaaaatcctatcatggacatataataataaacaaacttcaaaatacttaaacacatacatattttaataaattatgagtttcactaataaatgccatgtttatgttttgcaggcaaatctctcctcaccatcttctacagtatctgagagtcagctggtatgtatcttctaagtcacagatctactgcaaattctgatctctcaagagagctttacctgagtaaaagtgaaaaaaagaatacatttactatatatatttttattcacttacttgtctaataacattttactgatattttccaaaagctccatggtggttgttttgcaggtgacaaacatacgtaaaactatacatagaccttacttgctagtaacttacatccaagtagaggcattagaagagattgtgaggtcagatgaaagatgccattagaatttagagaagagagcacactctttaaaggaagagatctaaaaagagtttaaggagaaggtcatgattgagtaggatagtttttggatttgaggaaataagaaatagatatgtcacacaggagaattagcatgcaaatggtctagatcagtgctgagcaatacaaacacaacgtgaatgacaaatgtaagccacatatgtaattttaaaacttctagtacccatattaaaaaagtaaaatggaacaggtaatgttaattttcataaaatattttatttaatgttatataaatattatcatttcaatggataagcagtataaaaattgagatatttttacattactttttttgggaaaagtctttgaactattgcatattttacatttacagcaaatctcaattctgcctagtcacaagagctcaacagtggggactacattgggcagcacagatccagactctaaaatctgttatttgaagataaaatttgattaaatgagagaattattttatcttatagagttttgtatttcttatgcttacagtggttaccaaattgaagtcatgaaataagtttccgagatattactggtcaaagattttctttttttttttttttttgagacggagtctcgctctgtcggcgaggctagagtgcagtggtgcgatctcggctcactgcaagctccgcctcccgggttcacgccattctcctgcctcagcctcccgagtagctgggactacaggcgcccgccaccgagcccggctaattttttgtatttttagtagagatggggtttcaccatttaagccaggatggtctcgatctcctgacctcgtgatccacccgcctcgacctcccaaagtgctgggattacaggtgtgagccatcgcgcccggccaaagattttcttaatatctttggctatttattgtctaaaattgtaaattcctgaataatagatatcttcactaaaatgatggaaatttctagtaaaacagtttgaaacattaactgataatccccttttaaagaaattgttttggtatcctatagccacagccaacaaatcatcttgtcattattatcccaataaaaataattacaatatatttatttgtaatactgagaaatcataaaaagtgttgtttgacttttaaaatagcttgattcaatcaatccacttgggtatactggtgtttatacatatagtgtgtatatggcatgtgtttgaatatgtgtgtgcattagtgtcaattggtttagaacagtgtgtgtgtgggggggcaatatagtatagttgaaagaatctgggatgagtatcagaagacccaccttatacttcctgctctgacattaactagtggtctgacagtgggtaagtcaaaagtccgggagtctggatttcaatttcttaattgaaagtgagagcattctattgcgtactttccaagcccttccagggctgtgaatctatggttactaacacagtgaagttgaaggagttgccatggaaacaagcactgcaataacataatgaggttgaatgacttcccactttagatatggaaatattactacaattattttagtatttaaaatgatatatttgtttatttagagtaatatatggaaatgaatgttttaaacattctcatatatagtttcactcagtatagtatataaaatatagattttaggtgttggactatatatacatgtgtaggtgtgtattttacatacatgtaagttcttggtttaatcctttaagaaattatttcaaagtggcaaatatatatatgtgtatatatatatataatgattttataaaataagatatagtaaaacaactctttgtgaatgtaataaaaaaaacttactttttgcccaataaaataatcctgttgtttgtgttctctagtggcaaaactacaaagcattgctttgaatgacttttataataatttctctgcatttacttaagtccttttctctaaggagttcaaggcatttcttaaccaagttttaaattaagttttaatctcaaaatgcccttgagatacaggtaggtttgtgaagggattattatcaagtaagcatatcacattaaaaaaaaatctcttctactgatatgtttattttattcaataattttggtttctatttcatgtcgttagccctgtgtttatattaatactacccgagagtgaaataaatagtggaaaatgattgtatgtaagacatattataggacatgtacttcactaaggaattagaatatttttacacttaagtaacactatttataaagttataattttttcatttttatgaatgaattttcaatatttgccatcacgaactctttaagttctgaataatatgagtaaataagaatgtctttgataaacaaaactttgatatatatatttatatttttatatatgtatgtgtttataatatgcatacacatatagatgacatatgaggtaattctgattgtttatatatacacatctttgtttatatgagtaaatatgtatggatgtataacgcataaaaacaaagttattggaaatgtatgatactttatagttgaattatataaacaaatatttgttttgtgtaaaacaaactaaatagttaaaattatttgactcctattttaggaggtaaatgtagtaaatgttttgaacagaaaatatatgacaaagtgctatggtaccacaagcttaatgcaattctcaaattgcttttgagatttaactttttaacgatacatcattttttcatgctttcaaatttttaacttggctgatctgtttgcttgcttttattgcaagtgtgccaattcagaattgaaaaggaaagaagaaatagagccatgacccttactcttaaaatatttccgttgtttactctggaagccaaatgatttagaggagcttgggagactgttttggaggttcatgtgaagctagttcaccaatcttagcttctcttctactattaaactgcactgcagtcgatcagaactggaaaggaaattagagatgaaaatattggaaattcccacctattcactggagattggaataacgactctgtcagcctgaagggattattgtgaggctcacatatcataaaatgtggagttgtcagtatactcctatggatagggagaggttatttttgcacataaaatctgtgaatgatgaagagatattatgagcagccatttttacagaaaaagaaagaaatgcttatgtagttaaatagattatctaggatcaccagcattagtgttcatccttgctttatgtagttttggaaaatgaatcattaatattgattttagataattcaaggaaaataagaaaagagtaattaaggagtttggaaacagggcctcactggaagcattactttcactgggtacctcctgtgtctgactctgcctcgtgtttttgcactgcctggaaaatgtgagtacttacctaagaggagactgggtagggtcagttagagtactgaagttttcacagctgtgaatagtgcttcctgtagcatattaaaaggagcaagaggaaaggaaagatctagggtctgcgttaaaccttcacaaagctttcctagctgttgagctgaatcatcacaaagatattaacaaaggccagcggggtctttttccctgcataagataacacacaagttaggcaccccaaggtagctaaaccctggtcttctttggcagtaggggagcctggtttagatgacatttgccttttgcttttgaaatttcatgccgttacaaaatgttcactgttgtccaggatggaatacttaatctaaagagcacaaaacaatagattttaaaaataagtcacatggctatatacaggtaaaagcaagatgctatttactggaacactattaagaagagtgcttaaacttgcaaatactttgttcctagttctgaatgccagctgatgcatccagctttagcggtgggtgcatgactcatctttctgagggcccttttaaggcctctgttgttcagaaaatgcagccctgaaagcttttatgtagaaccgatgtctccttcaagctcaaaggcagtttctccttgaccagtttttccttgacataacgtacttaagtgccacagcatttatcaggtacgcctcctcaggtttgagtcatgctatcatcttttatttaaccattgaaatatttcaatctggccaatctgtattgtgtatatttcatgaaatggttcttgagccatgagatactgccaataattattgaggtcttatgtgcctttatttttatacaactattgtaatcattataaaacttttttttggaaaaacacatcaagtaggtacttttgtgaatggtctagatcatttagaatcaacatgccatatttataattgcaaagtatatattctgttttactttcaaatttattttatgctgttttttctttatcaagttttgtcatgcatattatctcattaggttctcgaatcaccttggagttagtatggcaggaattgttatttccattattctgatgaaaaaactgaagtttaaatatctagaatgccatgtcaatagttgcgtggtaataagtggtataaaaatctcttttgttttttccaatattgggagctttaccctatgccatagtgttttgagatttaagatatttgtttgaggggaaaacatagcttgagtatttgcttcaagtatataataatgtttgtttaaaacaagaattagggtctataaatctgtattatctgaatgagtaaatcaggtaaataatctagagaatattgcttttgcccacaattttgcctggtagaatatattgagtttgcacaaacttttttgccatggaaattctaaaggcaaagaaaaaagcactggagaatgaagacaaaactgcagcaaatgggtcaaaaacaaccatggcactttcacaaactctttgagcccataaaattagtagaatttccagccagactcacagaatttgctatatgttgttttgtcactttcttgcagttttgttacacatcttatctctccagaaagattaaaataaactcttgaaagctggcaccctgtcctttatttcttttttgctttatcacaccacccgagagcttattactatagtcaaaggcaattaaaaaacatcagtccattagtgttagttgaagttactagtttaagaaagattttgctgtaaaaacccattatttaaaaatattggtcatggattctctaggtcagcgctggtagttaatctccaactttggtctctagctcagaggctgtaccaacttgctgtcatagaattataagttccaaaggatggaaatagtatctatttacatagtgcccaaagtgacaatgttcaagtatgagtgtatacctgatagattataaacacaaatcaatagcaggcttagacgagtgtcttatagcccattaaaacctgccactgggcttcggggagcccatatattcactcccttggatttttttctgtccccaagactaatgttagcatcagatataatatcctcttctcctccccactctccactcttgaattctctaaaaaagatgacatcattgtgttttggtattaagagttttattgcatatcaccatgaacagagggagaaaaacaacaatttattttaaatgaagaagattaaaatcgtgtaaagtccctaaagaagtggcctctttccttgactttctgaagatgagaactttggctttctactctttcttctgagggtgaaactcaccaacccactttccttcttctcatcctctattggaaaaatgccatatggctcttctatccctcaaagttccctctttgtgaattatattgtgatcaaaaagccaattcaagaaaaataatggaagacctcaaggagtcaatcagcacctttttttaaaaaaaagaagttattttaagttccagggtacatgtgcatgacgtgcaggtttgttacataggtaaaaatgtgccatggtgatttgctgcacctatcaaaccatcacttctgtattaagcccagcatgaattagcatattttcctaatgctttccctcctcgcccacaacaggcctctgtgtgttgttccctaacatgtgttcatgagttctctttgttcggcccccacttatagtgagaacatgcagtgttgggttttctgttcctgcattagtttgatgaggataatggcttccagctccattcatgtccctgcaaatgacatgatctcattcctttttatggcttcatagtattccatggtgtatatgtaccacattttctttatctggtctatcattgatgggcacttgggttgattccatgtctttgcattgaatcagtacctcttatagactccatattgaattatagtcagcacactgagcttctgtctgtcaattaacttattcattctgcaagtatttattgagcaccaaccaggtacaggcaccattctagatgttggagatacaagagtgaataaaccgaagatctctggtttcacagaacttacattctagttgagaaagaaagacaataaacacaaacagatgtcaggtagtggtaactgctgtggagaaaataaagcaggtaagagaggtggagattgctattttatatggctcattaaaaagatctgtctgataaggtgatgtttaaacggacatttgaaaaactgaaaaagaaggaataagggagttccagacaagggaagagcaaatacaaactcctagaggaggcagtatcatataatgtgtaagctagagtagaaacagtgaaggggtggaagggagagtactaggaaataagattggaaaaagagaggctggttagggatatgaaagatcaggtcatacagcacccttgtaggcattgctttgtaggcactaccagggctttgaactttactctcagtaaaaaggtgaggcattagagagctttcagaggagagttgacatgacttgatgtagaactgacggacatcatttaggagatgagtgacatgactcgacttatactgtggttatcttatgatttattcaacaggattgtgaaccctctgaaaacagggggtatgtcttttttttatctctatagacactatagttcctgacacagactagatcttaactggcaaaatgtctccagtgaacatctggtagaggtgtgtttcagagttgcaaaacagctatttgtctttcaggcacttcaaaaatgtctatacccagtgtaaatcagttctcagtacattcatgaattgatattttcgatttggagaatcttctcattttttttcttgtgccctttgtgctggctatgagagtcattacattttttatttttccacataggctggaaagaaaattacaaaactgctttttctggcatcattagacggccatttgcacctatcaatcatgagtctgactattctatggattctatagtagataaaaatgaaagaagggcctcttaaggctagtttagttgtaatattgctgaacaatgacaatcttacagtagttcagttttatagactcccctaacttgatagatctaatttcctctgtgtttgtttggacacagatgtaacaaattaaattgttcagaattagagaagttgttcaagagaacctttacttgaagtccaaaggtatcagcaaagatcactacacacaaagttgcaatgtagatgaggaattaataaagcatagtctgttttaaagcctctccttcagtctggagacagaagacaaggccaaatgggtgtctctggaatgatagacttagaaagatctatctctacatgagcagcacattttaatgtattgagttcaagtctagtgtctttcaacttttaatgtgtacatgaatcgcttagggatttgtaaaaatgcagattcggattcagtaggcttaggtcgggcactgagctttggcactcataacaggttctcaggtgatgctgatactggtctacagccttcattctaagggtcaaagtgctagcagacaatgtcttaattggatagaacattagttaactttctgttgcaaatgtagattgcatcaccatttgacattgtgaaacaaggtatgaggaagaattgaggggaagttaactaatattccaagagagacttatgtgtgatggcaacagtgccagttgcttcacatatgctgttttatagactttctaagtggcactttgagacccttgtttgggtgatgggtttgaatatgcagaaacaagccctttgctgtaactctgtgtggtataattcctgaggggtcggaaaggtaagtaataaagtgtgtcattacccattattaaaggacatagtcatgtattagaattacaacccttcaacagaaggtctacacaggttgaatggcttttccaaggtaatacagtttattaacaacattgcaaaaactaaaatctatgtccatgtttctctccttctacaatattatgctacttcatgagagtaaatttttaaccaaatccagagacacagtgggaatttgatgtcttggccatgcaaattatggagtattttaggaggtggtgaagaggtgtgtgtgtctgtgtgtgtgtgtgtgtatatgtgtgtgtgtgtttgtgtgtgtgtgaagagagtggatgtgtggatgtgtacagtcaccaggaactgaaaacattagataacattaggtcctaaatgttctgagaatatttaggatggctaatgaaaagaaagtaaaatggcatagaatgagttagcaatggccaaaatcaaggatgagacagttgacagtggaaataaaacagagaaacaataaattttaaaggaataaaacatataaaaactacaggagctttgtttttgattagacaggataagttacagagaggtggatatttaacaaagatttcaaacttctatctattctatgatgtctctcttcctccctggaatcggcatagaagtgataaaaatcacaggcatgatgatcacaccaaacatggatttaaaccttaacatattaactgcatgactttggcatgtgacttattacctttaaaactcccaaagaatttacaagaaattgatgagatgatctatctaaaatattgagttcagtttttgattctatattgatagaatatagaatctgtgtctatgagacaatgacaatgttattagctgcaatgggtcctcaaggattttgaagccggttttgaagcacatgaaaaggcatgaggaaggtgcagaggctaccatgcagatgacttgttagtataccaaggtttgtggagggtgcatgaggttcagaattgggacactagggttagatttttaactggaccaatagtgagagatggttgggtttgaaaggtatggttaaagattataggatgagaagtatgaacaatgtcaaaggcaaactatgtgtagtcgtcttttgcctagagttggcttccatatctatgaagtattgactactgggtaacaacaaattaaggttgttggagcaaagaacaggactaaagaaaaagggaacatatacaatgtaaaaatcagggaaaccatatgaagaccaagtaagtaaatagaatgaggaagactcagagacttcatatagcccaaacctgggaacacaaagtccaagaaaagaacgtggaaaatctggtagagtggaggaaatggagcaaaaatcattgtctaattgtcagagacaaccatcaaatccaggaaactcataagaactaaagagcatgaaaactggtagagaagcaaatatgaagcatcagtaacagactctgatactgaatgtatctgatatccaaccaaccagaagagtctctcttctgatgtcaccctggaaaggactgatcccaagacagatgatctgagtggaatgccctaggccagaataaccccaaacatctgcctgcttgcgataaagggacccaggcagtcatatttctctggcagaggttatcctaccatccaaagtgctcctgattagatttcttctccctgctttcatctttctgcatagtgacaccaagcttagcccctaaagtaccatgttggttttacagccttgtagcccgagtcctggagttgcatttattttctgcctcacaagggagtagaagagaaggagaaagtgcaggaagtgcaggaataggagaagaagaaagaagaaatgaagcaggaagtcaaatgaaaaaaagagacagaggtgtggacaacttaggatcatggcccagatatcaggcatctccataattacaggtggctatagaaatcaggaactgcctggacgttttttttttttttttttttttttttggcagcacttaatggaggaatattgttctcatgtgtatactctatggcatgacttcatgcacaattggatgttacttattcatttttccccttgagaaaaatcagagtttcttaagtgggagatatttctcagtttggggaagatagagacttgtctcaatctgtattttcccagttgtcatatacatgaaagaccaaatatctgttgaagaaagtattgcagagtgacatttattcaagactcaaaatatatcaggtgctttatagagcagagagatagatgtagtcccttaaggcttaacttgtgagcatcagcattgactgaaaagagctaatttaccattttccaaaaggaaatggggttgagaagaatgattgcagcaaaagtgcttaaacagaaagagcatcacagctttttattaaattattgtttgggatgtttttgcaaacgtcaatctttctgtgacattttacggggtaacaagattttggtgtttgtgaaacatcacattttgaaattaccccaaactagagttctcctgcctctctttgtcaaatcgacactgggtacaagcttaagaatctcgagtgactgatgtattagctaaaattctttggattgcaagtgacaaaagtaaagttgagttaaataaaaaggtgtgtgtgtgagggaatctggtgtaaaagaaaaggaaagaacgtcaggaaaggaaattcatgtaggcccctggaatgtttggggagtcaattctggaaagccctctggtgtctctcctttctgggctgcccctccatgcactttgctctaaccttcttgatctcagcatatctgctttttaggtcatgttaaggctttcctgtagcttctacatgacatactttaatttcagtctcccacagttactgcacaacagtttaaatccctgttccacgttattgggagagacaatctatttgccacccaccctccactcttttaggtcagaaagccacctcagttcataatatgaacatggcatctgggggcccagctttgtagattttggggcatggagggtgagcagtttccagaaaaagaaagttgtcatgggcttggtggatataccaaagtcatctatgctatcatgcccagaatgctgcctgacacagagaagactctcaataaatacttagcaaatgaaatatgtgttgaccaaatgcaccagcaagggtagaacatgtttgcattttgaatgttacaatagtagagctttatgaactgattgctgttatagttaaattttaactaaacttatattagttaaaatcatttgacttcaggctgtttttatgcatttttgaaatcattttaaaattaaaaaaatataattttctgtgagaacagcattgaatgacttaacaataaacatatttgttcattttaatagtgtttttttcctgtttttaaaatatttattttacattcatgaagactaagcctggagtaattcgcccagtacctgtaaaatccagaatattactgaaaaaagaggaggaagtctatgaacccaaccctttcagtaaatacttggaagataacagcgacctcttttctgaacaggtgagcacatacaagagaaaatgtttgctattttgataaatataaatatatataaaatatatataaatatataaatatattttgataaatataaaataaagatgtctctatgaatatagtatgcgtaagaacatgttcatttgattggaatatatttggtaatgaaaaatgcttgcataataaatagaagttgctaaataattcaagaataatattttgaagcattttaatgtgtttttttttttttctaaaacttgtctatctagtgctggtattgttttggagaccaagatgttgctctctataaagacatcacaaaatcactgattggatgggtcatataggtgttgcattcttatttctaaaatcctgcttccagctggatacagtggctcatgtctataatcccagcactttgggaagccaaggcaggagtattgcttgaccccaggagtttgagacaagcctgggcaacatggtaaaaccccatctctacaacaaattaaaaaaaatatatagctgggtatggtggcgtgtgcctgtggtcccagctacttggcaggctgaagtgggagaattgttgaagcccaggcggttgaggctccagtgagcaagtaatcatgccactgcactccagcctgggtgacagagcaagaccctgtctcaaaaaataaaataaaatcttgcctccttttgaagagatggaatattttagatttggtatactgaagttgacaaaagtcctgtttagattcatattaacagagacgatgcagtctcccagattgggaagtaatagtaacagaatcggggatcaagtcatatttaggatttgttgttcattttgtttatgtttgaaaagtctatactagattctccttatatatgttgaaggaggtataatggagaattgtcaatggtgctttatatttgtgaaaaatatgaaaatacacatttatgcaatataaaacttcataatgaatagcagagattttaaatctttgtcatattaaaatgcagcaaagagtatgggctatatattttattgagagattgaaatatgaaattaataagcaatgtaagatattcagaaaactttctgaatacagtcaggacatgtaagatcatcatattttataatccataataaaatagatttaggaatataaggtgttatgctctttttaaaattttagtttgaaaataataactaacaatattcttgaaaatataaattataattacatttatatttatatttataaaacataaagaatctcttatctgatgtgttagctctgtgaccatgggcaagtggtgttatctctctaggcttcagtttctttctttcttcctttctttttttttttgagatggagtttcgctctgttgtctaggctggagctcaatggcgccatctcggctcactgcaacctccgcctcttgggttcaagcgattctcctgcctcagcttcctgagtagctgggattacaggcgcctgccaccactcccggctaatttttgtaattttagtagagacagggtttcaccatgccggccaggctggtctcaaactcgtgacctcaggcgatctgccggcctccgcctcccaaagtgctgggattacagccgtgagccaccgcgcccggctggcttcagtttcttaatgcacaaaatgaggtgttcagattaggtaccttttaaggatcctttaaacactaaaatttgcattacttaaaatctatgattaaccataactgggtctgaaatccctatgtaaccttgaaaaagttcattacaaatactttttatgattagttctagtttttatttacaaaattcagatgaaaatattttccattgatttatatacactttctgagaaggctatgatttataagtctgatttttttagaaggcattgatatgatcaaaaatgataattagaggcaattattttaattttctggaataaaattatagacctcaaattaaattaaatagggaaattttgttgatatataaggttgccttcactaattccatacataacagaaatggaaactcctgtggggaaaacatttttttatcattaacaaaagcacttatgaaatatctattgcttgtatgacactaatattttagtggcttttagtatgaagttttagacagtatgggataattataaaatgtttataaaaataatttagcagttatatgaaaatcaaaccactaacagttaaatttcacatattatccatggaacctacattgttcaaaatatgatccaatgctggaagataataactttattcttctgtgtgagtataattttaaattcatgcattttacttcaagcaagactccttgtagagtattgagttaatctacctgtaatttacgacatgtactgtctactgaaatgataaattccattttcaagtgcagaaaattcttgtcattaaaaataattgccatttcttttcgttgctttttctgactataaagtaagtttaaagctctttttacattacaacataaatctatttatttctaaatacttggctgaaaatttgacctattttgcaaatcttaagttaccacagacctaatcttatctatattttctttcaaccaatttatcctcatttgtatccccatttgaatgtggaacatgagaagtaatagcagacaatgcactgtcagaattgaaagaagcctagcataccacttaaaagtgaattccaaaggtcccctggccttattcattgacctggcatgaaagggaaagataagatagaaccttgggaccactgaacacctgggaaacggcatgtactgtcaactggcctttttatgttgagctttaactatcatctcattgtgtccagaatctacaatggagagataccaaaacagctctcaagggtagatgcttacgtctgcttaaaaaataacttgaataataaaatgtataatctcagcattgctacttcatcagaacctcaatagaagaaagtgtactcaaattcatttctagtcactattgtcttctcttacactgctgccacagaataaattgaatggttccaaactcagctgatctcatccacccatgtaatggaaaattctttagccagacagttgggccaaatggaagtagctcacagtcactaatctgccttgtactggggacagttccacatgacaggagatgttggatgggattgttaagtcaataaatttttcctagcagcttcactgccattagatatgatttcaaaattctgttacaaaatgtcagacactaaagatgataatgagacctgacagaaatgtatttactgtagttcaaaaaggtgcagctgggcagccttttgacctgattatgagctgaaaatttgcctggaaacagctgctgagttctaacagccaagtttgaaaccaaatgcataatcaagtcatcgaaatttactagccaacaacttttacatcaaagtggcataggccaggaagcatcattgtatattagatttttttttaaaaaaacgaaaccttcaaaatgaagattatgcttttctgaaattgtcttcgttcattattaattaataattaatcttcactcgttattcagttaatttattattgtgccaatttgtggtgcttttcagttattacaaaatgtcctcacactttgccataaatctatggatttaaaaactgtggtggtgtgtttaaagcatatttttattgataactaaaagtagagctggaaaataattagcaaaattcattggactaatgggcatccagaagacatacaggctcagaaaagcaatttgctgatgagaatgaagatgctaaagagctgaatggtatttagtttattctgactatttatgaatttgcaaaatatattgcttgttttctgatcatttaatatgtgtaattagataaagaggatttcattgaagatttttggtttaatataaaagggcaataattcacctcatttacataaagtgttatgtaaaaatcctctctttataaattaataatgcaactcatagtattagatatattgatactttcttaaagccctaaggaaatgtgtgaaaaaaggttttggatagaattaaagggagaatattgtttcatctgattttccaagaaatatttttcttttttttttccgtttgtgagaaataacactttccagcatgtatgcctcttaaaatttatttttcttctactctgtttaaatgggagagagaacatattttctatgaagatgaccatttagagaatttcctctgtgctacctcacagagaacataaaagggtaattatagagacttttccttgttatagtatttcattcccgcttttcttctgagttttttttagacatctgacttgcctcttttccctaccaaaatgactatgcttgacattcaactttgatgattatgtcagtgactttcaggtttctatctaatgattcatcaagttgtatttcaactgtgaccttcaacttcccttctttatgtcacccacatgttaatattacaggataaatacctttgtcgtaggtgaaactgacaatactgccttttactctctctgaaaaactctggctttgtcacaaactaccactttttcaacatttgtttctcaatcaagatggcccatattcttctgtcataaaatcatcttttataattgctaacattttattgagaaatattttggggtaaatgtttaaatgaacctttttaggtgtagaaatgaattagtggtttgctagattgttttaacgagaggaaagctgcaatttcttgtagtgttacatttctttgggaaggtttacgaacagagatttggcttctctaagttttgccatgttttttttttttaatttaaggactgaagtccttatgagttttctctattttgctttgcttccttcctttatatgaaagatgtaatagacaatttagcataaacaggttatgttctatacataatagacaaattatcatcagcacgataaactagtttcttagtatatatcttttttaaaaattgtctttttgagacaatatttgccttttcctccaaaatatagttagataggctcacttcttcatacacagaatttccatcacctctgcacccccccccccttttttgacatttcttttctcttgattttatgtgtgcatcaagtttggaaaattgtaacctatgctttagattattctgttggcaattgtcagttgttaacaggaatttcttttccatgcccctcttcagctgccttatgtaggagtaaaaatcttaaagagatttttatttgcttttaaaacagcaaacacccaaagaagacttatttgccactctatcataatggtctgaagcattatttgcttaacaaatagttggtggatatgtagtgtctgttaatatcccaatttactaggaaacaatgaccttttgaaagttttacgcaaatgtgttctatgttttgttaacacatgatgtttgtatgtatatttattcaagggagattggccactgccatatttagaacctctcatacaaagtacactccagtttaaaaataggtctttgtaatcccagcactttgggaggccgaggtgggcggatcacgaggtcaggagatgaagaccatcctggctaacacggtgaaaccccgtctctactaaaaaaattacaaaaaatcagcagggtgtggtggcgggtgcctgtggtcccagctactcgggaggctgaggcgggagaatggcgtgaacccagtaggaggagcttgcagtgagctgagatcgtgccactgcactccaggctgggcaacagagcgagactccatctcaaaaaaaataggtctttgttaaaatagaatgttttaattctttattggttttatctgtaaggtattaaacaacaacatttcaaaagagagagaggatatctatgtaaaaataattttaaataatatccaaaataaatgttattctgagattagaaagttcaaaaattttgtttgttggctgcgtgcagtggctcacgcctgtaatcccagctctttgggaggctgaggtagaaggattgcttgagcccaggagtctgagaccagcctgagaaacatagggagaccacatctctacaaaaaatttaaaaatcagccaggtgtggtggcatgcatttgtagtctcagctactcaggaggctgaggcgggaggatagcttgagcccaagaattcgaggtggcagtgatctataattgtgccatttcacttcagcctgagcaacaaaacaagacctccatctcttaaaaaaatttttttgtttgtaaggaaaaaaagatgcattcatatgttttatttcacaagagtctctatctcaaaccttatcctcaaattttgagacaagattagcctgtgtatagaaccacagatggtaacaatcacatacctttggcatgtgggtgagaatcttaaaggcatttttatttgccagtttatgtaccaaattgtcttataatacgtaagatatttttgatgaaactagtgctcctctccaaatacactgcctccctccctccctacacagtttcaattctacaactgccttaaaatgttttgtgtgatagctgttaataagtatgcttaggaaatgcaatcaaagatattggcttgtgattttcttttctgtactgtacatttgttttggctcatgagacgtgagatcaaggtagaatgcatacaggagaacataatgaaaattgggggtattctttgaatatgaatgctaagtttaatgtgtttaaaaacattttacaatctctcaaccttggcgatattggcatatattttaaaatgtgtgttatagacagattttgaatgaggacaaacctaaaatatgacaagatgtacaagtttgaagatgagttacatgaagataattgggaaccttctcttcctttctgtgacccaagataaaatatcttaaaaaaagcaatttaggcaggaaaaacaataaatcctaatgagaagagcaaccaagagaaggcataagagaagcaaagagctaaagctggtaatcaaactgtgttttgaattccactaaaataaaacaaaggacagcttgtgaagttcagcctatggagaacagaatcaagctagtgatgcaaatcatttaaaataaatgtatagaaagaaaaccccaatttttttgaaaaaagaattgtatttttgtctatttcaaagacttcatggaaagggagacctatactaagtttgtaagttcaaagttggtgtttctttagggatgggattaccggtaggttttagagtttttaaaaataatgttcttacaccttgaacaatgagcctcttgagtttgtaggaagggcagcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttttttttttttacaataaggctcttgaaaattgtcattacttgtgttttcctatacattcatctgtgtgaaagcctttttcttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcaccgcaccgcaccgcaccgcaccgcaccagagccagagcagctgcttgtctgcagcaggacacagttcctacatacgtttcagttctttcatggtaagctcaatggactttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccataattttaggactcctataaaattcttccttgtttgttaatgctattaaaactcagattcgagggaaataccagcttccccttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggaaaaaaaaaaaaaaaatgttctaatgttcaaataagggcatcctaagtggaatttaatttattgtagctcaggcatccaaatatcaattttccttatgagccttaagatctttaattttttttaaccttactttctcttgaaaataaaaaactacctttgttaagtaaataaacagcttaccaggagctgacttgtctaattatttttatgtaataaagttgggagggctgggtgcagtggctcaggcctgtaatcccagcactttgggaggctgaggtgggtggattacctgaggtcaggagttcaagaccagcctggccaacatggtgaaaccccatctctactaaaaatacaaaaaattagctgggcgtggtggcgggtgcctataatcccagctactcaggagtctgaggcaggagaatcgcttgaggttactgtgagccaagatcacaccattgcactccaacctgggcaacagagtgagactctgtaccgaaaaataaaaataaaaatcaataaaaataaggttgggaggtttagcatattttatctgcaaaaggaaagcaagtttatatgatgtttattacattgggttaagttcagaaaaatagagttgtttttctctctcttaagcttaggtctccatgaattgcatgcggttgaagactggcccattgcagggcatggtagagtcaagctagtttaaccttcccatgtcaaaaactacatttaggcaggatctgatgacttgattcatttttatgtgtaatagaaccaaaggaaatctagggcagcttggttttacagaaacagttttgaagtgtgtattctggctgtgacattgtggttaatcacctctactctgtgcatttgtgaaacctgaatctcatcagtgaaatgaggggatggcaccagatcagtgattctcaaccagagatgattttacaactgagaaagtgggatgctactagcatttagtaggtggcggccagggataatgccaaaaatcctacaatgcccagtacattcccacacaacaaagaattacccagcctcaaatggcaataatgctggcattgagaaaccctggactagaacatctcttggcactctctgctccaatactatgaataatgaagctcattactttatccctgccaagggcaattcagttcaaccaacattgattaggtgccttctttttgtgttcttagttctttagggagaactaagaacttctccctatttgacataaaaaaagaaggtaaaactctatctctggaattcgtcatattccaaatattgtcccatgtagcttctactcatggtagctctgtttgataaggaatgtacattttcaatgattccagatatatcggcaaaattatggcttttcacatttctagacatttcttctttcttacttgtttccctaattattaggttccaagacaatcaactaaaagagaaatttgaaagagtcagatggtttatataactcttaaaatccgtattgttggattaagccattcctgatattggatcttattgtcttcacccgcacaatgagagtggagtacaatgcactattgaaagtctccttgtatcctgaaattctgtgtttatgtctttaaatactgttggagccctgatatttgatgattagatgattcaaaaaagaggggggaaaacaagtattatttaggtcacatgtttggagagatggaaagtcttaatttattgtttaagtcaacatcatgacaaatacccagctctacagggtttactatgatgtgcaggtgtatgtgtgcctgtgtgtgtgcgcctgtgtgtgtgcacatgcatgggcttgcccccgcccctgcaatttggatagagcaattttgggttgagaattttttttcccctttcttaaaagtcagtttctattcacttcctgtttgtattgagaaatcatcaatatgatttattgtcattatgtccctttgaatgactataattttgttttcctttgccttaaattaaaacccctaagagataatttattttcaaaattaaatatgtctgtgtatgcaaaagatgattaaatacacacacatacatatttagtggttttttaaagggtcttggcatttgctacttaagttaccttttatttctttttcacattggtaaatttgtcaactatttctgctgtaaatatacttaataagaaggctaactaggcaacctaaaatttaagtgaagatacttttaataatgaaggtgaacatgtctttgcacttccctgtttctggatttactgtctcagctttcttcaagtgcaaaggacaccatatttcattcatgtgtttcataattataaaagactctgggttaatccttgcaataaactttggggataacttttgccttttaaatctctctctggaaagtgatgtgagacttaaaaagactctgtataagaaaataatttagttgtagaacatcaaacttttcacttaaatcccttgttaagacaataatagattcaaaagaacaaaaggtcagtatattaaaaactgtaagatcacttaaaaatataatactccttaagcatgaacaatataaatgcttcatttaatgtgtctaaatgtatagattttgtaacactaaaaggttgtaatgctataataaagacatatctcaggccaggcttggtggctcacgcctgtaatcccagcactttgggaggccaaggcaggcagattacctgaggtctggagttccaaaccagcctggccaacatggtgaaaccccgtctctactaaaaatacaaaaattagccaggcatggtggtacgtgcctgtaatcccagctacttgggaggctgaggcaggagaattgcttgaacccgggaggtggaggttgcagtgagccaagattgcatcactgccacttcactacagcctgggcaatggagtgagactttgtctcaaaaaaaaaaaaaaaaaaaaaaaaaaaaacaacaaacagcatatcttgtatgtacgtaatctgttcagaattaaacaaaaaaaagtttttttttaattcaaagatatctacatgctttttgaatcaataaagttgtaattagctgatgtttgtatgcattgtatctccacttgaaaattttacaccaaaataataaaaccatggtctattctgttttcctaacaaagatatggtactttgactacctgactgccatagaaatcaagaagagcatagccatttattttttatgtgcttttataaagataatcctatctctttacagtaagtcacaaatccacaggcagcagtcaagtaacacattttcaagcaacttatacttatttgcttagtataattttctaccattctttgaaatggaacaactcttaggctcagagcatctcttgcagttttaaaatccagctagtttttgaaaatctcttttgagatgtctcaaaatgacatctgtcagaatcccctccctctttttgtaaaaggctttctgccaagacacacccaacagccatttctagtctatgatttccataccagactagccacaggggaacttgtgaattggtccatttattctagatttacttggcaatcgctggaaaaattctctctaatctcttattccccagatttatcagggattatcttcaccaccactactttcaccctgggagtcagctcagtgctgacagtggtcatggggaccttgcctagtcctattgagacttctgttcttgttgttttcctctgttccctccatcctgctctcagtcccagcacagttcacacattcttactctgattaattatgttcttttccagaggtttgatgtcctagctcctaggcttttgaaacccagttttttctctgtcaaagtattaactctgccatgagtttccaaaatctattttgaaacccaaactctactttttcctttttgcaattctgctttaacattttaatccagaaacatgaggatggaattaatctttagctacctgggttgacagaaggaacacagaacacaggactatgagaaagacaaaactagaaaacatttatgagcatgtggtctccgcaatgctgagtagtgagtgctgtggttttatgctgaatggtgttgctacttctctgtctacttatccccctttcctctacacttaatattcaggcatttaacgtttgtgccaggctctgcaataggcctgggtgattccccaggaaataaaggagacgatatccctccctcatgtagcttagattctagtaagttctcaatattctggaccctggtctctgcctttttgctcctatttgtaaccttttctacacgctgtgtacttcctcactaaaagctgtccactttacactcaggctgcacattctgtggactcctactgcaacggaagtgacacgtctggtccttggctcctctgatcattgaggaaccctatccttgtggctagttactgtagcctttgactttcctacttcctgaaaaagagaaaaagacgatgatagaattcaatggcaagaacatgggctcttgtgatttttgaaaaaatcagtccttactgaacttcaattttatcctacaaaaatggggctactaatcaccatttctaatggaacccatactaataagtatttgtgatttttttaaaagtataatttctttaaattttttccaagtgctttcatctttattgcagtataattgacaaaaattatacctatttaaggtgtaaaatgtgatgatttgatgtatgtgtacattgtataatgattaccacagttaaattaatcaatgtaactattaatgtactagttactctgtgtgtgtatatgggagaagagatgaggacacataaaatctattctcagcaaatttcaagtaaaaagtaaaatattattaactgtagtcaccatgctatacattagctctccagaacttattcctttgataactgaatgtttctaccctttaaacaccatttttccttttcacttaaatcccttattaagacaataatagattcaaaacaacaaaacatccatttcaaccaaaagtccattccaacccctggcaaccatcattctactctttgcttctgtaattctgactattttagattccactaaagtgagatcacgcaatatttgtccttttgtgactggctcatttcacttggcataatatatttggaattcattcatgttattggaaatggcaggatttctttcttttttaaggctgaataatatttcattgtttaacacgttttatttattcatttatccatcaacagacacttcggttgttgccatatctaattgttaagaatgatactgcaatggttgaatgaaatactcactatcaaagggctctaaagacttaaatgtttcttgttatcatttcctttagaatcacttcaattttggaagaaagaggttgatttcctgctaaagggtcaactgaatatattgtcttctttctctcttccattatgagcaattgtagaagcctattttctatgttacttttgacttcttcaattttaactgctcctccatcctaaacacctccacatgggaaataaaagaccagaatccaactatatgtatagaaaaacataaaactcagcattgtagtcctctgctgctcactgtgattgattatggagtgtttttctttcttttcccttgagtgtacctccatcagatacttccatgctgatccatgccatctgttctgtgaaacttgctgtcagacaaccatacactttaagcactaagttatccaaattctatcttaaaaattatgttgtgattattaaaaatctttttttatatagaggatttcaaatagctaagcatatgctaaatttttcatacttcacaagttcaaattttcttggttcaaatcaggattcaaaatatatgtgttgctttaaatatgtctgtttgaaaaaatgcatatggattctccaaaatttgggtttctaagcaagaagatatgccatataatcgaaaccaatttatattggctttatcttagtgaaatgtagataatcacaatctcttatttcatagtaacatgaggtttttgtgatgctgtctgtaaagtgttggtgtctttagataaaggggtcgctctttaagaaaatattactactgttcatgattttattagcaaggtgttgatttaaattaaaactgtagcaaaaatgctatggctctgattttaaactgctgtaagttctagacagcaaaggaaagctgaaaataaatgctgcatttaaaaataaatgttgctttaccaaagaggtgggaagatggaagacaggatggagtgaaaggctccagtaattttacctatggtactctgagttcacaaaggtgtcttgtactcagacagaaaaccgcagcgtgaagaggggacagcatgagtgaagaggaagtgaattttcacccttcacttccaaaccacaggaaaggaagtgactttaaaatgccaggatggaacaaaagcatttcagatgtgcaggctttaataagaagagctcaaaatgccgtaaaatgccctttgatgttgcaatggaaacagtttttgaagttaaacagtatgatttgatggttgagtagaaagtaggctttttctagagcaccaaatgcatcagatatggctataacactaattttctgatgtgtctgtcagttaagcagagctaaattaatatattcactgcatatttgtctgctaatttttctttaatgaacaaagatattacttgcttcataagttcctgtcttcttgaagttttgtagaatgatagtatcatctcaaaaataattaattcttttcaaaaatcaagctcctcagtaaagcctttttttgaaacattagttctatgtatactgaaattgaaagaggacaattctcaagtgactaaaaagcggtttaaagcattttatcagaaataactatgttacctatctcattgatagaaacatgtccaagactgttttatgatccctgtacatccctcaaaaactaaaacattaaaagattcatatattgcatgctaaagcaggatagagtgatgttcattttcaagaatcatttagaatagtgatctctaaagtattaggtaccaacctcaagataattcgctggggtggaagtagggcacaagttagacgtgatagagatgccattagtgtgttttgaagcaaatctcaaacaggggtcacaaactatggtctgtgggccaaacctggctcaccagtgtttttataaataaagtattattggaacatggccttgcctatttcagttatgtgtcacttaagaatgggatatgttttgagaaatgcatcattaggtgattttgtcattgtgtgaacatcagagggaattacacaaatccagacagtgtagcccattacacctagggtatgtggtataggctattactgctgggctacaaacctgtacagcatattactgtactgaatactggaagcaattgtaacacaatggtaagtatttgtgtatctaaacatatctgatcatagacagggtactgtgaaaatacaatataaaaaataaaagaaggaacacctgtatagtgcacttaccatgaatggaggttgctctgggtgaatcagtgagtgagtggtgagtatatgtgaaggcctaggacattacttgtacattattgtagactttaggaacacttagactacactaaatttattaatatttttttgagatggagtcttgctctgttgcccaggttggaaggcagtggtgcgatctcggctcactgcagccttcatcttctgggttcaagcgattctcctgtgtcagcctcccggtagctgggactacaggtgcacgccatcatacatagttttttgtatttttagtagagatgggattttgccatgttagcaaggctggtgttgaagtcctgacctcaggtgatctgcccacctcagcctcccaaagtactgggattacaggtgtgagccaccacaactggccacattttcttttttcaataataacctcagcttactgtaattttttacttaataaacttgaagtttttaaactttttgactcttataataaacaaaatgcaaacacaggccaggtgcagtggctcacacctgtaatcccagcactttgggaggctgaagcaggcggatcatgaggtcaggagatgaagaccatcctggctaacatggtgaaaccctgtctctactaaaagtacaaaaaaaaattagccgggcatggtggcgggcgcctgtagtcccagctactcgggaggctgaggcaggagaatggtgtgaacctgggaggtggagcttgtagtgagccgagatcatgccactgtactccagcctggggacagagcgagactccgtctcaaaaaaaataaaaataaaaaataaaaataaaaataaaaataaaaagatacaaacacattatgcagctgtacaaaaatattttttatttatatctttaatctataagctttttctctattttaaaattttctggattttttttcttttttttttttacattttaaacttttttttttttttttttctcagacacaagtacacaagttagcctaggcagggtcaggatcacaagacatcactctgcaataggaatttttcggctccatgttaatctatgggaccaccaatacatatatggtctgcttaccaaaacatcgttatgcagtgcatgactgtatgtatctattgtttaaggctgcttttatgttactatgttaggattgagtaattgtgacagatttatggtttgcaaagccttcaatatttactgatgggaactttacaggaaaatgtttgccaacttctaacataaaataacaacaaagattctaagctttgctgatttatatgggtttacatgggtctcctttgtaggtctgaatgctagatagttacaactcatatatattctaaatgagattccttggaaaagtgtcaggcctttctaacttggggtgatggacagtgagccctcagttggccattccttaagcctgttgtatcttattgcactatatgtgcccagttagctagacatacgatttatcatttttaactatttttaacgaaaatagccatcttaaaataagcaaatgactttattaaaaaaaaccttcggcaaaataatctagattgactataccactgctgatacaagcataagcaacaagaaatagcagaggtgacaccatatctatgtctaacataagcttgtcatcagacatacgtatccatttcaaaccctgaaaatctacttgaatttgataagaagtaggttattttttgaaatgattaaaacaatttaaaatatagttttatatctgcttttattatgaatatacctgtccttaagtttatatttttgccttgagttttaactaataattgcattatggcatcatacttgataagacattaacaaaaccggcatccaaggtcatgaagctgtgcaattttcagtactgtttaaagacacaaggtactcaatattataatgtgtaaagttttactgaagcaaatgataaaattctcttttgaagaatcttaacagggaaaaaatgaaaaacccaattcagctggggatacgtgtgttcttcctgctgaagtatttattgcagaataataacaatagaatgatgaactgaaatttattcctttgtaattaaatgccattagaaaatgcatagaaaacacctttgaagatctgaaaaagtgagtaatgagccaattactcccaatatgggagttttattatgcagttggatcaaagtatagattttaaaatattctcagtttataacatttgttttctaaatatgaaatatacagaaagtgacatttgaaatatatgaaatacacagaaagtgacattttggattcttaagggaaaaacaaataataaaaaatttgttctctaaagtaagtgacttctttaataaaaacactgttttatgagaaaattctggaggcataatagcagtgggctacattaatgattgtactatgaggttgcagttacatcaacatttataggtaacctataacgacaaaggagatatacacacacacacacacacgtagaggattctttacaataataaaactctgttcatgagaaggattatgaaaatctttgggatcattcggagtttctcaagttatctcatggcaaattattttaaaaagtaacaaacttcaagacgcattagaaatgctcgtttttgagaaatgcaagtggggttcctgatataatgctctatctctctgtggcagcctgggcacagacaagttgccatggaaattgctgtgtagctgatgatagtcttcattattttagaagtagaggctaaaccaactcataccccaaaccctgggcacaaagataatcccaggtagtggtcctttccctgtatgaacctgttggaaaaacatctcgtccaggaaatccatttgctatggaaataaataaaatacaaaaggaaaaaaagaactccagagtgaataacaaacaaaattaatatttaacttgagacttttaaaacaaagtgtagtgaacagttgaaaagtgacagagtattccaggtacctaccacaaattaaaaaaaaggagagatcataatctgcaaaatgggcaggttgaattcaggctaaaagttccttaagcaagacacataagacccccttataatgctaaaagatggcatttacaaggaaaatacagtcattagaatatgaaaaaccaaaatataacctctatcttcataaggcaaaagcaggagataagatctggaaaaagtgaaaatatattattggtaaaatattttgttaacttgtttgttcagtttatcatagatcaaataaaaataggcaaaagtagatcatctcgagtaaatctaatttatatatattcagactctatcctgcaaacaaaacaaaatattactctttttaatatctgtggaactctcataaaaactgactatacattaagctaaaaaagaaaacctattaattgccaagatggaaacaatatacacaaatttatctgatcacaaaaaatttataaattaataacaaagttagaaaacaaaaagttcctgacatttgtaaattgaaaattttgctttttcatgaaactttatcaaagaggaaattcagaataaaatttctgtgttttactttttttattctctaactttattgaggtataattgacaattaaaaattgtatatattttaggtaaaaaacttgacgttttgatacatgtatgtattgtgaagtgatcaccacaatcaagctagcatatttatcacctcatgcaattaacattattatactattattgttgtggtaagaatatttaggatctgccctcttagcaatcaagcctacagagtatacagtacactattgttagttatattaatattgccattcattagatctccagaagttattcatctttggtaactgaaactttgtaccttttgattaacagtgacccattttcccctcccctctgcccctggtaatcactattctactctctgccttctatgagtttgactattttggatttcacatttaagttacgtaatgcactatttgtctttctgtgtctggtttatttcacttaacataatgtcctccaggttaatttatattgtcacagatggcaggatttccttgttgtttaaggctgattaatattccattatatgtatttatgtattataccacctttcctttatccacttacctgtcaatacacatctagtttattcccatttcttggctatagttctgcagtgtacatgaaagtacagatatctcttcaagacactgatttaatttcctttgatgatatacccagaagtgggatcgatgcatttttatggtagccatattttaaattttggggggaaacttcatactgttttccttactgacttaccaattaacattcccaccaacagtgtacaagtgttctcttttttccacattctgaccaacactcattcctattgctaatactcattccaacaggtgtgatatgatagctcatggtggttttgatttgcatttccctgatgactagtgatgttgagcaccctttcatatacctgttggtcttttcatatgctcattggccatatcttcttttgaaaaatatctgttcaggtcccttgcccattttttaattgagttatttgtgcttttttggtattgagttgtatgaggtttttttcaaatacatatattttggatgttaagcttttatatagacagtttgcaaatattttcttcctatatactgtaggttgccttttcacactgttgaatgttccctttgctgtagagatttttttaagtttgttgcaatcccacttatctatttttgcttttggtgtctgttcttttgctgtcgtatcaacaaacaaacaaacaaacaaaatacccacaacaatgtcaagcagaagctttttttcttgtttgcttctagtagttatacagttttgaatcttatgtttatgtgtttaatccattttgagttgatttttgtatattgtgtgaaataaggatccagtttcattcttctgcatgaggacatacagttttcaccacaccatttattgaggagactatcctttcaccttgtcaaagattagttgtccaaccataatgggtagatttatttttgttccactggctatagtctgcttttatgacagtgccatactgttttgattactatggctttgtaatacactttgaaatcacaaaatgtgataccttcaaaaaagggtgtttgaaaaatttctttggattcactgagagtatttttaatattgtctttctggcttgcatacgacttctgatctttctataataagcttatattactttgtaattatattaaaactaagccttttaaaaagtaaaaagaagatctaactcgaaaaaatagaaaataaaatttctatctggaaaagtaagctaatgaaatcattatttttcaaattattgtctattagaactgataagatatagttaaaatagtccttgaaaggaaatttataatgtaaaaatgctaaatgaataagaagagtaataaaggtcaaccaagtaagcattcaatttggaaaatttaaaaacaaaaataaaacaaatatttagaggaaacattatttaaggagaaaatccttattctttgcataagaaaataaatgaaaaggactttatagcattagaaaacgataaatagctagaaagcagaacagttgtaaaactcataatagcacgtattctttgaaaaaagtgcaaaatagcaaactgttagttaaacagatcaataaaaagggagaaaatataaaatacaaaatgagaaataaacatgaaaataactaacaatatagaggacacaaaatacgacactgcttctctcacccttatgcaagtgaattaggaaatccacaggaaataaatactttatagcaaaaatacctagaaaaatataaaaataaaactccagtaaaccaattaccaaaagaaaaactgaaaaaaaaaatgaaaagttaccctcaaaaagctccaagtcacaaatagattcccagggaaattcgaacaatcttttaaggaacaaattcagttatgtgttgcttaacgatggaaatacattctgagaaatccatccttaggggaattcttttattattattattattttatttttacataagttattggggtataggtggtatttggttacatgagtaagttctttagtggtgatttgtgagaccctggttctcccatcccccgagcagtatatactgcaccattatatgttgtcttttatccctcgacccccttgcactcttccccccaagtccccaaagttcattgtatcattcttaggcctttgcatcctcatagcttagctcccacatatcactgagaacatacgatgtttgattttccatcactgagttacttcacttagaataatagtctccagtctcatccaggtcactgcaaatgctgttaattcactcctttttatggctgagtagtatttcgttgtctatagtgtatatataccacagtttctttatccagtcattgattgatgggcatttgggttggttccatgattttgcaattgtgaattgtgctgctataaacgtgtgtgcaagcatcttttttgaataatgacttcttttcctctgggtagatacccagtagtgggattgctggatcaaatgggagttctacttttagttctttaaggaatctccacgctgttttccatagcaactgtactagttaggggaattcttttttgcgcaagcctcatatattttaccttacacaagcctagatggtatagcctactacacacctaagctatagggtatagtatagcctattgctcctaggctacaaacctgtacagcacagtattgtactgaatactgtaggcaactgtcacacagtggtaagtatttgtgaatctaagcatatctaaacattgaaaagattcagtaaaaatgggaccaccattatatatgcagttcgttgttggctgaaatgtcattatgcagttcatgatgacaactctaataacagagagttgtagactatagtaatgcaagcatatcttctaaataattttctgtagcaagtgtaacattgttataaaacccagcagaagttgcacaaaaaggaaacttcagctcaaactcagttataaatatcaatgcagatatctcaatttagtaggaaacagaactcagtagaacattaaagagtgctgtgtcctcaccaagtgggatttaatgcaaggggaaaagaatgtaattgtctccttagactttaagtgccatctttattaaataaacaaaacagaacccttaaggactttcagtaagggatggtggattgaataatgcctctaaatatgctccttcccaatatttccttaaaattattgtaaagatgtactgtaaagatatagtctacaagtatgggaagtaagaagaggagacacagcaataaaattttagaggcagaaaaatatcctgatgaggaaaagctgacatagcaacccaagaaagctaaatcctaggctggccagggagaaagccaagtactgattccatttctatgttagagttctcagaaggcttaggatttggaggtgcttgatacctctgaaaggaaggtaaagaaatggtagctgaaaaaaggaagaaaaggtaaaagctatttaagaagtagctatccccaaattcatatttcttcttgactgattaactaccattttaagataataattcacatgctggagagaggaaaacaggatttctggcctggggcctcctggcatagtggagagcagtggagctcttctgaaaacaggggactaagtgatgctataaggggttaatgccgacccgcactgtctcttctattcacatctcagaacacttgtagccaggcctttgccttctagccaggagattgaaaatgtcttttttgaggaatctgaccaatacaaagaggaaagctctcaagttattgagactgggttaccctgtacagtgaaactcaaatagcctgatccatgtgctcagagtttccaaagtgctcttaattcctgactctaaaatattagcagataattaaagatatccagatacccgaggaagacctccaatatgaaatatgagcagaaaaccaaaccaaaaaaaaaatgaccaaacaggaaataaaacaaacaaacaaacaaacaaacaaacaaaacagaggaaacactatttagacagaaaaaactcaagaacatcaatatttttacagatagataagatagtgcctctataaaatcggaacagaatactaaaaaaataaaaagaatacttggaaaataaaagggcctcttggaaattaaacacaagattgcagaaacaaagaatgcaatataaaagttggaggtggggtgactaactcatcgcagtttgtcttagcactaaaattcccactcctgggaaacctctctatgctaggtcaccttagttggagaatgatacggtttggccctgtgtccccacccaaatctcttgttgaattgtaatctccagtgttgggggagggacttggtgtgaggtgattagatcatgggggcagatttccctcttgctgttgtcatgacagtgagacagttctcatgagatcaggttgtttaatatgtgtagcaattccccttcactctcctgctccgccatggtaagatgtgcttgcctcccttcggccataattataagcttcctgagacctcccacccatgcttcttgtacagcctgtggaactgtgagtcaattaaacctctttcctttataaattactgagtctcagatagttctttatagcagtatgagaacagacttatacagaggacaaattaactaaacctctcaagctgatgagcaaaaggaaatgagatgagaatttgaggactatctaaaaaagtccaacatccagaaagagaagagagaagaaaaagagaaggaaatgataaaataattcatgaaaattttccaaaatgttacatataaaagagcatcaaattcctacaaaagtagatgaagatatacccacgccaaagcgcatactggggtattttcagattattgaggacaaaaagaaatcctgtgtgcttccagagagagaggacaacaaaaagggtcatttacaaatcatcggaaatcaaaatggctgggcttctaaaccacactggacaataaaataatccagtataataatactttcaaaattctgaaagaaattattttccaacctggaatttcatattcaaacaatcaaacgtaagagtagaagaaagtcagttttcaacatgcaggttattggaaattggcttccatatacttcattttcccaggaagctcctttagggtccagtcaatatgagagaaaaccaaaaaaatgtaagacacaggctattagaaataggagatccaggccgggcgcagtggctcacgcctgcaatcccagcactttgggaggccgaggcgagcggatcatgaggtcaggagatcgagatcattctggctaacacggtgaaactctgtctctactaaaaatacaaaaaattagccgggcgtggtggtgggcgcctgtagtcccaggtactcgggaggctgaggcaggagaatggcatgaaccccggaggcggagcttgcagtgagccgagattgcgccactgctctccagcctgggcgacagagggagactgtctcaaaaaaaaaaaaaaaaaaaaaaaaaaaaaaaaaagagaaagaaaaaagaaacaggagatcgaacataggagagagaggcaaattaaatatccaggattatgctaaagagaatcacaggatcataatgtatacaaacatagaaggcaattagcacagattgaaacataaatattgaagctgtaaccactaagaatcctttcatctttgtattgtattagcaactgacagtactcaagtgagcttcgccaaggttcttaactctcttttgctcgtccaagtgctgataagattctgctctccctccctgcccagctgcctgggtagagtgaggacaacacctgatcctacagaaacattcaggtttgaccgactcctaagagctgaagattggcaaaagtgaacttagaggcacaaaacacagagtagcacactctctgcaaacattttcctcttgattggatagaacttgattccgccagataagcgcatttggtgaattcgttgctttccatggatcaccatgggctttccccctgacaacctgagaattgatttttacaccctccaagaaaaaactgaagcctgagtataagccagagactgttcaaaccactttacctaagcaccttcaactatcaataacaacactgtccttttctcacatagttagtcttgtgtttgctactcagttgtcatattaatcactttcacactgattaataatttttgtaattacttgctaaaacaatgaaatgtttgatttagaaataaaacaaaattataagtcagaatcatctttaatggacaagtactgcatatgttccattaaagctacccactgacatggctttcatttcattttcattcaatgttagaggcattaaccaatgaaattagacaaatggaagaaatgaaaagtatcataactggcaaagaggagacaaatttatcactctgttaggtgaattgatttttttggattgacccaaaacttctaagagaatcaagtgaacgacaattacaatcagtacgataattcagtaacgtgtcttggtagaaaataaatagctttcatgtactgatacagaaaaattccaaaattgtcaaataaaaaaatcaaacaagacacagaacattgtaaagaggatattatctttttaaattttaaatttaaatttttattttttcttcaacttttaagttccagggtatatgtgcaggatgtctaggtttattacataggtaaacgtgtgccatagtggtttgctgcatgggtcagcacaacacctaggtgttaggtccagcatccattagctattcttcctgatgctctccctcttcccacaaccctggacaagccccagtatgtgttgttcccccaccatgtgttcatgtgttcttatttttcagctcccacttataagggagaacatgtggtgtttggttttactgttcctgcattagtttgctgaggataatggcttccggctccatccatgtctctgcaaagaacatgatcttgttcctttttatggccacatagtattccatggtgtatatgtaccacattttctttatctaatctatcattgataggcatttgtattgattccatgtctttactagatgctatctttttaaaataataagtatgcatgtgctgtgtgtgtaaagtaagatacatatttgtatttgcttgatttgtagaagacatatacctgtatgtaggccctttttgcaacttttctttgtagcctcaagacttcttactgttttgatttccttgctccattcacataattcatggcctcatgtagtagttcctacttcctcaaagccactcatcgtttttccatgttgaagacccactttagttaaggcctcgtaacctcctttctttgcagttgcactcctctatttgttgcaccaccagtttctctccaaaacaacacattgcctagaattgaagaccttattcattctttccagacccacccttccctgattccttatccatgacaaactcaactccgaaacttattgtgtcatgaactaaaccttgtacttctgcccctccactcactttaatattttccacaatgccctccccttgacttcccgatttcttccagaccaaatcacaagcatctttaaattaatttccatgactacctacctcttccatgaagatgttcctaaccccagcccacttcttttggatggattatcttcttccttacagatatctccccttaatactttcaaaaataaacctggtacccttcaggagacattctgcaggcacttgttttgttctgcagaagaggctggaggcagggaatgaaaggaatttttgaaagagacacacaatatacactgaaagcagttgtctcatgagggacaccatctcatgaggagaggttgtcttcttactggtaagagattctgacctatgtctatcgtagacctaattccaagcgtgcttgacttttttatgctaacatcctcttatgcctttcttcttccccaccaggatgtaacagtccctcccaagcctgtctcgctccatcctttatatcagactaaactctatcctcctgctaagtcactgctgcatccacagaccctctcacatgctgactgtcttgccccaggacccttcagtcatctgtccttctccttgagtgatgaacaggagaattctcacaccctcctcagtcacaacgcatgcaacaaggtgagaactcctccccaaaatgaggactattctattctgtgaaccttcattacgcttgacttttaaaacttaaatgtggaggaaacatgtgttaggaatatttaaatattaaatatctaaatgtataaagaatattaaatatttgtgtgaaagcacattaccttataagcagataataattgaacttgggaaataataaacatttatatatttttccaaagttattccctgatttgtatttttcactgtttcatgttctaactccatggtggaaattccaagacatttttcaaaacctcacaaaatgccattattaatttatattctagtcttagttcagtgttcctaaaaagcttctttaaattacagtgcctggttgaggaggcacttataattagagtcaatgggcaaaaaatgacttagaattactgtgggtatctgcaaaataatattcacattttactttaaaatgtacctgtctgcttcactgtgtatagtaacgcgatgtgtaaaaaataatgaagtgtttcgtacctgaagtgtgtgtgtgcgtgtgtgtgcgtgtgtctgtctgtctgagtgtgtatgatacaaaacaagtaaaaaatatttatagttggctttggaattgaatcataaatgttttctaggaacaagcaattaaactacatggggcttacatataagtgccctttgctcttctgataagggcatcctggctagtacagatgctcagaccctgaaaatttcctaaaataattaactggttaaactttaattaaatctttttgtgaaattcaaaatcctgtttaaaagcatttattctacaaggtatctacctccagttaaatacatctctatacttagaaatcaatcaagatcatcttccagaatgtagttggataatacttcttggagcctgaggcatttttaaagaaaaaaatgtcaataaaccctgtctaaatgcaaacagtcatctaaaagcaaaaactataacactgttatataaggaaaaattagatttttatatttaatagcttctatgacaactgaatgatcaattttgattaaacaaattttaaaatatcagttttttgccaaaaaatgtttttgggcaacattcaatatgacatttttctgacctttgtttgtgtcccattcttggtctagaaaataagtatatgagagaaaatataatattttaaaaattattttatattatttgaaattctttctgatttaatatttgccaacagccatgaaatacatttagttatttgagttaataattctgataatactattaccattttcttataaattgtcatctatatgataaggttatgatttaatttacagatatccgttacatgatatagctcattgttttgatattttgaaagtgttttctggaactgttcagcaaggatagactatatttcatccatatgtcagtctttgtttggttaggctgagaagaacaaaagctgtgtgaaatcagacaactattttcagtccacataatcctcataatagattttgtctttctgagtgtgagatttgttgatactgaataaagaaccattcataaccaaaataataatagtaataataataagatagtaatacaacatttttaatggaatgttcacttgcttagtcttgaatctgtattgccttattaaagtacatgaattaccaatttgatgtctatgtttacaaacattgtttgttagatattgggttaatagcatactaatttatcaggactttttctttttacttgaaataacttaatgcctttaattgcaagacataatctgttatttaattaacttttcttcaatacgctaacatgattcccaagtctgaccttacagctttgcctactggcctatctccaaactcaaatcttcccatccttccctctggagaaccatgctgaacttgtcttaccagtctttagagtccctcttcagctgggctacaataggtgttcaacaggttgtattcttcttctgctgagtctgcagtgtgcactcttctcttctaagttttaatcaaactcctcatgtcctaaatcttcaccttaatccctcccttacttttttactttcaagagggaactttataactgggtgcatcatatcctataaggatgctcaggtactttcttttcatcctggaataaaacagtacaactgccttcttcactgccttgcagcctcatgaaggaagtcattccttttactttcttttcttttttttgttttaattatactttaagttctgggatacatgtgcagaacatgccggtttgttacataggtgtacatgtgccacggttgtttgctgcacccatcaacccgtcatctacattaggtatttctcctaatgctatccctctcctagccccccaccccccaacaggccccagtgtgtgatgttcccctctctgtgtccatgtgttttcattgttcaactcccacttatgagtgagaacatgcagagtttgtttttctgttcctgtgttagtttgctgagaatgatggtttccagcttcatccatgtccctgcagaagacatgaactcatccctttttatgactgtatagtattccatggtgtatatgtgccacattttctttatccagtctatcattgatgggcatttgggttggttccaagtctttgctattgtgaatagtgctgcaataaacatatgtgtgcatgtgtctttatagtagaatgatttataattctttgggtatatacccagtaatgggattgctggatcaaatggtatttctggatcaaatggtatttctggttctagattcttgaggaatagccttactgtcttccacaattgttgaactaatttacactcccaccaacagtgtaaaagatttcttctctctccagatcttctccagcctctgttgtttcctgactttttaatgatcaccattctaactggcatgagatcgtatctcattgtgattttgatttgcatttctgtaatgcccagtgatgatgagcttttcttcatatgtttgttggctgcataaatgtcttcttttgagaagtttctgttcatatcctttgcccactttttgatggggttgtttgtttttttcttgtagatttatttaagttccttgtagattctggatattagccctttgacagaaggatagattgcaaaaattcttttatccttaaaagtgagatagcccagcaggttaagaggatgatgcctctagttcctttgtctgaggttatttcttgacccaaccctttttagatggtgatattgggcaagtcatttagcctctgaatgcctccgtttactcatttttaaaatgagaataataatagtacctaccttattagagtattatgaaaataaaatttacgaatatgcgtaaaagtgcctgaagataatgaaaaacatataaaagttagatcttattatcactaagctttctgggattgtcattcttactgctctccaaaatcgtccattcttctccattggattcctcccctttgtatgcagaagcctaaaaaacaaaataaaacaatacaaaaggagcacttgatccttttccttgatgatgctgcaaatctatcagtttcaaaattttctttctctcaaagtggtcaatagccactatctccatcccctttctgcaaactcactcttcagcccgttcttgaaagcattctgactttcacctctaccactctactgaaattgctctgtcaagggtaaactggttgtcagcaaattcagctgaatttcctgacacagttgatcatttcctcttgcatttctctcctcactctgctcttgggataatatgcacattctaactttccgactgctccttctttgctttctttgtggacacttcttgctcctctacctcttctttctaattgcctcacttcagctatttacccactcacaggccttagtgattatcttagtactgataagtctcaaatctacacttcccattctgcttctccactgagattcagtttcgtatctttagctgcttgcttatcatttcccctaggatgtcatgttgtcacctcaaactcatcattcattttgtctcaaactagttctgcactggcttttctacttctgtgatgaaaatcacaattctcagtccccaaactcaaaacttgattcatctgttatgctttatgctttttctgctttgtccttatattgagtcattcaccaagttgaatgcgttcttatattttctcacactagtctttattattattcttttactttacttaaactgattttcttattttcctctaggcacaccttggaaattccttactgttctacttgttcatgcattttcccatataaaatactcttctatgttctccttgcttacacaaaccattcttgtactttaagtccaagttaaattatccctcctcttttgtgacatttctccatgcatcagtactcaaaatgatttgttttctcctttcaatttctatactcttttcctgtgccaaggcatctcatgcatattataggtcatcttgtatttatttgttgtgcttgtcttggtgtttatctagggtgtgacataatatgctatttcccactgtataggcaaggtagtaaagatctattaatgatgaacaatttctacaactacctaactttttcactaggagccccagatgcttgaattattatgattatttctatttcaagtaaagactaaatctgagtcaacttatggatttaccagtttgtttagaataatgtcactcagttgaggatatttcttttattgaaggctatatccagtttccacagatctgatggagtgtgttgggaacataggtagggtggggttgtggaggcagggggcatctgaccttctcttgtggtgttctcattcctttctgttatataaccatgagccatataatacatggttacatccttttttcttcactagcatggcatgtccttatcaactgtaggtcagttacttttgtgcccctacagcttacatgggagaacattattacctgcttgctgggagcaaggtgaactttgtgaagctatctcagaaccattctcttggatgccctacatatctttctctgttctgttcatgtcccctttgccatagggaactccaaaaccatccgtatttgtgagttcatctactcactaaaatttatttgtaaccccaaatcagcactcattgtgtttgctcttctagtcatttgtggacattcacagaacagggagaaattcgaatcctctatgttcccagctcaggttgaacaaggcaatgccctgctttcttgctgtcatgctgtaaacaattgtcctttttaaaagccaggtgcggtggctcacgcctgtaatcccagcactttgggaggccaaggcggctggatcacctgaggtcaggagttggagaccagcctggccaacatggtgaaaccacgtctctactaaaaatacaaaagattagccaggtgtggtgtggcacacctgtaatcccagctactcaagaggctgaggcaggagaattgcttgaaccccggaggcggaggttgcagtgagccgagatcactccattatactccagcctgggcaataagagcgaaactcagtctaaaagaaaaaaaaaaattgtcctttttgcattctctctggtatcatgtttttgtttgcatctctgtgtgttttgttggtaattttgctgtttaaaatggcccctaagcatagtgttgaagggctttctaatgttcctatgctcaagaaggctatgatgtgtcttaaaagagaaaataagtatgttaggtaagctactcttatgcttgagttatagtgctgttggccatgagtttggtgctaatgaattaataatatattaaatatgtgtctttaaacagtaaacaaccataaaacaggttatttattgattggttgatgaaaatgtaaccagagacttgcaataacctaatccaggttttccccaggagaaatggtttagtattcacgaattccatgctcatggaggctttaaggacataactgctgtgaataatcaataatgagggtgattgtacctttgtttggttttctctgagaagaccgtcacttatgagtagttattttgggaggtggttccaggaaatgcctgttaggggagtggggactgagacaaggaggagaggcatctggtaaagggtgtgtgagcaagcagatgaccactgtggggaactggagcttcatatggctggggaactctgggagctgctgtagggacacacagctcagagccctgctttctgaggggtggaggagggaaattctggcagtcattagttgaggagagggggtggggcagcatcaatccccagaaagagccctgaggcaaagaaaagtagaaacaggtagtttgaagttcagaggatggttgctgcttaaacgttaaggactgagaaggtatatgtggctcaatgacttatattgtatgtatctgtacaaacatatatacatatatattcatgaaattttatgtttatgatctaattttgaagtccaggctcctgcagatcaaaactttggctgttaaaacttaaggtggctcatgcctgtaatcccaacactttgagaagccaaggtgggaggattgcttaagcccaggagccagagaccagcctggacgacatagggagactgtctctaaaaaaaaaaaaaaaaaaaaaattagctgggcatggtttcgtgcacctgtggtcccagctactcaggaggctgaggtgggaggattgtttgagcccaggaagtcaaggctgcactgaaccgtgattgtgtcactgcattctcggctgtgcaacaaagtgagaccctgtcacaaaagcaaacaaaaacaaaataaaagtcttcaggatattttctttatttttgatatattatgctttggactatgtatattgctgaaacaagaaagggtacagaagaaagatgtgtctgtgtgtgtgggttaatattttaaaattgtatctaatctactatagtcattttgtccatttttcccccattttacaatgcatttaaattatttttttatctttgaaggtagcaaagtaccatgtacaacacacctgtttatgtctagattaaggcctactggagtccattttctatttttaaaaattcagctcatttagaaaaataatattcttcctaggcaccataagtatgtggcacatgtgtctcagcttacttacctggccctaaggtgagaaaactaacacacacataaagtatctaagcttatcactgtccataacttttcttctttcctccattcaccccttctcatttcttctatcttctactctcataatttccaaggtaaacctctctttttaagtcaccctaaaattccaattcttctggcctactttcagtattcccacttaattactcagttttatgcactttgttctcttcttattccaactacattttctcccttttatttagcataactacaagccatgtagacaggaagttatcacttattgttttctcccttgagtctctactctgccaagtttgcaccagcaaacaaacgagaaacacatggccagtctgtgaatagaaactagaggagtgaggactaagccttcacagtcaggatgacttttctgatctgttggcagaagcaaggctgagatttcctaagcaagaaggctctatttacagtgaaaacttgagaggttttacaagcaaaaataggatctttataggcagagagacagctttaaagccccaggagaaaattcacagccatccttgaggatattttttctttcatttaaaaaaaaattatttcatgccaagtttgtgacagtggagccattttatttcacttttagttttctaaaaatgcatgatctttgtgtgttgtttgtaaccatacactattttatttcaagtctgcttctgtctcatgaaagaggtaaataagtatggcagatttcttcacatgtactatggattctcccctttcttccactgctgttaaatcctattgtaagtttttatgcaagggctagttctagatttctctagcctttccatttgcatatttcagtatttatatctggagtagtctcttaaaaaatctctaccactatagctttcacttcatagccagagcagactattcatctcctacctctccattcgtcttgcccagaacccctcatagcctgaacactctcactcgcagaccccaggctgttgtcattgctcaaggtcagggcatgacctttaagatctctcacatagacaggaaaatgtatactcctatgtagatgatcatgtgttctgatcagtctgggccatttaaacatatatatataatatatatatatataatatatatatacacacacacatacacatatatgaatagaaacattatatatgtatacaatgttttgttctattttttgaagaattttattttttaaatagttttgaggctgggtgtggtggctcatgcctgtaatcctagcactttgggaggctgaggtatgccgatcatttgaggtcaggagttcaagaccagcctgaccaacatccaacgtggtgaaaccccatctctactaaaaatacaaaaaaaaaaaaaattagctgggcatggtgacacatgcctgtagtcccagctactagggaggctgaggcaggagaatcacttgaacccaggaggtggaggttgcagtgaggcaggattgcactactgcactccagtctgggtgacagagcaagattctgtctaaaaataaaaaataaaaaataaaataaaataaaataaagtgttttgaaaataaatatttatgtctaccactataataaacccttccagtcaataaatatttttaaaattatatgatttcaatatttttagtgcccctctgtttatcagaagtatcctgtttaatcagtaagcataaagtcactctacttatagtgaaatgcaagttaaaattcgtctgcagagtctatttgtaatgaggcatcagttgctgtatttattttgcagaatcaatgaattgttgtatgcctatacttgaaaaagtaattcaaactcttgctttaactttcttacctgtgaagtgacaaacaacaacaacaacgaaatagaatcactattatagaattgttaccaggatcaagtgatatatgaaagtaaaactgtcacattccaacttcagtattcagctttatacattttttagcatctagctactataatagaattttggtgctggagtgaagaaacaatccatcagtataactcctaggccattactctcatcttaaatacctttttacttttattacggcctatttttctattgctttctgatttattcacatatgtatttcctttaattcccatttgtcactcttctttcctttctgcccccagagaaatattctaaactatgtgatgtgtatgtttgtgcattttctttcaaaagttgcagtgttattttgtgtgcatatgacataatttacgtaaatgttattgtgccacacatttcactctcttcctgcgggtttctgtctcttcagctgtaatagtaggacatttagttcggtttcaaaaccctaactttaggactcagattgggctgtttgcttcagaattatctggggagctttagaaaagtgcagattcctggccgggcaccgtggctcacgcctgtaatcccagcactttgggaggctgaggcaggcggatcacgaggtctggagttccagaccatcctggccaacatggtgaaaccccatctctactaaaaatagaaaaaatgagctgggcgtggtggcacgcacctgtagtcccagctactcgagaggctgaggcgggagaatcgcttgaacccaggaggtggaggttgcagtgagcccaaatcgcgccactgcactccagcctggcgacagagtgagactccgtctcaaaaaataaaaaaaaatcaaaagaaaaaagcagattcctaagcctacttacaacttaaaaaatttagaaatcccaagaaccgggcgacctcaaagtttttacctcatagaaaacactatgcttcccctgtaataacagacgtttctttttttttgccttttaaattctctaatgattcagcaagaaaatgaactttcttatgaaaaactttaaaagaaaaattatattggcatgtttataagtactagattataattattttttcctcatataactcctagtaagtaaaaggaaacacaactgttaaattaaatatatatggagagagtgtatgtatatatactataatatagtatatactgtaacctatctagtatattagcttaggatttttttattagaataagttatgaaatattgggtttagctgttaatcaaaattgtccccatgtgcttgtaatgtttacaattgggcctgagtgtttacacattcagtattcatagacttactgaatcagaaggtgtataactttttctggtatgctacttcagctattaaaagtcctttctcattgaaaaaataccatagccaccaacatgtactttcttatgatttccttttttaaaaaattaaagtgcccttttcataaagatattttaaattatagcaattatttatattagaactatgtttttgctaaaaaagatgaagcatttacttataatacattttacctttatgatatgtcaacacaatatttactgatcttttttcttagccttttttctaagcagctgctcttgagattgtagattaagaataaagaaggaatataacttgtctgaaatgaaaaagggggatgagagtgagcaaatagatgtattttcagttcaattatttgcgttatttctgtcttctctatgtaaagaatcactccacttataataaggcaagggagaatcatctattagaatagtgagggagcctacctagcaaaatgtattctgaatgagaaatacacatataggaaataggagaaatgaaaaacaatagcaatagagagctaactccttttgtttccccatcatagaggattaggggttggcatacctagtctggaacctctggtgagttttcatggcggtctgatgttgtgtgaatgacataggaggacagagaaaggaaagaaactttcatgtccagagtgggtaggtgggagaggccccttcacaagctggctttagcctgcttcttaggccatgagcattcttttcttaaactccttggatatttcaccctgtaaacattgaaggttgactttccttgttcatttcttcttctacttatttattttcaaatttagtacgtgtgtaacgtttatattggtaacgttattgagagcatgtaaattggtattatcattgcattgctactcagagaattgaccttgtaaatctgcagaaatccaataaaaactaaaatattaatattatagtcatatattcaagcatgggttgattttttttggtagctcctctgaaatattttttgccagaggtttcttctgatattttaacaaagatcaatcaacaagagttaatagagattatgacttatctggagaaaggaaaatcagaagtaattctaaccttcccctactgcttcaaaggctgagagggctttgaaataacaatttatttttctaatatatgctgtaaatatttaaatctaaagatgtgaaaaatcttttatgagtatatgttaagaataaaggaacagctctttgagataagcagtctacaattgtacatagcttcaaaattagaaaaatgaacattaagtgatttggttcaaggttaccaaaaccttgactaatttcttactaaaaacaaaaagcatagactttgcaacctttttgttccaacataaagtctaggaactcaggagtctggaagttgacaaaacacatttattcatttcctaaagatgtattgaatatctgttaggtgcaaagcactgtgtttgtgctggccatgcactggaaagccagcagacagagacatgggggccttttccaagtccttattttctacatagggaaaacagaaattaaagaagaaaaaaattcaatacttagtgataactgtcacaactgccatgcaaaagacatttgggcaggtatgagtatatataccagaggtcctgatccagtctgatgaatcaggaaagacttaatgagaaaatggtgttgaatctgaggcctgaaaagaagtgaaggctgggagtggactgggcattccagctagagggggcagcaagcatagacatacagaaaaggaacagagcaaacttgagaaaacgaaagcaggccagagcattgaagaagcaactggaatcagaaactataatgtgaagttagcatcaattaagattactagatagcttccaccttcctgaacataatgagttatctgaactggggggaaaaagcagggagtgagttgagaagtcactgaaattttataaggaacatatttagaaaaagtagacaacattccacttacttcacatgcagcattttatttagattttaaaacaatcataaagtagggtttattttttcttttacatatgaagaaactgaggctcagaaagtatatataatttgtacaaaattttgcagaacagcttaaaagctgatgcttgattaattttctttgagatatctccctaacgtctatcaataaagtggcattaccactttcaccatcaccaccacccgggaatcacgcacaggcttccgtttggtcaaacccagcaccatatatgtaaatcaggtctagaactaattgctgaggccatctgacttccttcagtctacagataagaaaactgaagcccaaagatgcaaagtgacatacccaaggccatggcatgagttactggcagagcctgggcttatgaattccacaatacttttcacatttcatctccaggcaccaacattcttttggcagaactttccactttgcaaaggttagtggctaacagaaccactaaacatctagtactctgacaaaattgtactgaggtagccacatttattgaaaaaagtcatcttgaattttggaggcaaaaacatccctcaaacctcttcattaataatgtttatgttctaactttatgtatgattagaaatccgtgtgaataaaccaggtaatttattttcaatcatcatagaaataaacagctttactctcaattctaaaacttttctgacaagtttttaaagataatggagattagatagctatcgagatgattaaaatataaaatatttgagattgttggaattggaaaaaagactttatcaaatataaaatgggtttttaaaaatgttttaagatttttcaggaagtcaaaacatgtacactatttgacgatgccaaattgttttcaaaacgaatgaatgtgtttaattcattcacaaagaagcttctgttcaaaatgactaaatgcaaattaatttgacttttaacattaaaaaatgaatgtcaatgagcagatattttaagagaagtggttttgcaaaatgaattatcaatcatttttagctaggttctccactagagggcaaaaagagcatttcaacagaatacatgccttaatgacaggctggaatttgaaactgggcatgcttctgtttatctaattaccagtcttaaagtgtacttaattaatcataaaacagttggcttttaaattttttccaggaaactgagaacaatcaatttctttttcttatttctctttttggcttaatcttagtagcaagaacacctgccccaagctcatgtgttgtctgccattggacatatagtatctagctggaatttttcattgtaacatttttaaataaaatcattcaagaaattaggaatttggtaattggaaagagatgtatggctgcaggtaggcaggataacagttttatactttgagaaacatgatttttaaagctcttgtaaaataacatgctggcctttggaatttactgactatgcttgtattttatggacagagagaaaataaactgccatccatttgcaccttgttctgatggagacactaagggataatgaactctctatttcaccacacacatcagccacctgtcccttctccttcgtgtgatatgttaaatcaggttccttaaaagcagatcctgagacagcggttcagatattggtgatttattgagggagggttcttcagaaaagcttcctgtaaagaagggagtgaattcaaattgagaggggcaaagagctgagcaaatgtgacttcagttcaaggccagccttgacttaattcatagggagaaggctctagagaataaattgcagagttatccacacctgatgcaaaggagctacccttttatgccctttaccagtcagccattggctgtgggcactaggatgagagagagtcgagtaactcagggttaggacaatagtcttagctgagtgaatgcgcagtagaaggaggcagctatgagccatgcattattaaccctgaaatgtaatgaaaaccaggatagaagcattttatctttgcaaattgagtttttaaaatatatattttgtctacctttgaacataattgcttgtctaaccttcttgaaaagctattgtttttttaaaaaagtttctttaggttgcaccacatgaaactgccattattcaatagctttttacctacacaaatatcaattttatcagtttcatatagttcaacctagttgtctcattgccgtaatgtattttgtgatccttttacttatcccatgcaacaaaatctattttaattatgtaatatttgcacagccaaggagtctcctattttgaaacttcagggcaaaatttttctatgttgctttatcttgcttaatgtgaccactgttttactcctttcaccaaaatatgagcataaaattttttcagattgctaaatttgttgaagtttaccaatgtgtgactaatgaaagcacaactcagacatttaacttacagccatcaaataatgatactcattcgccttcatataagccatatgttccataagttctgtgaatcaaatggaaatctcttttggggaacaagaatatgactgtgagggtgggcccttcctcaggttttataaaaatatttatttagccaccattagacatcaaacactttcttagctttatgaaggcattcaaatgaagtgtaagaccacgacttgctttcaaagcattagaagtccaacactggaaaatcttaatactttgaggctctatttttaggaatatatgtttatgatagtcatattttctggttcattgattttattaccagtatataatatctttttttctgtcccttatagcatttcttcttgaattccatttttaagataataaaattactatttttagtttggttcatattggagagacaaatctttttcctactttggttttcaaatttgtatgacttttatttgtgtgtatgtctcttgttgtccagatattttctgatcttgatttttttatcttgagacatttctcttaatacctgagattatctcgctacataaccttaattctaccatattatcacatttttcataacttatctgttatttctgcttttcagttttttattggaaaggtgtagttttaatttactggtttaaaatgtatttaaccttgttttgctgttgatggtccttaacttaaggtctgtattcgtatttatatccttgtattgatatctgtatcttcttctagtaagacaagtccatttggtcccttccattgcctcccatcacatagatagtgttcaattctaggtgtttatttctgacatattatggttatagtttctctctttttcatagtaattcatggtttgttctgttttatttttacggcagcaacacacttaatcagattgctttattaccctttcttcccatatttcctgtagcatcctcctgtatgtctttctctttttatttaagtccttgacccaagaaagtttttaagacaggtttttatttagcaaatattccaaggccttgaatgcctgagaatatattttaatcatcccatatttgaatgaacttttaacagtttataaaatcccaggtgatatcgtaggcaaatttggcagtactatgaacatttttcttctcattctcaaaagatctcactctgggatggctgaaactgactgacagtggagagttttctttaagggcttcttagcgatcagtaaatacctcatttattttatcctttgaagtttgaataaaaaaccatcatagctgttagtttgtggttctagcaagaacatagctggaagtaaaagaagacagattctccagaaggaagattttagactccatcagttggctcaggaatggccacaatctaagaccaagttagagtgcctgacaggaccatatagtcagaccatgtagggcaagaagcggaggtggaaggaaaacactgggtgtactgacagtttaaaggcattaaacataaaggagatggtaaaagggtcagaaaaagcttacacaactttgaagtgtagtttgaaataatgcataggaaggtgtgggaatggaggaatgtggcccaatgccaggaagatgggtctggcaggcaccatatagaaagaagcccttctgttacctatagacatacagtccttagctcatctgcctgccaaccaaccacataccctctccctcctcaaccaactcttggcccccacatccttagtgatgctcttgggggtgtactgctagaggagagtggaatgggatctggtacggggtctaaggtgagaggggatggcttgaccctatcacagtcatacctatttattttcttaaatactcttccaaatccttgcaacacatcaattgacatctgttgatattacacctgggatctgggatagatttcctgcaacttagaggtaactggtggcaaattaggaagaccttggatgggattaacgcaggggcaggattccaaaaacatttatggaactcgggaatattaatacacagctgtttatattctattttatgtcacactggaataagaggtacaatattccttataatctatagaagataaaaaacagagagagaaaaatattccaccaatattttattttgtgaagaaatagacatttgatttatgattgtactagactggtatgatattgaaaacaattgaaaatgatgttttgcctgtagtactaagtaatgaagtgttctcttaaaggatagacaaaaagaacaacaaatatgcttccttgtcaattccaatttcaacttctggaatttgttttgagaactgaaatggtgttagaatacatgttttactctgttttcattataacctgggagctgtgcactgaaaaaagtgaatggtgtagttaatccccttagggaagtggttttctagttgagaaagaaacaactctagatgaaaaatgtaagtcaacaataggatgtggtatttgtttttaaataggctggacatacaataatgagcagacaaaaattcccttacactgatgtctagaaggtggtctttggaagaagaaattctaacatgccttaagtctttatctcttgggatggaagaggaaaggccaagaataaaaatagcataatttaggagttttccgtcatatttcagatctattacaaagatcaggacagaaaattcctatgttttcttattagtattcttagaattgagactccaatataacaatattaatgaccaatattcagtagtgagtgtttggtgggcttacgaaacaattaacatgcatttcaacagaatataccaaccaacatgtattatcaagtgaatatataataaccaagggagtacacaaaagaatgtagtgaaacttaatagtttgtaacagttcatacaaggaataaataagcagaactaagaaccgatattaaggattccagttaagattggggagttcattttaccatccccatcagcataacttctacctcagctatggctcagtgcaggagatgccataaagaagacctttatttctgaggtagcatcagttatcaatcaatagatttttttgcttaagcatcatggaaccaatgaattatccaagtaaaagaggaactgaaactcatctatttagggcccagactttaaagatgaaaacctaaagcccagacacaaagtgattttccccaggtcacaaagggaattaattagatagacaaacttgggaacctttgggcattaccacaaatatatgctctacttttgaattctaaaaataaatatttaaatcctaaaaataaatattaataaatgttgtaatatatttttgatatttggcctaatacagattaaatctttaagacatatagctaattctttttttttgatatgagaggcatatttctatcgagaggagctttttccacatagcatgtattatccacagacctcaataaagaaaaaactcagagcattgcctatgttttattccagggtatagaattgtgagcagtaaaaccaatcaactagtgtttggtgcacaactgctaggatatgatgagacctattctcaagcagcttgcagtcttttggggaaatgtctttggggaaatgaggaacacacacacacacacacacacacatatatatatatacacacacacatatatatacacatgtatacacgtgtgtgtatatatatgtttatttacttttattttaagtttgggggtccatttgcaggtttgttacataggtaaatgtacgttaaggggatttgtcatacagattatttccttagccaggtattaagcctagtattcattagttgtttttcctgactgtcttcatcctcccaccctccaccctctgacaggccccagtgtctgttcccttttatgtgtccatgtgctctcatcatttagctcccacttacaagtgagaacatgcagtatttggttgtctgttcctgtgttatttcactaaggatgatgcgtccaacaatcacatgataaaaagcccagcatcactgatcattagagaaatgcaaatcaaaaccacaatgagataccatctcataccagtcagaatgggtattattaaaaagtcaaaaaataacagatgctggcgaggtcatggagaaaaagaaacacttatacactgttggtgggagtgcaaattagttcgaccatgtggaagacagtgtggaaattcctcaaagacctagagacacaaatatcttttgacccagtaaccttattactgggtatttacccaaaggaatataaatcattctattataaagacacatgcatgtgtatgatcactgcagcactattcacaatagcaaagacatggaattaacccaaatgcccatcaatgatagactggatgaagaaaatgtggtacagatacaccatggaatactacacagtcataaaaaggaatgagatcatgtcctttgcaggaaaactcatatttaacagtgttcattcatttaataagcactttcaagggcttacagatgacactgaagtgaagttgatgcatacaaattcctcatagtaattctctgtcctcagtttctgacatctctctcactcattttacccatccacctgaattttctccctatttttcaaccagcccaattgtgagtaatttcttctcagggactaattccatattcactcatcatgcttcttattcctatgaggtagcatccctgaaatttcagcctctgggaaaaatatgccttcatccttttagtttaggttagattcatctattatgaaccctgataagactcaatacttttacttcctaacacattattttgtgtttggacttatatattcctgattatataattactatctgtctctcctgctagactgtagtcttcaaggcaggtgacaacgtctgttcactgattgttatatccttaacatctagccaagtgcctgacctattagcaggtacttaataatcaaatatgtggtaaatgatctaactatacaactccagtgtatctgaattgattaggacattttgagtatagttaattttagttggaatagataaatatttgaaacaaattcatttcatcaatttatacaaagatattggcaatgactttactattcaacctgtggtagcatcagcaccagctgacagcctgtcataaatgcagaatctcaggcccctctccacaactaccctgccagaatctgaaatttacaagatttcctgggttcctctagcacattgtgatatgttgtaaatcagggattaaaaacacaaatactttattgggctaggcatatctccaaagtgaatgaaacaagccatatatatatatatatatatatatatctgtctctccatatgagacagataataattatataatcaggaatatataggtacaaacacagtatatataatatatagtatatatagtaatataaatatatattatagcatataatatataatacaaatatatatattataacatataatatataatacaaatatatatattataacatataatatataatataaatatatattataacatataatataaatatatattataacatatgatacatatatattataacatatgatataaatatatataatagcatataatatataatataaatatatattataacatataatatataatataaatatatatattataacagataatataaatatatatattataacatataatatataatataaatatatattataacatataatatataatataaatatatattataacatataatatataatataaatatatattataacatataatatataatataaatatatatattataacataatatataatataaatatatatattataacataatatataatataaatatatatattataacatataatatataatataaatatatatattataacatataatatataatataaatatatattataacatataatatataactatattataacatataatatataactataatataacatataatatataactatattataacataatatataactataatatattataacatataatatataactatattataacatataatatataagtataatatattataacatataatatataatataactataatatattataccatataatatataatataactataatatattataccatataatatataatataactataatataccatatactatataactataatatattataacatataatatataatataactatagtatattataacatataatatataatataactatagtatattataacatataatataaatataatatattataacataatataaatataatatattataacatataatatataatatagataatgataataaatataacctataacatattatcatgatatgtatataatcatgattatgtacataatcatgataataggtaacctctgacctctggcctcctcataggagtggtggggactatgtttatatgagatctttagcttcatctaaaaggcacaggctactgtccagagtcacaaaattgcaaggttagtgttggaagatctttgaacagttcaagagaaaccagaaaaacaaaccggcatgtatgatctatggacttaaacactgacaattaaatttaattctttttaaagcaaaagaaatatgaggatcaaatagaacttacttgtgtgatagttctacttgaaggatcttcagttttcaaaatctcatacaaaggatgtcttttaggcattcagttcatacttcctaaggcctcactaactcagaattctttaattttacaagtcggaaaactgtttcttttctgtagccatcgaattcttcctttcttttattaatttattcattcagtgtctactctgtactggttgggtcctatgctaagtacagaacaactaacaacgagttagttttagttatttataatctatgacttccaatggcatctagtcttgtaatgacaacattagacttatgaaacagacagtatttgatgtgggtattgctgcaataatttgtaatgtcgcttttgagggatggtcttgagaaggttatgctctgtcttagcagttcagaaatctaagtggagagacagaagcagaaggtacagatgactgaagacaaatggtgtgaaggaggttgacaagaggatgtggttgaacataaaagcaatcctaaagaagtgaattctggatggaatgtatggcacccatggtgattttaaaatgttaaaacttcccgtaacactccctcagcttcacaatttcgggcagtccagaaaacatactttatctccactcaaaaagagagaactgtttcacaaaagctaaagctctaaatttcatgtcttgtgtacattaaagacttaattaactgatttaaccacattttgcctattttttttctagttgttacattttcatttcttcagttggtgtgaggggattttatctctttgtgagtgtggtttatattaccttggaagaggcagtgatatttttgagcatgctagtgacaaacacttcacaaggctttatgttagtttggtggcagctgtgaccaaaagtgtaataaaaatcaactgaatgttttattcaaatgtgtttatccaacagtggtgagtgaacaaaggttgggttaatctgttatacaatatctaggactggattttctatccaggatgaaaagcgtgctttgtctcaattctcttgaattttccatttcatttatctttccatgttaaataatgctctcatgttaatatcagtaactttttagttatttttttctttgaggcaacatagtagtttgttttccacagtgtttaccatcaagtatgccagcttggatgactctctctgtcctgtaatattaatctactctctgcatagcaagccattcacctacgtagaacttgtttttttgctgttttttttttttttttacgtggagtgttgctctgtcacccaggctagagtgcagtggcgtgatcttggctcactgcaatctccacctcccgggttcaagcaattctcctgcctcagcctcctgagtagctgggactgcagacgcacaccaccatgcccagctaatttttgtatttttagtagagatggggttttaccatgttggccaggctggtttcaaactcctgatcttgtgatccacccgcctaggcctcccaaagtgctgggattacaggtgtgagccaccacacccagtcagtacttgttttaatgcttagtttcactgtttccattctgactggcaaaattttcatactgtgtgttattgtcctccccatttgacatctctagtcctcatgcattacaaagcctctgcagttggcagaggttttagcattcaacatttctctctgttcccagtttttcttccttaatcaacaaaatagcaacatatctaccctctgcttctttgctcatcctggaaagtaggaaggctagagttacccagaaaacttgagtctattgtattttctgagatcatatttttattagaatcttctttttttttctccctcccttccttccttccttccttccttcccttcctccctcccttccccccccactttcctgccctgccgccacatctctcatgcattatttaaatatcttccaatccacatatttcgatattttgcacatcagccacagtaactttttttgaaatgagaaatctgaccacatgaccacacgtgtcccctacttaaagtacttgaacgacttctcactgcctaagataattaagctcagactcctcatctgacatataagctccattatactgtgtctcttgtgtggcctttcatagttataccagccagccctgagatgctcttggtctgagaatgggacacccttgacttcagtgcctggcttttccctttactatatgtcatactccattcacttcccctgtctctctgtcttccctgcttctttttcctgcataacttcccatgggcatattgccacctcatacttgctttgagagcacagtctctgcatactctcagtctagattccagcatggatgttccactcactagttttgggccttgaacaagttattctacctctcagtgctttagtttcctcatctgtgaaacagagtattactagtgctcaccttaccaggttgttgtgaaaactaaatgaacaaacccatataaagaatttattatgtgagtatgtaataaattattatgactaaatccataaatcttcacaacacattaatatcacatttttagtcagcttaagaatattaaaaaggcaaatctactgtgataaaagatcataaacagaagaaagcatgccaaagctaaatataaatgatttgaggattaccaattcattaggatcagtcattttctgttctctttcattgattaggataatcaacacatagtttttgaaattcaagattaaaataaaatggattaaaattactgaatacctgtattagaaaggaagaatggaatataacagtaggcatcacataatgactcgattgcttttctaatctcagttgaatgctttattgggatattaccaagattttaaaatttcaagatgattcttcttttctgttttaggagattagaaggttggacgtttgacattgtacaaactgtgatgattcatatagatattgtactacttaacctacttataccaatgactgtgctatttccaggataaatcacttgggtttgaagtttgaagcagtacctagagtctgatcctaagccatacttaggatctcaggagactctgatgaacaggagaaagtaggtgcttccagctgcttcctggaattctatttagatttctagttggctctagggccagatcatgcttctatttaaagcaatggtctcaggcagctagaaggagtcctgttgctatgatacccaaaggattttatagttgggaacagagtgtaagggcttggatttagtgaagctataactttaaacaaaaactggctccattcttgaatgtctgttggaacaaagggaaacctgaggaaatgtcaggtggagacctccttggcctccctagcagccaaggttagagtcttcccctgggtaggctaaattactggcctccttcaaattgctctgggggtttaagagctgatctctgtccatggactttttgcccaaagcaagaccctgttgaaagtgaaaggggtccaatcatttcaatagccctggtttgccgggaaggatggcagaaataagaaatattcctgtcaaactggatctgtggtgattctaaagctggagctaggataaatggttaataccaaaaaagggtaaacagatttcattacaaacgtttgctctccccttctctttgtgtgtgtctcttaggttgtctctttcttgcatattgatgactttcttctatcttatgaagtttatgtgtagctctcagaagacccacatagcaataaaaattcccacataacaaaagaccttctcttctgttaaagtgtctctatgatataaattacattataataacatcacctggtgagattacaatgtttatgaagtctgtatgtattgagattattaatagtcacaataaagcacaatattttacatttccagtaagtactgtctatagatgcatctacacttaccgtgggtctgaacatgacttgttgctgttgctttggagcttttcagttagaggcctattatctgagaggtgaagcataaatttaactttgtttcctctctatgaaatctgttagtgcattttgacgattccttcattacatacataattaatgaaggcctatgctatatgctaagcactgttagagttgatgtgtgacataaaaataaataagatgtggtcttatacacagagtactcaccctctgccaaaatatcttccttttgtcttttagtgacaattgaatcttagtgtttatacttggtagaatccactgttatctgcaataaaatatttatgtcattgtcaatctgtttaaatgaaattttaacatttatttttttctcacttctactcctgatcatatcctgggcatcttttctgtgaagctgagtcatccaatggtggctattcctgaacatgaagctcttgattccaaagaggtaaatgtaagataggactggatatctaattatccatttctgtgtgattatagaaataaaccaatcttatttttttaatgttaacaaaattgtgcttttataacaaaagaaagaattattactaactgtttcactctgtcagtcacaaggatttgatagtgaaataagtaaattcttgctgcctctcaatgtagaaggtagcactagagttccccgtgtctgatacctggaccacaaaccaactcctaccccaagtgcctgtctttgtgatttcctttttgggttcatatgtgaaatcaccattgtcttctttctctagagggtcaatggatgtcccataatccatatggtgtgttttcagggtcagagtcacagtatctcatggtatctcagtttcagttcataggaagatgagtgctaggctcactgagcacccccaaccccaccttccccaagtgaattttatatatggcatgcagcttttagacaaaggcatatcagctcaatcatagcctctacatttcatgtaaatgtttatctaaagttttgagctgataagtaaaaagtaaattcaaacaactttctttttttaaaaaaatgctataccacagaaacaaagaaaaattctgtaaagaaatgttctcattatggtttacttttgtattcctcaagagcaagaataactgaacagtgttttcttctttacatcccctcagataaagtggaaaataggagaaaaaaagtgattttaaaaaacttatctctgagaagggactgggtgagctcacacattcatttaaaataccctcacaaaagaagtatgcttaattttgcagcctccaagtttaggaagaaacaagcataatataaaagagaagtaagaataataaaattccacgtataatttgaattttgttttccaagccatattttccacaatttagggcatactatctacatttcctaaactggcatccctatttctgcaaatttaaaaagctctgtcatagtataagactgatgtggctttttgctgtaacattagtcattaaaatataaagttgtgttatgaataggtatgcatttatatccttgaccacatctctggttactttttaagataatattgtaaaaataggattattggttttatgattatgaacatatggaagactctcaacacatgtagccaaattgctgtcctggaaaattgtagtaatttaccacatgaggagtgtgttataataatatctgtctccatgcagtcttggcagcattgagaattattataattcccagtttattgagaggttactatacattagaaacagtgttatgcactttgttttacttaattttcataaaacattcttaagttaactactattattattctttttagagatgaggaaactaaagctgcaggaacttaatctattgtctaaagtcaaatagctaggaagtgtctccacaatcagaaattgaatccaaatctgacagcctgcagtctgtgcctcttgggcactctattattctctgtctggtatctaaattaatctaaattaggatttttaatttagataaagatatttatccaaatttctctatttaaatttatatttctatctatatgatctaattctttctcttttaaaatcacgtttaaaatacttgccaaattaaaagggaaagttactttttaatattaatttgcatgttaaaattctgtatttcttctgttatttttgtctttttaaatctattttgtttttgcattatcttatgcatttattggtatggtaatatatttttgttgagtggtaaactccatttttatatattaaagttaataactttttgtcaaatgtgttagctctttcagtatgatagtggcaaattgtgtaatagtgaaaaattagaaaaatatatactttcagaaatagaagaatgattaaatagattttgcccatttcagatgaatataaaaaataggaaactttgtatttctttcaaatacaataattttggttcaagttcacattgactatatctacacaataagagtgttcctacacaaaaaagagaaaatgaattggttatttaaattacaaaaacagccagttcagataataaattgagaactactgaatgttaggtaatgcaaaagactttgtgagccaaagagaatggtatagatgtagtacttgcattttttcacaccaattatcacaaccctggagacaaaacttaaaattaagatagtggataagattgccataaaatgattttgattcaggtttggaatatacgaaaaatgtcatttacagtttgaagtttaacatttgtgagagacaatacctattattagtaaaaaatgtaaataattaaggaaaaggccattttgtgattccagtgttctgtattttacttcttagtaatattggcacattttggagcaatttagcaactttttacaacttcttatgatgtgtggtcagaccaatattgaccaatatatttcccccaaaccttttctctgttatttatttaccttcaacaacaaccaagaaacatcagttttataaagcaattctgttcttatgactatatgacctaaaggaataaaccatttcagttacaaacccagtgcaaataaaaaattatggaaaagcccttgatggtatctcattattttcctcttggtttttctttcatttcctaaagacattagtttgtcttgcttactaccagactgtcatttcttgaatcaaatcaggctatttgtagatactacctttttaaaattaactcagtaattcatttaaatacaaacagatgttagatatatcagatttgacttactcatcatttttgtaactcacatcatttctaaagttcatttaaaaggaactaactcaaaaaaaaaaattccacttaacatctagctcagtggttctcaaccctggctgaacattagaatcatctgtaattgacttttgaaacacaccaatgataaatatacttccttgtcatatgacagaaatccattccagacaaattaataaatcaagaaactttataggtgacaaaggtatttgtatgttttaaaatctcttcagattattcaaatatgcatcaaagtttgagatcttcaaattatagttccttcattggcagtctaggaaggccaatcaaataaatccatcattcaaccctgaaaacacaaaatagaaagtaaaagtaggaggatcatgaaagaatttgttgcagtgaatgatttcaatttctaaaaacttgagtgacaacaaattcctgtccaaaggcttaaatgaataacatgtgctttaatttgtggtagattaattttgagagatctgttctgtgttgagatccactgtaatttcattagtaaaatttaatactttatttttgtttgccttgacattccatacaaggtttggaaattgcttaggatggggctggcatagcatttggtgcaagccgagtctggaggcttagggcattccaaacagtgttttatttgtactttatatgacacttaaaatacatggtcactgatgaaactccatacaagcagatgagatctgtaaataattgatttgaccattgtgtcagctcattttcaaagaagaatactttcatagatttttactgttcacaccaatgcagtaatttctaagaaggtgaatatttaacaccatacaggcagagcatactcgttgactaagataaatgatttctgagttgagttacttaggagaaaattaaattctagtagtgacaattattttttattgtatttctcatcttgtaagttcagcaactcttctatccacaaccactccataaactacttctccttctgcagacttgtttgtgaaagtcatactgcagaatgagatataaacagaccgcccctctttgtattacctgctacatgcagccctatgactactgcattttattttcaaattgaagatcaattgatttcccaaaacatgattagatgcatttggttctgacctttcaggttcatttgttattaacacaacttgagagctaatcgttcactagctgcccataaaacacatgctaggcaaattcttgtgttttcttattccttctctttgcagatttttgataaacatttaatggtttacaacataacaattctgttagcaaggtgactatgactgatttgccactttggtggtatataagctttctgagtttattttattttgaatttcagaacctccactgatgtctaaggttctaagagtataaagcagccatcccattcctctgactttatcctctggatgagaacatagaaaagagaaaataaattacttgcccgtggaagccactctcattttctggtttgattcaagggtaaaaataaaattatcaagagaaaaaggcccactctattcttttcaggcaattttccaaaacattatttctcaaaatgaagctttgatacatcttggattgctgagagttgaaggttgtaatcttaggcaagaatttggaatctggatattattacctgttgattaaaagaagattcctatgcattgatagacaaatggctacagggccagggtaaatttgtcttataaaaataaagacacctgatacaggtacctgagtagatagccacctttcccagtcatcaggtgagcagggaaataataaaggaaaggatattcctatactcggatttgatagcaatggacccatcaaaatgactttcttgtgttgtaagcccccaacctgtgttggggaaatgtaatttaaaaacagaacaaaacaaaacctttctgctaacccagaagttcccttcactagggtagtagagaaagaaaaccctttttgttattgaataacattgaaccagaatgtgatgtgcatcataggcaatctgctaatagactgcaaagacgagaagaaatctcacccttcgtatagccaaggagatagactccattttatacatattctcaagatcaacaataattaagttggtcctcaagtaagaaaaaaatgacagcatcgttaattatacatagttcatcttaagttcacctggaatttgggatgacaatctgtgtctggctttacacaaggtaaagtaaacttctcatatctttaggacatggggtcgtttcataactttgagccaggcttgagctaaagttagagtcttatcctccctggaaactggcagatggggatgatgtctttcttggttgtttacatttaaaggacatggttctcaagtccttgaaagagacttttcagggcctgacaaaaggcccacctgttttcaaaagaatttgtatacatttcaaagagaggagaaagtacttacaatgatgagttttctaaagtaaatgctttaagaaaaagaaggaggagggaaatctctccccttatgctcagcagcaagaattaagcctttctttttgaatttccaattgttcttacacttggttggcaagaaccagaattaaaatcagagagagtctggttctgaagtagccaataaaaagaaacaggtctcatttatttttctcttctagaaactcagttaaatctactataggagaagtgggcgtttgacaattttggggtctctccttcaaagtcatctcaacagattaaagttgggtttgatattgtagtgagtcattgtcaagttgagcagaagtcaggaactaaaaggacccacaactcctctgtgtggtggcttgggaagactatttctagtttccaagagaaacaaacaaaacactaagatcagggttaataattatttggaactcacatcattcagatgtcacatggttttgaccccagattcaacattttactctttagagtccattgtacctgcatcctttatctatgaggctgcctttataggaccttaattactgaacgttttatagcttctggcttatggataataaactctgataccagattttatcttttttcaccaaagtcaatagttacataaatgcacaaaacatttgaaatctttcaggaaaaaaaaagaacatgcagcatttaatcatattatgatacacatttcttggaaatggctttttgttctcaatacatgcagcctaatttcatattcacaagaacacatgtgtaggttattttgttttcattttgcagtaaagaatatgcatatttgatgttgcatttaatgggaatgaaaaaccaactcacacagcacattcttttaaaaaatgctttctgtaacattggcttaatgtttcagaagaatatattacctattacccaaggttaactctgaatttaaaaaaaaaccaagattttgagtttgactgtgttccagaattatgacttccaaagcatcttaagttctttcttgcttgtattttcttatatccaaaataagtgtgttgtttcattggcaatataataaaatactgagccttaactgccagtgtgctagtttgaaaatagaattgatttatttgttgatgattctcacttttcttacatgttcacctttgttattcccaagttttttagctctttacctataatgagattggcaaataaacccagtaaaaacttcacaaagtgtctaaaacgatggctgtagctgtcatagcatagtacaacttttccaactggctgctaaattgtggggccaaacatttatttgacctgctggtgggttcgggaagagctgagaaatagtgctaagcttgctggcatggcatcagaggatgatctgcctatggtgcttcaatctgatttaatgattcctattataataaaattttatatttcagagggaacttagaaggcatttattccaatattttatttaatgttataatcccatctacatcatatatgctcatatatcttctattgaacctctcctggtaacagagttcaccatttcagaagccaaactcaatataggttttagtttgactaagacaaactaagtaatggctatgtgaacaacaaaagcaaatataaaacgtggaataagctggggtttaatttggagcactatgaccttgggtgtgatattgactccttctgagcttcaattttattctttgtaaaatggaatcaaatgatcgtgaaggtctgcctaagtgtatgtaaagtgcttagcatataaaatacatggcacttaaaaagtattagccaaatgatgatcatttccttaaacctctgtaaaattaactactaaatgctggtactttaagaaaaatcatgttggtgctttcagaaaaagcaaaataatggtaatttttatttgttagaaaaattaatgagcagatgtacttgagtcatttcctcccttcattctagggcttcagagaattccagatgatgaaagctacagcttacttcttactttttgcctgttgattttctatggccagaacaaaccagagcagtcatgagccacccctttgttagtgctttttatctgtctccttcttctagtctaaaatatactttctcataataatgcagaatgtaaccgcgattcacaatcctgtttagctgcttggccaagacattcaccttgcacataggagccagctctaagtcaccactgcttcttcacctcatgatctggctgagggcaaagcacagacagttgcctacagaaaggcaactgacctcctttattttctaccaggcatttcggaaggttcccatgttagtcatgagttggaacctggaaatagaaagttctggtcagttcctccattggtgttattccgtcacattgttctatcagagacatgtcttagaactatatttctcttcttgcttcatctctgatattttcttttatactttcttttgtataatctgccttcacagttgccaatagccatcttccactcaattaagtttatcttatctgttccagacagttcaaccctatcatataggaacagagagactgaatgggtaaagaaattattggaatcactcctctaccacagagcaaaattgtaagatcaagcaaatcaatatatgaagaaaagcgagaggttatttggtcttggtcttttgtaatgttcctttttgcaaaagctgggacttaattcaatccctattcagtttacctccttgttagatgatgcattttagggaatggtgcagtcaatgctaaagtgaagttaagtcatcagccaagtcatggaagggtgtgggtgtgggtgagatataacagtgctgttccttaaggcagcccctgcccctcaaaaccatcatggcactttgtaggaggccagaactgctctgctgaactgccaagagattggagtctgatgtaaaggtacagctgtttgtctttattatgccattaatagtgaaacaaggaaggatctacttaaggaataaaaataagcttttcctattgtagtataaaccatttttttgtaggagatgctatgcccaaatattaatgtataattttcaggtgtatatttttaaatttattcatcttaacctgactaccatattctcttattttacagcaatgaagttggagcagaggctgaaaacacaggctgctgaagttttttggaatgctggtgctaaccacttgctagatttaacttttttttttttttccagaatgagtgctccctttatgagctgcagtgcagcagaaccaaaaaaaaagtttgctgcaattatatagcatcacagtgctctgctaacagccagcatagaagagatttacctacagctttttgcaccactgttctagcctttaatgccttctacttaatattaagctgaccgcaatactaacgtgcccctatatttggcagccaaataaagaagaatcgtgggtaaatagaagaatggctgtgactatttttcaatacaaattttatttaatgcatacatttctaactgagtcaggtttttattccccttttacttcacttttttacatgaaaaaaatcacaacttttaaagtaactaattagctttcagaagacgctgatattcagaggttctctggtgagatcttgaacatgagaaagttggtattttgtataacacacattgctttcctgttctgttgggattcggtgctgctgggacagactatgtgccaggagcagcccagtgctgatgaacatcgcgttactggagtgtctgtgtctgggataccactgtctctctgcctgtcaccacatgattcttgtgaagactactttagagttagtttgtatccaaaatcctgagagcagcagagaccatagagcaaacccatacttgatgacagtcctgagagccccctagaggcacatcatgtgcccaccgtgttggccatcttcaatttatttcccagttgtcatccccagcagtctgtcctagccccctctaagtgatttccttcttctgctcatatgggaagcctaggataacacacattaagaaagaacaggagtctggacagtgagcccctgatggtaaagcagtcttgggaaaactggcttcattcactctttgcacattgcccatgttctctgtggagccagctctgagccacagtgcccctaaatcaagcttcatcacccagtcccatcacccaaactcaagcagggagagtgacctatagaagagcaactaggctccttcattctccaatagccattttagaatgttctaatttcagctattatttgacaaatggaaataaatacttctcaatgtcccctttgttggtgttagagaagcaaaggaggctcaataaagccctctgctcatctctccttccccccaaaaaaaccatttctccatcaacctgataaattgtgtggagcatcactttagattattaataatgatctctaacattcactgtgctcttatcatgagcaatgcaccacaccaagtactttacatgaatgtaatttaacctccacaatgagcctgtgatgttggtaatattattatccatattttatttttgtgagaacaggctcctccaaatggttaaattaagctagtaagtggcagcggcagaattcaagtccaagtaatctgattctaagaccaagccacttactcaatcatttgtgtagttatttacgcagtcatttttggatctccagtgtaaaagggtgacttgattacactcctcagctcatggcagatttctgtcacaaatttgggcaagcccccctcatgtatgcttgttgattaatgatcatcatttataagaatttctatcttcccttctctgctgtatgcacacattcttatttatttaatgtatatcttttgctcatatatgttttgaagatgtacattgttttgtctgcatatatatttaataaatataaatggtattgcttatattctgttttttttttttgtttttttctactcagctctgtttttaaagctttatacacattgctctatagacatctattatattgtgttctcacagctgcgtggtagagtctcatcacattttacttatctacccgcccagccttggtctctcaggttgttttcctgtaccaactgttgtgatgtacattcttgcatgtgcccccttgtggacctctgtgagaatttctctggaatacatacataggactagaattgtttaatcctgaagttcccatgtacttaatttgatgaaatcctcccagattactttttagagtagctgcaccattttttattcccatcagcaatgcattaggtttcttatatccccaagtacctttccacctttgaaggtctgatctttgaaacattaggatccaatgtcattggaggcaactcttaaaatgggaaggttgtttgacgtggtgtcctattcatcctatattttccaattctctaagacttttataccctttaactcattgcaattttcagtcaagtattattatcttcatttcatttgtcaacctaaataacagagtgaggcccttaaaagaaaaagaaatttatttgggagtagaatattgcggtgggtatacataggctatagtaaactatttgcatgcatattaagggaagtaaaaaacaataaagaattttaaaggaaaaaatgaggaggattacatgataattttgaaataattatccttaactgcaaatatcagtaacaaaggtgacaccagttcaagattggataggcagttgctgtccttgtagaaatattttgttgtataagcttcccatggcttttgtacaaggttgtgattttgcagagttttctgtaatagcttttatcaggcatagtagcaggagaactctctcttcatggccgtttctggctctatcagatttttgtttttaaatgtttgtgactccattttgattctgacaactttcacttgttactgaaacatttgagaccgacaggttatttgactgaggtcaccaaattagtgaatgacaaacctagcacaaggtcttttgattttcctactgtgtcattgctacaaattgctgcatctgaacatcatggtttaatttatttgttcagtttctcagtaaagaacaaagtcttaagagcgtgagcataggaaaggcaagtgttgattattgggagaacatgggacatgaattagtgacttttcagtttggtgagcagcacattcagtgcactaaggaggttgggggcactatgtatgtttctgaggaggaaggagatggggacagatgatgtggaatttgccaggtactgagactgcatctttatttgggttcttccagaagcgaactctaagacaaggatttagtgtaagtagtttatttgggagataataataggaaacactgataaggaagtgaggaagtaagctagggaagccagttactacattgggcaactactgtagtttatttccactaagaaatttgaggacacaggttgaacagtcctcagacttcattcagtttagaggaaaggaaactagggtagtaattcttaagtctgactattaacctttacgtgactatggctgtgacttccctctttataaagcttttgtttttttcggacttttcattacacatcaccggtgggacccattattttcttgtgaaattttaatttggtgaaaatggaaggtcttttgaatattgttcttcatagtctctgaagtaaagtgcagaaacaaagagataattgaaagcttaagtaacaagggaatattctcagaactttatctattgggcaagcagaaaaatctgcaattaggacagggaacaaaaattctactttaactagactgctgcagatttctacatgtgaattgtttatcaattagaaattaaatcaactgtatgagatgataacttgatttataagaagaaaagattgctttgcttagagtaaatccagaggtcttagagtaatcaactagtagttagaaaatatttctggatttgtttaaaatatatagcacatttgggggacatttcatatattcctgtggtaggttgtaaaattaaatgttttattcccttcatactttaaaatgtattattttcaatttatttgactagaaataggcttttctcttcattttatagtttaataaaaacgctttaatttcttataaaagttttctaacagatgtatatacaattgctcaacatcacttaagcacctgagtccatattttccttaattggaaactctggggataaattcaaaaaataaaaccacacaacaggcagaggaagagtcataaatgctaaaaaaaagaaggaaaagtaaaaaagacaaatttttccagggggctacagattgtgatttaaaaatattgaacagaatatctaaattgaaacaatggaaaactcaattaaaaatatgtttagccaaaaatatgttctgtggaagtactaagaggcaaaaggttctgataataatgtgaatagaactggataatatttctcacaaggcttagaagccttttcaacttcgagctgagttaaatcacttaagggcgtagaaattctagagattttgtcaactctgcttttgagtcacagttcagtctttttgtttttctttttaaatcaatactagtttaggtaaaaatagcagaagttgtggagaaattaaagttagcagcttacttctcttttccaactaacagataaagtttgtaaaaccttttacttaagtcatttaagattagagaaagaagtagattttgaagaatgcgtagtaggccaggctctgaacttttaagaactggtgctcagttaatattaggtaggttcaacagaatttaggaaagtataccaacaaggactgaagctttcattcattattatatactaaggcagtaatactagggagaaaattctatttttcaaaatttgtttttgcacacaactaataatatttacataaaagggagaaaacaaaaatgtgtactttcttctaagtttccagtcctatcactgctcacagattttgcttgcatttttgcatcgggcgtaataataagggagattaaacgttaaggttaagatgtggcagaattggattggaattttggtctttttttctctgaaggtctttttcctctacaagtgtttttccatttttcttctgccatgagtcaaacagttaacactctcttggaagtcacattcccttctctaagggtacatcagtaagagctatgaatggagattatgacaggtgggagcctctttaccagctcgggcggcaaatagtttcaagtctgatttttcagattaacggttcaagtttccacttgcccaacaagcaggaaatctgaataactatgtttggatattctcctctgaatccccttgcccaaagcctcctttatgcaagatgaaactcctttttgggaactaagctccacttctctcagacaatcttgatgggcacaatactactcaaacaattcttcctaaattaacaaaatctgctttaaagagactgtttcttgaactatggacatagttctgtatttttgatttctcttttcaaacttctgccttacttgacactccattacaatacaggaggatttagagattacatccatttcagtggcatgccagctgctcttcctctcttcttctgcacgtgctagtgctttaccactctaatattgaaaacttctgttataacaccctattccctgaataattgagaaaacccagtgtgatttgttcaccacttcagaatacacttgctaaatcattctcaatagtaatatgtagaatgctgcctctagttaagactggcttaacacatccctgcttgctaagataaattcaatgccctctccaagatttctgtgaattcccaaagattatatttttctagagcaaattcctagcttctatggaacattcatgtcctacttcgcatcttgctgaaacattcttagcacgccttcagtgtggatcacattccctttacctgagaatccctacctacaagtcccctacaccaaggtataagctagacttttactgaagatttgtgagctatggtgataactgagagatgaagacttattacatgtcaacaaatgacggactatttaaattggattttagacttcctagttcttaaaaaggaatgagtcatttatgacaaattggcatcttccatttccaccttgctgtttggagtccttctctcattttctctctccttaacttcattctgtccacaaattgcttcttaatttttatacaactgttttactatctctttcttagatcttctatccatctaaatagcttattgatttttctaaataaaaagcttctttcctcagagctgcgtcaagagatacaataataagtaatgccattagtgctcagaaagtagtagccaaaattttcacctaaaaatctaccacaacttttttcccgttcttactttaaagaaagtgaaaatatcacaaaacttcagcaaattggaatcatcatagtaaaacaaacaacaaaagaatccctcaaacccaaccccaaaaacagttttgttggtcccttctggagttgctcctcaggcattccctgcccaaggtgagacaaccagccacagagctcccacaacgggctactctttagcccctttcacctactgagaccttctatcttctcagctactctgccactaacacacttggactctccctcattgccaggcccctttcatatcaataacttgagtttggaccacatcctgagctctgatatgacactcccctgagggactgatccctcagcttgatggtcctctatcctattcaagtcactggtacggctgtggagatctcaggtctgagggcctgagtgtcggagtgggtgttcactagactggaactgttttggagtcttagttggtggtcatgcattgattaataagctatggtgaaggtaatcaatgctttctaccttagaagtagacagtaatagtcagagaaacactgaaatgcgcagttcactgaaagtaagcttgactttctgggaaaatgactagaaaaatttttagtttctattggctatgtgaaagttgtactttagaggatttaaatagagcagaatttatgagaccaagttgcaaatcagctctaaaacccaaagtcattttggttacataagacacatttttaggcttatgaaaattttacatgtcaggccatttcctaagtgagggctttatctctacaattaataaaatatataaatggaaacctgcagctggctgaattgtcctttctgttcacatcgtatttccatttatgcttagagccggaatttaacttaaaaaacacgctttgtacacctgataagcttctgctttattgtactcccctgggaaaagaatttcagatattcgtaacgaagagagcttcttttgctgtcagggccagctagacacaacctcagagaaggctttcctggaaaacacttctcagtcacctcttggacatggtagctgattaggcagtcattttaggcttctggctttggaagtgtcacagcccgctagcaccttccctgattcagggctgggggttaggcaaaggaataaaagtagatgagttgtcaaatcattctttcattttaatctagtcacatttccccagcctctgagcttcccaatgtacttcccaatacatacaccctcctgacacacacatacttctacacgcacaccacacacacactgcacaaccactttttcttcctcacatacatacaccttcacacaaatagacacactcctgtacctgatgactactagtggaattataagcatgctcttttagttctgatggctccagaataatctaaccttttgaatattttaacacagactaatgaacaccaatgtggtgggatatgcctgcttttgtagaaacccaaggtgttaggggctaagacaactcttctcagtcagaatggcaaccatttggtatcagtcttccccatcccttatcccatactcatgccagaatatttttctgatcatggtcttgagctatggagtctaggtttggcttcagaatcctccacacagagttccagccagccataatcataaggtagtaacttatgttccagctgaaacctgttaccacccctgtcctgaagtgttgcagtttggccctttgacaacactttcctttgtgctctatttttcctccccatttctcattcactctggaggtctgaaccaactcagattctcagcactccttctatcatcagacaagtggtgtttatgctctgggttctgtacttcaagaggccctcagctttggagtaccttccctaaagtgtctaaaaccccctttgattactgtgatgagccaggattggcagtgctacccaaatggggcatcctgagttggcacaaggaactgcatgggcccttgtccccatttctcccatgcagagtatcttgactctattttttgcttgggtcaaccaggtactctaagatgctcagagacccatgcctagagggatgtcccaaagtcaggccccagtaccaggagaatggtctggtaagcagaccaccctagctgtgctgtgttatttctttcatgcaaggttgggcctccacatagtcctgatatgccaattcttgccaactcaagaatttttgcttatatagacaaaaattccacaaaatatagtcttgctgcaatgttaacaccattagagttctacttatctttccttcctgccaatttctcaaaactcattaattttattgtacaaaagaaataatatacttgcaacattttcaaaattaaaatgtacttgtcctagttcctagtgccaataggacacaatgtcattgattgacctaacaagggggctgtctgagagacctaattttggtcaatgagatttaagagaaagcctacttaggggtttctaggaagcgtttcatagctcttaaaaaaagacataataggacagtgatgtaaggaagatagtggaataggaagatccatattttctttactcccatggaaacaccaatataagaacaatacatgaaccaattccttttatgagaaatcaagaagccagttaatagtttcctgcaccctgacaagcatagaataagctgcatcaaagataacaggaaaacttgtggcagtcttttgtcacagttcctttccctagcctagcaccagcaatatacaatcaggagaaaactccaagctattagcttctctgggtggagaaagagagaagactctgccttagtactatgctctgacattttgtgggactgttcaaggggttgacaccttcttttctgtcttggagcactgacaggacctagcaaaatccagatatttgggggtcactgggaataaaaaaagagttgtgcagggtgctaatgctcctgagggtctattatagagcatacagagcctgatacagcatgacgacctctcccttagcagaatagagaagaggagagtgtgcatccaacattccagcttttttttttaattatactttaagttctagggtacgtgtgcacaatgtgcaggtttgttacatatgtatgcatgtgccatgttggtgtgccgcacccattaacttgtcatttacattgggtatatctcctaatgctttccctccccccttccccaccccacaacaggccctggtgtgtgatgttccccttcccgtgtccaagtgttttcactgttcaattcccacctatgagtgagaacatgtgttgtttgtttttttgtacttgcgatagtttgctgagaatgatggtttccagcttcatccatgtccctacaaaggacatgaactcatcattttttatggctgcttaggattccatggtgtatatgtaccacattttcttaatccagtctatcattcatggacatttgggttggctccaagtctttgctattgtgaatagtgccacaataaacatacgtgtgcatgtgtctttatagcagcatgatttataatcctttgggtatatacccagtaatgggatggcagggtcaaatggtatttctagttctagatccttgaggaatcaccacactgacttccacaatggttgaactagtttacagtcccaccaacagtgtaaaagtgttcctatttctccacatcctctccagtcagcacctgttgtttcttgactttttaatgatcgtcattctaactggtgtgagatggtatctcattgtggttttgatttgcatttctctgatggccagtgatgatgagcattttttcatgtgtctattggctgcataaatgtcttcttttgagaagtgtctgttcatatccttcgcccacttgttggtggg

SEQ ID NO: 269 - DNA, 51993 bp, Homo sapiens
aacatctaattcagaatagtttcactcttttttcctattgtcctgcataaagcttccccctccccagtggacagactgcaatgggctggcatctgacatttgtctgcagacctcatggtaggagacaggctggttttctgccctgggagtgggagtgtaggaaaggaggaggcactggggacctgtatcccaggttttcagggcaaggctgtgtaagtatttccagcagactagtgtgaggcatgctaggaagcgagctgatgtggagccgagctaatcctgtctgatgtggccacctacaggcatcaacaggcctcagcagagagaagctgaagtgattactgcattcctatgagctgtgggaggaataaatcgtggaaagaaatcctcatttgcaactgtatggcattaggggtgaggggtctcggaagaagcacccaaggaggaggaatcccctgtaagcccctaccagtcccagagaatgcaaagccctcttgcaaaccgtgcctgctccacgccccagaccactccttcccccaacccttccccattctactcaaccttggagggttagaaaccaccattagcaagacaggagaagaaggatagatgcataatgttgaggacctgtttccccatttctcatcttcccatccttgcaaagcccttgctggaggaaaggagacttacctttggaactaaacgttgagtttctgaattggcattgtgtttggtaatataaaataactacaggacctaagagagatcagaacagtcttagtactgtccatattttcatcttggaatggggaaaactggctccactgagcaagttaaggacgtcatagactgatctgtagatgttcaatgaaatctgtaattcaagactaaataacgtattcttggctgggcacagtggctcacgcctgtaatcccagcactttgggaggccgaggaggcgggcggagggcagatcacccgagggcaggagtttgagatcagcctggccaaagtggtgaaaccccatctctattaaaaatacaaaaattagccaggcgtggtggtgtgcacctgtaatctcagccactcgggaggctgaggcaggagaatcacttgaacccacgagacagaggttacagtgagccaagatcatgccactgcactccagcctgggctacaagagcaagactccatctcaaggaaaaaaaactaattaataataataacttattcttgagacacatgcgatgcaagacaagtatttattgctaggatctcctcaggtaagctgtgcagtaagtctgtgctgtcctacatggtagccattagccacatgtagcaactgagcacatgaagtgtggctagtccaaatacaaatgtgctcttaagtgcaagacacacatgagatttcaaagacttagtacaaaaacagtaaaatatctcactaataatttttatgtttattacttgtcaaaatcacaatattttggatatgctgtgttaaataaaatttactattagaattaatttcacctgttgttttttacctttttgatgtgactactagaactttgtaaattacacggagctcgctttctgtggacatgtagtctctctcacagagaaatacatgtatatttctgctggacatgtagtctctctcacaggtcataaggcactgaggtcacaggccataggttgggatgtttctcctccagagagtagctcattctcactttaaatcatcctaaagaacacaggtactggtaggtaggtgggccgcaagctggattgagtggggaaacttcctgctgtctttgaaccagaacaagaacagagttgggagcctgtattttgcatagtgaaggcacactcaagggagccacctatcttggggagttatgctggcccccaaaactcagagcgtgctaaaggtgaggcagagaagcctcctgtagcaagtgcatacagggaggggcgtgggcctctgaaatctgaaagcaccatgtctcatttccagttttaagtgtacctggaattctcttctgttatccctaggtctttagtggagcctgattaaacatgaggctgagggcagctgtgggagctgagggtggattctgtgcccactcgtggcccccccactggccatggcttcctccccagcaggcctcgacagcagtctctggagcctctggcccagcttgctgcgggtcgctgctgttctctttgtgtctcttagcctgtgacttcaatgcagtcatctcatttctgggaatctatccaattctcaattgtgtaaaaagctttataaacaaaaaaagtgcattacagtttactatcttaacaaaatattggaagcagcagaaacatttagcagtaaaaactataaattatagactatgtactttgtgcatcattgggaagccacttaagtgacttttattaaaacttatattaacaaagaagacaatagtgtcataataatttatttaaaaagaattaaaggccaggcacagtggctcatgctgtaatcccagcactttgggaggccgaggctggcggatcacttgaggtcatggcaaaaccccatctctactaaaaatacaaaaattagccaggcgtggttggtgggtgcctgtaattccagctacttgggaggctgaggcacgagaatctcttgaacccggcaggcagaggttgcagtgaacagagatcacgccactttactccatcctgggtgacagaactagactgtctcaaaaataaataaataaataaatataaggaattaaggaacacacaattatatatgcaattggtgacaataaaatacaacccctcaaaaagaacaaaaacaaaaacctaaacaacaacaaccacctaggtataaagaaaagactagaaaaaaatgttttaaaatgaaaccataactgtattagggttctccagagaaacagaactaaaacctctctctctctgtctctctctctctctcatatagatgagaagacacactcaaaggagctcatataggtgagagagagattttaaggaattggctcacacgattgtggagattggcaagtccaaaatttgcagggaaaactggcaggcttggagacaaaagttaatgtcacagttcaggcctaagggcaacctggaggcagaattccctcttccttgggggatgtcagacccactcacatacgggagggtaatttgctttattcaaagtccatccatttaaatgttgatttcatctacaaaataccttagtagaaacatctagaataatgtttgaccaaatatttgggtaccatggcttaagcatactgacacatgaaattaacctttggctgggcacagcagctcatccctgtaatctcagcactttgggaggtttagatgggtggattgcttgagcccaggagttcaagaccagcctggggaatatagtgagactctgtccctacaaaaaacaacgagaaaaaattagctaggcatggtggcgagtgcctgtggtcccagctgctcgggaggctgaggtgggaggatctcttgagcctgagaagttgaggctgcagtgagccgtgattgtgccactgcactccagcccgagtgacagagtaagaccatgcctcaaaaaattaattaattcattaaatttaataaatatttttaaaaattaactttcacaatgatctaaggcttactactttaggatttgcttttgaaatacttttctgtgttttccaaaatacataaaataataaagatgtacttatgatggaaaaggcctgtgtaaacacattttaaaacacagcctccttggggtagccccagagtcccagggctctccatggccccttggacacctttcacagcattcctcacctctgtcttctaccattattatgcatgtctgaatatgtcttcctttgctaaacatcaaacagagttttaggactgggattctagaaagtgagagaaggcaggcgcagaggaggcagtgggagcctgcctgagggcattaacgtcagtcctgggctatgtgctggctcctcaggaccgcccttctgaggggcacagacacgtgagtggagggagctcatgttccagtttctttgcaaaaatcaacttgataaagtttttcctgttttgttaaaattgcctaaaattttttagcaatacttcatttgattttctctaatggtttctgtcatttctttgagttttaatttattgctcatgctttaacatcccagtttatgtcttgcttaatttaatgtccatatagttgacccttgagcaacatggatttgaactgcataggtccacttaggtccacttatgcatgggttattttcaatcaaatgcagatcacaaacacagtaatggtgacatgtgaaacccatgtatacaaaggcccaactttacatatatttgggacccaaagggctgactgtgggacttgaatatgtgtaggttttggtatacacaggagtcttggaaccaatccccctcatataccaagggactactgtatatctgctttgtttatttcttttttttttttttgaggtggagtctcactctgttgtccaggctggagtgcagtggcgccatctcggctcactgcaacctccggctcccgggttcaagtgattctcctgcctcagactctcaagcatctgggactccagtcacccgccacgcccagctaattttttgtatttttagtagagacggggattcaccatgtcggccaggttgatctccaactcctgacctcaagtgatccgccagcctcagcctcccaaagtgctgggattacagtcgtgagccacggtggccagtctcattaccatttgttaagaactcatttgggcgggcaacaggtatacatcgcctcatgaaaactgagtcactcagcctgtgctcccacctggacagaacaccatgcagcctctgcttagagatgctccacaggagccagtgtggaaacaccagggccaggcatcctttagaaaaccattttgggattgctccagctcatgaaccagcagttaactgagtcaccagccatatcataaagcatgactacaactacgcaggcctggtccctaaccccatgttgttacagcaaaatataacccattcttatttcagaaaaagaaaaaaagctagatgtgatggcacatgcctgtagtcctggctacttggggggctgagtcagaggatcagttgagcccaggagttcaaggtcacagtcagctgattgtaccactgcaccccagcctgggcaacagagggagaccatctctaaataaaataagacaaaaacaacaacaaaaaaaaaacagaagaagaaaatataccaaaatgttaacaatgtcttctatctttatttattggggttagaaattacttttgttttcttatattatgtatattttatttcaaacctgataatttttttttcctttttgagacaggatctcgctctgttgcccagggtggagggcagtggtgcgatctcggctcattgcagcctcagcctcccaggctcaggcaatcctcccacctcagctccctgagtagctggggctacaagaacacgccaccatgcctggctaattttgttcgctttttgtagagatggagatctcactacgttgtccaggctggttgcaaactcctggactcaagccctcctgcctcggcctcccaaagtgctgggattacaggcgtgagccaccatgtccagccaatgttatttaatttatttatttttatttatttatttttttgagacagggtctcattctgttgtccagactagagtgcagtggtgcaatcatggcttatcgcaacctcaacttccctgggctgaggtgatcctcctaccttagcctcccaagcagctgggactacaggtgtgagccaccacacctggctaatttttgtattttttgtagagatgggggtcttactatgttgctcaggctggtcttgaactcctggactcaagttatcctcccacctcggtgtcccaaagtgctggtattacagatgtgagccaccatgtccagccttatttttaaaagaaggagaaaattattgagcaagagagtctctctgcagttcttaagattgctgtcagaaccacctcaatactctttctgcagtctgtgctttgagcagcaatataaaaatgcagcattttatgagcattaatagcagggaatgtaaattagcctatttgttttggctctgctttgcttctgatcattagaggccagcaaaaatagaatgagaactgcaaactccctcttgttcccggaagatctctccacagcatggcatatcagtcagatttctgggctgtctcatctccgtctccgtaagaaaggatcttgttggaaatacattgaggcatacactgaagcagaggccccagtgccacctgggcagaggcaagccagagaaaacagagggaaatgaaaagaaagacttcctggtattcacttctacatactgccagctaagctgcgctgggtacccagagcccacccaccacatctacaccacaaattcaactgggacttcgggctttttttttttttttttgagtctgagtttcgctcttggttcccaggctggagtacagtggcaggatcttggctcaccacaacctccgcctcctgggttcaagtgattctcctgcctcagccttcctgagtagctgggattacaggcatgcaccactacggctggctaagttttttgtttttttttttttagtatagacggggtttctccatgttggttaggctggtcttgaactcctaacctcagatgatccgcccaccttggcctcccaaagtgctgggattacaggcctgagccactgtgcctggccgggccttcaggctttatgtagctgattgaacacaaccatctctgctcccagcagaaatcccaccaaaatgtgataaaggggttttaaaaggcaaggactgacaagaacaaaaggcggggggagaggagagagagagagagagagagagaaactgactacacaatctaaataaatagagaataatgatctggataacaaatagacaaaggtcttagcagataagagaaatttaaaggtaaaatgtcagtgggagaatcccagaagcaggctgatttcacatagcagaaccccagtaaggaatggagaaaccaagtatcccaaacgtgagtgtgcaagaggcctggaaccagaggctgatggtctatgtaagaagccactagaaccctagatctcctaactcaacgcacatggcagagtgaccccctatattccaccctaatgagtggtttgctcgctggaggcgttgaaccatgccacatcctgggaaccacaatgaaaatcatttaaggctgggcgtgatagctcatgcttataatcctagcactttgggaggccaaggcaggaggatcacttgagtccaggaattcaagaccagcctaggcaacagagcaagatccccagctctaccaaaaaaaaaaaaattacatatatatatatatagcctatggccttctggctttatgtggccagaagaaaacaaaataaaataatttaaaaaatagaaaataagtaataataaaagaaataaaataagagaagcaataaaagaaaagaaaaagtcatttaggattatgtaaaagcctgcctatcgaacagtaaggcttcctggtcccctccatgaagttggttctgagaactccagcagccagacttgccccaggccgattaatagagaaaccttctctggagaaactgaccagacaaggaaaaacacctaggaacacaggagtaagggggttctgacggatattaagctactgtcacttgacttcaaaaccctcttccactctctccttcccagctggctccctcttaggtgtagagggaggtgtcagcactggaggaagaagggatcccttcccttgttggcctcccaatcctgccggcatcaccacagccgaggatcttcagccctgtagcaacagctggtccagcagcagtagcaagtcccaaactgtggttcttcctcactcccggcaaaggcctcttcccgtggcctcagtgataccggctcactggccaggctcctccttaggaaactgaattctagctccgtggggccatcctcccagattctcccattgaataatactgacctcttccctcagttccccaagactgagggagaggcagttgccccattcctgattcccacgcgttctacctctgcggtatctcagtgctctttttgtctttttagatctcaatatgtggttaacaatcctttatataaaattacctctgtctgggcgcggaggctcacgcttgcaatcccagcactttgggaggccgaggcaggtggatcacctgaggtcaggagtttgagaccagcctggccaatatggtgaaaccctgtctctactaaaaatacaaaacttagctgggtgtggtggcaggtgcctgtaatcccactacttgggaggctgaggcaggagaatcatttgaacccgggagaccgaggttgcagtgagccgagattgtgccactgcactccagcctgggcaacagagtgaaattccttttcaaatagaataaaataaaacaaaattacctctgtttaaatatttggatttttttctttcacctgactagaccctaatacaagggtcttctggagaaacagttcagcccatttgcactatggtgaagcccactgaaacctccccccatccccaacacacacacctggagtttccaaacagcttaagatctaactaagccaaggattactgtatcattcacaaagcccaagccccaatttgagcagagaaagtttattattagaaagaattattggctgtaacaggctaaaaagacgtgcagagaactccaaagaatgctgtagggccgcgggagagtacccaaagaaggacacacgtggaagcatccccaccccaaagctggattcagaactcaaggcagaaagtgtgcatgtgcccaccaggtaccagattatttccctgggatgcccaggccaaagcctgtgaacagtcatgagcaagcaggaaactgggggggtcgcggcatcgggagcccactcactgcatgcaaggcctggggcatgcagggtccacgtcagggccagctcgctgggggaacgcatgctgtcagcacgcagctaggacagagaccaccggatgttcccacctggccactgatgggccctgccgcaggagcaacaagaatcacaaaccatagctcccggaaccagagataaaagaaattctttcctctggcagtgtccctccggcgccctctactgagaaagcttaatattgtgctggctgcgaaggagaaccgcttaattcaatacagatcagttaagaggatggatttacggttgagaggcaatacattgataagaaactagtcattatgggatgaaaaccactgacatgaaagacaggtattgaaaacacaagaattaaggaatataaagccaggcgcggtggctcacgcctgtaatctcagtgccttcgcaagccaagctgggcggatcgcttgagcccaagagttcaagaacagcctgagcaaaatggcgagattctgtgtctacaaaaagtacaaaaattagccgggcgcggtggcgtgcacctgtagtctcagctgctcaggaggctgagatgggaggatcacttgagtccgggaggtcgaggcttcattgagctgtgattaagccattgccctggaccacaacagagagaccctgtcaaaaaaaaaaaaaaaaaaaaaagaagaagaagaagaagaggaaatttagagaatgcaaagagccaaataataaaatccactgcaattaatattttcataaacataagagacgatattttctccatggtaaaagaacacattattaaataaaaaatttaaagttgaagaaatcttctaaaaagaagcaaagggtaaagaaatgtagatgggaccgggcacagtagctcaggcctgtaatcccagcactttgagttgcggaagtgggtggatcacttgagattaggagttcgagaccagccttaccaacatagtgaaaccccgtctctactaaaaatacaaaaattagccaggcgtggtggcatacgcctgtaatcccagctacttgggaggctaaggcaggagaatcgcttgaacccgagagaggtggagattggagtgagccgagatagtgccactacactccaacctgggtgactccatctcaaaagaaaaaaaaaaaggaaaagaaatgtagatggtatagaaaatatatgaaaattagatcatctggatgaataggaggatttctagaaagaatagacagagggaacagaagggatgaaattatcaaagaaataattcaagaacttttctcagaactgagagatatggttccaaagtgagatagacctcaagtgtctaacagaagtgtctaacaaaaggaatgaaatccaaggcatactaccataattttaaaaatactgaggacaaaaagaaaaatcccaaaattggacaaaaagaaaaaaacaggtcacatgaaaaagatcaaaactcaaatggtatagggttttctctttttttctttctcttttcctttttttttttttttttttttgagacaggatctcactctgtcacccaggctggagcgtagtgatacaatcatggatcactgcagccttgaactcctgggctcaagggatcgtcccctctcagccttctgaaaactacagacacgtaccaccatgcccagctaatttttaaatttaattttattttttgtagagacgaaatcttactacgttgcccaggctggtcttgaactcctgggctcaagcaatcctcccactttggcttcccaaagtgctggtattacaggtgcgcaccataacacctagctgaggacttttcaacagtagcactggaagctggaagatagtggagcagtgctttcctaatttaggtgtaaattttacaacttggaattttattttcagtaaaactattaatcagatgtaatcataatataaaagacattttcagacaaaatttcaaaaattgccctcccttgcccctttccttaggaagttccatcaaagtaagggattagatcaggagagataaagatgtgggatcctccaaagagtgaggagaatgaaaatcccaggaggttgctgtgtaggagaactagggatccgcaggtccagattaaaatggtttggaggccgggcatggtggctcctgcttgtaatcccagcactttgtgaagccaaggcgggtggatcacctgaggctaggagtttgagaccagcccggccaacatagtgaaaccccgtctctaccaaaaacacacaaaagaattagctgggcatggtggcacatgcctgtaattccaactactcaagaggcggaggcagagaatttcttgaacccagaaggcagaagttgcagtgagccaagatttcaccactgcacttctgcctgggtgacagagtggatctcaaaaagaaaaaagaaaaaaaaaaaaggcttggggccaaaacctcagggattaagaaaattcctttacctggttacagaaagatattaccaagaaaaagagggaattgattaattgtaatacattagactgcagagaaaaaatagacttctatagaatctgctgacaaatttgtgataaattcatagacaaatgatcaaaagaaaacctagtagatctgtataattctggatatcattccataaagcccagcttagaacctgtgccctcagcccttataaagatttcaaaagctcttaataccctttgtaaaatgtcttcctgttaatttacctagcgtaatctctagttgctgcactgaaccctgactgatataacttgttattaagaaacaggaagataaaaactaattgagcatcgaagtgcttttacttctaggaagagagaattaggggttggtaccggactatagcttttgttctgtctttggctttttaaattacatatctgtaatttatatacacacacatatatatttggcttttaaaattacatatctgtataaatctgataaaaattttaaatagttaaataaaaacttatttaggagataatatattagaatactaagatgagtgctgagtttaaaaaacaaaaaggccaggagcggtggctcacacctgtaatcccagcattttgggaggccaaggtgggtggatcacctgaggtcaggagtttgagaccagcctgaccaacatggtgaaaccctgtctctactaaaaatacaaaaaaatcagctggggatggtggcaggtgcctgggtaacagagtgagactccgtctaaaaatgaaagtggcatctgatacagagaagattagcatggcccctgctcaaggatgacacacaaatttgtgaagggttccatttaaaaaaaaaaaaaagtctgagcgaggtggctcagtcctgtaatcccagcacttcgggaggccaaggcgggaggatcacttgaggtcaggggttcaagtccagcctggccaacatggcgaaactccgtctgtactaaagtacagaaaaattagctgggcatggtggtgcatgcctgtagtcccagccccagctactccggaggctgaggcagcagaattgcttgaactcaggaggcggaggttgcagtgagctgagatcatgccattgcactccagcctgggcaagaagagcaaaattccatctcaaaaaaaaaaaaagggcatctgaatatatacaattacaatgtcaataaaaatagataaatgaataaatacagttagtctttttttttttaatggcatctggacattcctacattctggaagatttacaaatacatagtggggatacctctcataaatgtataagcctctcagtttttccttccaatgcattgcagattgtccttatttagccctttcccctgggaacctgagactgagagcagtgcaagctatgctttttttgtaaacacagcacctcacatttctagaagacaaccctaagtaaacttcagggccctacgtcggtcaccattccatctgctcttctctgctctgattcttcctatccctcagaaacccaaggcctccttagccaaacggagctgctgtggtcgcaaatagccttgtgcccctgggaacctgtgagatgcaatatgtcgtcagtctccctcaatcttggcctgagtccaagagaaaggcagctgctctgaggttcgagactctccagtgactcagctctctaattcccagtactctgtgcatatgccctcctcaattccatctcctagacttgccagatgtaggtcgagtcctcaaagatgagataaccaagatgcaaaatcctaaaatcctccattaagcacctaccagctgcagaggccctgctggggccctgagggagatgtgtgtggcagactgcaggccaagtaagtccttctttaaggctggtgtcatgagaattactcaatgccgcctcctgctggggaaggacacttcaccccttttatggaagcccaacgggaaggactcatgggacagggcaggctgccctgtctcttttttaggcagtcactgcaatcacacatgctcactaatccagttcactaaggtacgaagccacaataaagtttggagccaaaactgtagatataaagagagttcctttatctggaatggcctcgatttttgaataaggagttttttgttgttgttttgttttgttttgttttgtttttgagacagagtttcactcttttgcccaggccggagtgaagtggcaagatctctgctcactgcagcctccgcctcccgggttcaagcaattctcctgcctcagcctcctgagtagctgggattacaggcgcctgccaccacgcctggctaatttttgtacttttagtagagatggggtttcgccatgatggctaggctggtctcgaactcctgccctcacgtgatccgccggcctcggcctcccaaaatgctgggattacagacgtgagccaccaagcccatccataaggttatattttttaatgtcctgcctcctcctctttttttttcttctctttttgttttcaaataactaaagatgcacagaaagttgcaaaattagtaccgagatgtcctgtgcactcttcacgcagcttccccagtggtaagctcttacatactacagtacattatcagaacaagcaattgatgcatattttctcaatgcattgcagtaggtggatttggtacttgagaccctcaacaatctctttccgcatatcatgactaacagtataggctcatggtttttaaaggactgccctttgaaggaactggatggaattttgtttgcaaagagctgagaatcactggagaggcaataaatggaaatgttcctgtagattgtcactatagagagcagggctgatggatgtcaaaggatatccagggatataagccctcagcagggaggagagcaaaaaggccagtgtggttggttattggagaagttatttggatagtttttaattagagacatctcttgcatgaatggatttcctaatgaaatcaaattttgattgtggaaagcataattaacatgtaggaaacatcagtatattctaggacctgagagtaaaggatgaagtcccttttagagagatacactgttctcttttaggaagatgggcatagaagtgcaggaagtcaactagacgtgttaaaatataaatttttggctgcttgtaacagagacacaaatgccactggtttaaattaggtagaaaatgttttcccacccttggatccaagcacatgaggaccctgcccgggctccatgatctagagggacctgctctatcattcccccaacttataggacaaaaagtccgagaagccaaagggatagacctacccatggaggttgcatctcttctacaagtactacagtctaggtacttggaacccctgaattcctggcactaatggcccccaagcctgcttccaagtttgcatgggcctcctcctggggccatcgtcccaggggttatgcctcgctgctgtcgtgcatgctctgagaccccaaaatgtggctgttttcagagaaggatatgggtctggagattttagggacttgaattttcaggaaaagaaagtagggcagatgcaggtagaggacccagagctagttttcctcactcagccatattctgccatggaacctaggggagtctcagaattctaaattccagcctggctgtcctagcctggattccccagaaaacagattctcagatagatttatctgcagaagttttattggggaacaatcttgggacaaacacctttaaaagctgagagaaacgggacagggaaagggagcagttgaactgtaatgaagccgtaaagagtactgagctgatctcatgggttgtggaggcctctggcactggaaaagtcctttaaatttggccaaactcggccgggcgcggtgactcacgcctgtaatcccagcactttgggaggccgagtgggggaggattatctgaggtcagcagttcaagaccagcctagttaacatggtgaaaccccgtttctactaaaaatacaaaaaattagccgggcatggtggcatgcgcctgtaatcccagctactcaggaggctgaggctggagaatcacttgaacccaggaggcggaggttgcagtgagcagagattgtgccattgcactccagctcgggcaacaagagcgaaagtccatctcaaacaaacaaacaaacaaacaaacaaaaaggtggccaaacttgaagcaaggtaaccaggactttgtatgttcttatcttatctatcagtcattggatgtggctgcccccagggaggggaggtgtaaccttgggcaagacagctcttttcagctaagggcaattcccagagacagagctgtcacaaccaacacccctggcagctggggaataagtgacaatgttgaaggtaggatttgggtggcacacaacagtatctgctacactagccttcaagatcagtatgaaggtatatttatcaagacaaaagctggaacatgttttattcaataatttatttgtttgacttataacaataaaccatctctaacacacatttcccttcctgatatcagacagctgctctgagggatacccgagacccacattcaggaagtaagatagatatcagcctggactgctgaatagatgccctgtgatttatcttcagacatgactcagtggaaatgcagttgactccattctaaaacctctcttgagaatatttccaggcccagtcaacttatcttggtctcactataaggaaaggaactgagatcagctgcaccctgagaggctaagatcctgatagggagcaggtgaaatcaggttggaaaatagacaagacaaaggcaggcagatgtaagaggtattcaaaagcccagttgtgctctatttttgccttccacgaggaatcttacggggagcttccacattacccggttattggtcacggcggtgagttaaggctgttttattgaatgaaatcatcaacccccctccttttcctgctaaaacgcaatctgtttccaagactttcctaatgtagagtgattttattgagcctagaccatggatttcccatctgataactctttaagagggatgagatagaacataatgtgagaaaataacattgttccaagatttgtaaatgctaataattgttgaagtcccatggtaggtaaatagaggtattttctttatttttgtgtaagtttgaaaatttccataataaaaagtgttataaattgtcttagcaggtcacataactaataataaaggtaaaatttttgttggtcttaatgagagagaatttggaaagtggagataagcggggctttggagctcctaaactattcgggctgtgttttgactcagcgagctcaaagtgggagggcaggagagctcgctttttaaaagatcgacagcgccatctaccggtaagagcgcccaactcccttgctaaggatgatatcattatgctagggtgatagtagcaagcctcattgttagtcacctaagaagttaagacaataagaaatcattcaaaaaataaaatggtggcaggacgaggtggctcacgcctgtaatcccagcattttgggaggccgagaggggaggatcgcttgagcccaggagtttgagaccagcctgggcaacatagtgaggtccaaatcgctaccaaaaaaaaaaaaaaaaaaagagaaaaaaaaaagaaaggcgttaaaattaatttaaagatacacaataatgaaaatattacaaagtactattattcagccataaaaaagaaattacattctatttatttattttattttattttattttgcagacagagtcttgctctgtcacccaggctggagcgcagtggcgcaatcttggctcactgcaacgtccgcctccccggttcaagggtttctcctgtctcagcctcctgagtagctgggattacaggcacgcgccatcacgcccagctaatttttgtattttttttagtagagacggggtttcaccatgctggccaggcgggtctccaactcctgacctcaggtgatctgccagcctcggcctcccaaagtgctgggattacaggcatgagccaccgcgcccagcagaaattacattctgatacatgctacaacatggatgaacattgaaaaaattatgtaaaatgaaataagccagacacaaaaggacaaatattgtatgatttcacttacgttagatatttaaaatggggaaatctggtttgccagcacagcaggaaaaaaaataaataaaagtaaaatacaaaaatcatagaggtgaaaagtcaatttggccaggtgccgtggctcatgcctgtaatcccagcactctgagaggctgaggcaggagaactgtttgaggccaagagttcgagaccaacctgggcaacatggtgagacacccacccccaccacctctaaaaaaaaaaaaagaaaagaaaataagtcgattagaggttaccaggggctgggcggaaaggagaatggggagttattgcttaatgggtaatgagtttctgtttggagtaatgaaaaaaatttggaaacagatagtggttgacagctgcacaacaacgtcaaatgtaattaatgccaatgaattatacatttaaaatggttaggctgggtgcagtggctcaggcctgtaatcccagcactttgggaggccgaggtgggaggatcacctgaggtcaggagttcaagaccagcctggccaacatggtgaaaccccatctgtactaaaaatacaaaaattagccaggcatagtggcaggcacctgtaatcccagctactcaggagtctgaggcaggagaattgcttgaacctaggaggtggaggttgcagtgagccgagatcgtgccactgtactcaagcgtgggcaacagaacgagactccgtcttgagaaaataaaataaaataaaataaaataaaatggttaaatgggaaatcttaccttatatacattttcatatatataacatacacacacacacacacacacacacatatatatacacacacaccacacacacatacaagtatgagccaccacacctggctaaattgacttttcacctctatgattttcctattttatttttatttatttttttccctgctgtgctgacaaaccagatttccccattttaaatatctgatgtaagtgaaatcatgcaatatttgtccttttgtttctggctcatttcattttgcataattttttttcaatattcatccatgttgtagcatgtatcagaatgtaattcctcgtttatagctgaattatatatatgtttatttttaccacagtaaaagaaattttaggccaggcatggtggctcatgcctataatcccagcactttgggaggccaaggcaggtggatcacttgagctcaggagtttgagaccaacctgggcaacatggcgaaaccctgtctgtactaaaaatacaaaaattagccgggcgtgttggtgcacgtatccatttcagctacttgggaggctgaggtgggaggatagtttgagccagcgaagtccaggctgcagtgagctgtgattgtgccactgcactccagcctgggtgatagagccagaccttgtctcataataataataataatgattaattaatttaattaattatttttttaaattttttattttttgaggcgcagtttcagtcttgttgcccaggctggagtacaatggcatgatctcggctcaccacaacctccgcctcccaggttcaagtggttgtcctgcctcagcctccctagtagctggtattacaggcatgtgtcaccacacccggctaatttttgtatttttagtagagacagggtttctccaggttggtcaggctggtctcgaactcctgacctctggtgatctgcccacctcggcctcccaaagtgctgggattacaggtgtgagccactgcacctggctaaaaaaagaaatttgtaatgaaattgacttcaaaataatttaaaagttaagaaaaaaaccacattacacaaatatgatataaacttaaaagaatgacataaaaaaaaacacacaagagcaaaaaaggacgcaatgaaatatggaaactagtgaatggaaacagtgaaatgacaaaataactaaataaactagtagcaagatacctgaaaggaaaagttgactgccaatcaaaatacgttgctgggtgaccaagaaatcaaagttaagagaggtagatattttaggagtatttcatccaggtcatagtaaaacccagtccaggaataaaacattgtatgtatctataccagccttgttttaaacaaaatctaaaatagcttaaacacaatacaacagaattaaaaattacaactaaggctgagcctggtggtgcctgcctgtaaccccacctactctggaggctgaggcaggaggattgcttgaggccaggagtttgagactgcccagcctggacaacatagccagatctcatctctaaaaaagcaataaaatgaattagccaggctgttggggcacatgcctatagtcctagctacttcctcagaaggctgaggctggaggatcacttgagcccaggagtttgaagctgcagtgagctatgagtgagaccccaaaatctctaagaaaaagaaagaaaaatacgaaggcaagtaaagagttagaaaaatcagataaaaccagtaagattagtataaacatcatgctgtgctgggggtgggggtcgcaggtttggaactgagctctctagaagccaattcaaagagggaaacacaatcatcacatggcttccagtgtccaaagtctcagaagtagtgagacagccaggtgggaggggttccctggagaaatgccaaccagcctgcccactgaggtggagcctcaggaagtttgtgccctttgcagcggggagcagcctggcccctcttcttagtgtgtggatcctgggatttgaatggcgggtgggaagcgctctagtagggactctggcctagcgacagtccctgtttctccgttttcttccttttcatccaataaaacccatctcattcaccattcagattgtctgcgagcctgaattttcgtggctgtgggacaaagaacccgtctttagctgaactaaggaaaagtcccgcaatagtaacacaactaatcctttccctgagaccaggaagcagttttcttctggtctcccttgaccagaaggggtgtgataaagtgaacaacgtctcaaccacaccactaccataaatacaagttttcataggatttattcatttcttcggtgttcctgttacagctggtggcaccatgttccggcagaatcagtcagatcagtgcagtcccatgctgtgtgtccgtgccactggtctggcttaattcagggatgaattctagtgtacatgaaacagacggcacacatattcttccatcaaactgacagaagaagtctctctccacccatcttttgatatgtagagcatgactgtgagttcagtgttattatacacttgatgtcacagccattttgaagctgctgattaaaagtaggttatggctgggcgtggtggctcatgcctgcaatctcttagggaggctgaggtgggagaatcacttgagcccaggagatcagcctgggtaacataccagaccctgtctctattaaagaaaattaagaaaataaaattaaaataggttacaacagaatactcatggccagaacatacctgtcttcatgttcccctgcagggaacaatgactaaacagctcatgattcttgtcccttgagccccgcttttctagattccataaaggccaccctcttctgcatccacattctttcttcagttggcgcctagtaccatggatttgatttttgcttccttaggtctagtctttatccatgcatacttccccttggctccctttgattggatttatttactccccaatttccttagcaccatctacagtgtcttttccagttagtgcctctcattcactgtgcacagactccccacaactttcattcgtaggtgattaactttcatgtaatgtcctaggaaaccctttactagctgtgtgactttaggcaaattacttaacctctctgagccatattttcatcatttataaagctcataatgcctaccttggaaggatgtttggaattaaagtaagttagaggctgggtgcagtggctcacacctgtaatcctagcacttttggaggccaaggtggtcagatcacctgagatcaggagttctagaccagcctggtcaacatggtgagacccccgtctcttctaaaaatacaaaaattaggctgggcacggtggcttacacctgtaatcccaacattttgggaggctgaggtgggctgatcacctgaagtcaggagttcaagaccagcctggccagcatggtgaaaccccatctctaccaaaaatacaaaaattagttgggcatgatggcgggtgcctgtaatcccagctatgcaggagtctgaggcaggagaatcgcttgaacttgggaggcgtatgttgcagtgagccgagatcgcaccactgcactctagactaggtgacagagcgagtctcaaaaaaaaaaaaaaaaaaaaaattagccgggggcgtattcccagctactcaggaggctaaggcaggagaatcctttgaagccagcaggtggaggttgcagtcagccaagatcgtgccactgcactccagcctgggggacagagtgacactctgtcactcaaaaaataacataaaataaattataataataatggtaacaacagcaaattgttattgagttcttatcgtgccagacacgatgctaagaatttcgtatacaaatatttggttgagtcatctcaacaagcctatcacatgggaactctgactatccccactttacagataaggaagatgaggcttagagagcttagtgctgggcccattagttacagtagttataattattcaatgtccttcaatgtcatgagaaagtcaccatcagcctgggagttcagtgggagggtcaggaaagacttgaacaatgagttgtttgcagatgaatgggcttttgtgtttgttttgtttttattataaacccagtactatacaggtctttgtaaaagtacaaagtacaaagttgaaaagtcctgaaaagcttctaccaccaaggaataaccgccgaaataatatctcatcagaactttctccatgaatacactttttaaaaattatcaccagcagtttcatggaacacgaatactctgtttaaaaaagagataagcttttatgtctatattactttattttttctgagtactattttttcccctgattttcaccgaaagggttgctctctatgttgttgtttcagcccttccagtagtttaaaacatgcatctttagttctagtctaattcatgatttcccttacatctatttaaagttataattttatttaacatcaaaggttattcagtagctttagtctttcccctgaaccaaacacatttatttatttatttatttatttatttatttttggaattggagtctcactctgtcacccaggctggagtgcagtagtgcgatctcagctcactgcaacctctgcctctggggttcaagtgattctcgtgcctcagctttccgagtagctaggattacagttgcccgccactacgcccagctaatttttatatttttagtagagatggggttttgccatattgaccaggctggtcttgaattcctgatctcaagtgatccgcccgcctcggcctcccaaagtgctgggattacagccatgagccactgcgtctggccaccaaatacattttaacttctttcctctttccattcctcttactgtacccttctaggattccctgggttttgttaaaagcttctggaactggaatgtagcaaatgaatgttccatttaacaggcagagaaagaggaggtgggcaaatcacagaaccaaagtgcagagtggtgaagagctccagttgcatgcagggtggggtggctgccagggccctggtgccttcagtcattagttctgcaaatgttcatgagttccaccagtggtgtctgcccagcagagagcaggagcaggggtgagggtgaggacaagagacagacagagcctggaggggcagtcagctgcacaggaacgaccttctgtgcaagctgcaggctctgcacccagccagtacctgagcagggtagaggtctgatgaactgacttataggatgggctggaggacgcagagcctgtgggtatgaggccagttaggagagtgctgtcaccacccaggcaggaggccatgaacatccccatatgagaaagaagggcataaacaggaaacaaatttaacaattaaataaaagcacctccctcatgcaggaaactcgccctgtgccaggccctgcagaaccatctgcagagtcatttcctctcttggcaacttggcagcccctagcaaacacaatgcatcttggcttgccatcagtgcaacccttgttcttcagatacaggtaaaatgccaaatccctaagaaggcctagaaggctctgcagtgtcagcaccagcacccccaccccttggcccctctctgtggtcactttcttgggtcctgcagatgctccaggctccactcaaattctattggattaaggctcaccctaatgacctcattttaacttgatgacctctataaagaccctatttcctaatcagatcacattctgaggtaccagggattaagatttcagcgtatcttttgggggtgggggacacatggtcacatcctgaatgactatagctcaaacaggtctttgttaggtgaaaataacaggtggaaaaatcactgagcacttcaccttatctcaaacttatgacttcaaaatctctacagtggactggtttcccagctgacctcaccttacgtggagtgttgcccaattcacactctccagccttccccacactgactttaacttccacatattccttcacttcattcctgcataaacctgggtatggtcccttcattgtctctcagtgatgtggaaagttttcatgatgagtctaccctgctctctctaatgcaagtaggatacaacaaacagcatgttaagttagcaaatttgacattaacgtctatcttaaaaagtggccaactatgggccaggcacagtggatcacacttgtaatcccagcattttgggaggctgagatgggcagatggcttcagcccaggagtttgagaccagcctgggcaacatggtgaaaccctgtctctatttaaaaaaaaaaaaaaaaaaattagccaggcatggtggtgcacttgtagtcctagctacttgggaggctgaggtgggaggattgcttgagcctgggaggttgaggttgcactaagccaagatggcaccactgcactccagcctggcaacacagcaagactctgtctcaaactaacaaacaaacaaacaaaaaagtggccaacagaggaggtagtagttttgtcactagctgtcatgtggaaccccaggacctagcctttggtttcaaatactgtttttcatttatagaaactaggaccccttagaatgcaaggcttaggtgacaactgattccatgtctcagagaaggaaagaatcaggacaggacttgaatgttctgttgttgccatagagcaaggatgacttcaagaatgtgaaggacaggctgggcacgtggctcatgcctgtaatcccagcactttgggaggccaagacggacagatcacttgagcagaggggttcaagaccagcctgggcaacgtggcgaaaccccatctctacaaaaaatacaaaaagtagctgggcatggtgatgcatgcctgtagtcccagctatgtgggaggctgaaatgggaggatcatctgatgctgggaaggtcaagactgcagtgagctgtgactgtgccactccaatctgggcaacagtgagaccctgtcgcaaaaaagaaagaaaagaaagaaagagagagagagagaaggaaggaaggaaagaaggaaggaaggagggaaggaaggaaggaaagtaagtcaaggacagtgcttaaaaagacaaaggagccaatttcaaagagctcccattgttcaagttgacagtcgggcatgaaagaaagaagatgggaggaggaatgataattatggttaattgaagtaaattgaatctgtggcaggccatgaaatcacgataataacagataaaaattcacataaagggcacaaaagatgactgtaatagagaagaattgagttttaaaattttattttaataaaaagggaactattcattttgtctcttctattaattatgtgtctgtttataaagcaaagataggtgcttgcttttgtctgtgtaagcagaaaacccacagagaatgctgagaaagccaagtagccctgttatagtaggcagctagtcaggcacgagcagagcaggagagggcttcctaccacacacacccaccaggaatgccaggcgagcatcaggtgatggccaggcggttattaactgtttctctaaaataataactggtagcagctggcgccagggacaggcagatcccaatagatagaaaaaacctgaaactggtgatcagcagcttcctgataagatctcaggagttgggcgagtggactcaagcatgctcactaagaggcaaaactgtggagtttaactggtgtatgtccttcctctacgaattttagactggcaagggaagaacgcctcaagtgagcatgcgtacaactccagtaaacacactgtgcatgccgccctttccaagggctagcagaccactgcacatatggacagcccagcccaagggaagaatcaagggagaaggaacaccaagacccccgaagcatgcaatgtataaaacctcaagtcaggccgggtgcagtggcacacctgtaatcccagcactttgggaggccaaggtgggcagatcacctgagattaggagtttgagatcagcctggccaacatggtgaaaccccgtctctactaaaaatacaaaaattagccaggcttggtggtgcacacctgtaatcccagctacttgggaggctgaggcaggagaatcgcttgaacccgggaggcggaggttgcagtgagccaagattgcaccactgtactccagcctgggtgacagggagagactccatctcaaaaaaaaaaaaaacaaaaaacaaacaaaaaaagacccaagtcaaaagatcaaaccacatacttgatctctaaagtcgtccacttggccctcttccaaatgtactttccttcctgctctaaagccttttaataaactttcactcctgctctaaaacttgcctcgttgtctcctgccttatgcccctcagtcaaattctttcttctgaggaggtaagaattgaggttgctgcagacacctacggattcaccgccagtaacagccctgctgtaaatatgaatgttagcagaaataagaacgtctgacatgagatgatgtcagaggcaataatgaaagagaagggagtttcaatagtaggtaccaagacaataaattaaccaaaaatatcactaaaaagaagagctaaccaagtcaacccaattcttcatcttctagaatattgaatatttaaattgccctactagttataataaaatacaaataagatatgcataagatttaatactgctaacagatcaagtcagtatatcataatgagagaaaaattcattatgtaataatggtcaagagattattgaagtgtgttatattagggggagaaaatatgttgtgagattcttgtttgtttttttgtttttgttttttgatacgaagtctcgctctgtcacccaggttggagtgcaatggagtgatctcggctcactgcaacctccgcctcctgggttcaagcgattctcatgcctcaaccttccgactagctgggattacaggcatgtgccaccacgcccggctaatttttgttttttcagtagagacagggttttgccatgttggccggactggtcttgaactcctgacctcaggtgatccattctcctcagcctaccaaagtgctgggattacaggtgtgagccaccgtgcttggcccgcaaaattctaaaatttatgtaaaagatgtgtacctaactaaaagcagttatattcctcagtgagatataatttcacacccactaggctggctatagtaaaaagagagataataagtgttggcaagggtgtggaaaaattggcactctcatgcacagctgttggacagtgaaatggtacagcactttggaaaatagtctgaccattcctccaaaggttgaacatggagttactgtatgactcagcaatcctacttctaggtttatagcccagaaaaatgaaaatctatgtctacacaagaacttgttcacaaatgttcatagcagcattattcataatagccaaacaacaacgacaacaacaacaacaataaaaaatggaaatggcctaaatgtccctcaacggatgaatggaaaataaaatgtgatatatacagccatacgctagaataaaaatgaatttgaaaataaaaagaaataaagtactgatatgtgctacaacatggatgaaccttgaacacattgtgctaaatgaaagaagccagtcaaaacgacaccatgttgtattattccatttatatgaaatgtacagaataggtaagtccttagagacaaaaagtagatgagtggctgcttagggctggggtggagtaggggagggttaggagattgggagtgactgctcatgggtttgggctttcttttggggttgatgaaaatgttctgaaattgattatggtgttggttttgtaactccatgagtatactaaaaactactccctggttttgtacatttatttatttttatttcattttattattatttatttatttatttatttatttattttgagacagagtttctctcttgtcgcccaggctggagtgcaatggcacaatcttggctcaccgcaaccttccgcctcctggcttcaagcaattctcctgcctcagcctcccaagtagctgggactataggcatgcaccaccacgcccggctaattttgtatttttagtagagatggggtttctgcatgttggtcagactggtcttgaactcccaacctcaggtgatccgcctgcctcagcctcccaaagtgctgggattacaggagtgagccaccacgcccggcctcattttattattttattaatgattttttaattttgtgtgtacgttgtaggtatatatgtttatggggtacatgagatattttggtgcaggcatgcagtgtgtcataatcacatcatggaaaattgggtatccatcctttcaagtatttatcctttgtgttacaaacaatgcaattatactcttgtagttatttttaaatgtacaattaagttattatcagctgggcgcagtggctcatgcctatactcctaacactttgagaggccgaggcgggcggatcacctgaggtccggagtttgagactagcctggccaacatggtgaaaccccatcattccaaaaaatacaaaaattagccaggggtgttggtgcatgcctgtaatcccagctacccgggaggctgaggcaggagaatcactggagcccaggaggtggaggctgcagtaagctgagaaggtgccactatactccagcctgggcaacagagggagattccatccgaaaaaaaagaaaaaaaaagttattattgactgtagtcctcctgttgtgctatcaaataccaggtcttattcatgctttctaactattttttttgtcccattaaccatccccacgtgtcccccatagctctactcttcccagcctttggtaaccatccttctactgtctctgtccatgagttcaattgttttgattttagatcccacaaataagtgagaacatgtgatgtttgtctttctatgcctggcttatttcatctaacataatgacctccaattccatccatattgttgcaaatgacaagataccattctttttatggctgaatagtactccattatgtatatgtacattttctttatccattcatctgttgatggacactttagttgcttccaaatcttggctattatgaacagtgctgcagtaaactatagttattattttctattggttcatcatttagtctttctactttaagacaggagtagtttacctaccaccattaaattattatactattctgtgtttttctgtatacttgctattaccagtgagttttgtaatgagatttattctcattcattaacatccttttctttcagattaaagagctcactttagcatttcttgtcagacaggtctggtgttgatgaaatccctcagcttttgtttgtctggaaaagtctttatttctcctttatgcttgaaggatattttcactggatatactattgtagggtaaaagtttttttccttcagcacttgaaatatgtcatgccactgtctcctggcctgtaaggcttccactgaaaaatctgctgccagacttattgacgctttgggagtttgatcattaaatgccttgaggtagtctttgagtttaatctgcctggcattctataaccttcttttatttgaatgttgatatctttccataggtttgggaaattctgttatttctctgaataaactttctatctctatgtcttctgtacctcctctttaaagccaataactcttagatttgcccttttgaggctgttttctagatctcgtaggcatgcttcattgttttttattattttttcttttgtctcctctgactctgtattttcaaggagcctgtcttcaggctcactaattcttctgcttgattaattctacaattcagagattctgtcttttctgaaagattaaaataaataaaattttaaaaaggctgggcacagtgggtcacacctgaaatccaagcactttgaaaggccaaggcaggcggatcaactgagatcaggagttcgaaaccagcctggccaacacaacaaaaccctatctctactaaaaatacaaaaattagccaggcgtggtggtgggcatctgtaatcccagctactcgggaggcggaggcaggagaacctctcgaacccaggagacggaggttgcagtgaactgaaattgtgccactgcactccagcctgggtaacagagtaagactctgtcccccccacaaaaaaaaaaagaaagaaagaaaaggaaaaaggaaaaagaaaaaaaattttcaaaaaaattttcaaaagagtcgtacattcttcagcatgtccattgtatttttcaactattgaatttctgcctgattctttttaattatttcattctccttgttaaatttatctgatagaattctgaattctttctctatgctatcttaattttttttttttggagatggagtctcactctgtcacccaagctggagtgcggtagcgtgatctcggctcactgcaacccctgcctcctgggttcaagcgattctcctgcctcagcctcctgagtagctgggactgcaggcacgtgccaccacgcccagctaattttttgtatttttagtagaaatggggtttcaccatgttagccaggatggtctcgatcccgatctcgcgatccgccctcctcagcctcccaaagtgctgggatttcaggcatgagccaccgtacccggcccttgaatttcttttagtttcctcaaaacatctattttgaatgatctatctgaaagatcatatatctctttttctccaggattggtccctgatagcctatctagttcatttgatgaggtcatgatggtattgatgcttataggcgtttgtcggtatctgggcattgaagagttaggtatttattgtagccttcacagccctgggcttgtttgtgcctgtccttcttgggaaacccaataatgctgtggttttgcagactcttagaagtactgccttggtggtcttggataagagctggaagaattttctggattatcaggcatagactcttgttctttttgcttactttctcccaaacatacagtctctctctctcttgctgagccacctggagctgggggtgtggtgacacaagcacccctgtggccgtcactgggactgcactgggtcagatctgaagccagcacagcactgggtctttgccagggccttcccttcagggcaacaagttcctctaggctaagagcttctccagagatgctgtctgggagccagggattggagtcaaaaactttggtaatttacctgatgttctgttctactgtggctaagcgggcgctgacaccacaatacaaagtccctcccactcatccctcccctttccttaggcagaggagcctctccctatggcaaccaccaccaccagtccacagcaattctgccagtccaccaccaatgttcacttaaagcccaaaggtggccggctgtggtggctcacgcctgtaatcccagcactttgggaggccgaggcaggtggatcacttgaggtcaggaggtcaagaccagcctgaccaacatggtgaaacactgtctctactaaaaatacaaaaattagccaggtgtggtggtgggtgcctgtaagctcagcttcttgggaggctgaggcaggagaacctcttgaacccaggagacggaggttacagtgagcccagatggtacaactgcactccagtcagggtgacagcaagactccgtctcgaaaaaataaaaataaaaattaaagcccaagaactcttccatcagcttgtggtgaatgttgccaagcctgggacttacctttcagggcagcaggctcccctctggacctgccatgagccagaggggcaggtccaggacagaatctacacctagatttggggactccaagagactgcttgttgctctgccctaccatggttgagctggtgcctaaggtacaagacaaagtcccctttacttttccctctgcttttctcaaactgcaggagtctttcaccatagccaccatagctgggaatgtgctgggttactgctgaagacagcatgtctcagagtctcacccaaggcccacagtgtactacctggttattgctgctagttatgcagggcccaggggctctttagtcagcaggtgatgaatcctgcaagtactgggcccttctcttcaaggcagcagcttcccttttggcccaggtatctaaaaatgacatctgggagttgggcctggaatgggggcctcatgacttggcccagtgccctatcctactgtggctgagctggtatccaagatgcaagaccaagtcctctttacccgttgctcatctctccttaagcagagggaaggagtcactttcgttgctaggagctgcactgcctgggattggagaaggggtggcacaagccctcccttagccataccggctggtgtctacctaggtcaagtgcaaccctagtccattggctgtaagtccagccgagcactaggagttgtctaggaattgcagtccttgggtcctagactgccttttcttttttttcttttgtggaaatatggcctccttatgttgcccaggctggtctcagactcctgggctcaagtgtccctcctgcctcagcttccccaagtgctgggattataggtgtgagccaccgcatccagcctagactgcctttcaagtttacctaggacaccagagcactttggcccatggtggtgaggcttgcagagaaactcaagttccaaccactgggacaggtgatttccctctggctagggctggcccagatgcccccctccacatgcaggtgccggtcgatcccagcatgactttgctctccgctatgacagtgcagcagtgagttcaatataaagtcccccaccccatgccctccctccccaaaatgcaaagactctctttccacgctgcagggacactgccagggaggacggaaggggcgtcacaattcaagactgtctctcctgccctcctcaatgtttcctttagtgatatgaagttaaatccagttactgtgattgctcacctgatttttggttcttgtgatgatgcttctctgtgtgcagatagttgttaaaagttagtgttccaggctgggcacagtggctcatgcctgtaatcccagcactttaggaggctgaggtgggaggatcatttgaggccaggagttcaagatcagtctgagcaacatagtgggaccccatctctataaaaatttaaaaattacccaggtgcagtggtgcaggcctgttgtcccagctacttggaaggctgaggtgggaggactccttgggctcaggaggttgaggctgcagtgagccctgatggtgccactccacttcagcctgggtgatagaggaagactctgtctccaaaaaataaaaataaaataataataataattgcattcgtaggccgggtgcagtggctcacacctgtaatctcagcagtttgggaggccaaggtgggtggatgacctgtggtcaggagttcaaaaccagcctgaccaacatggtgaaaccccatctctactaaaaataaaaaattagccgggcatggtagtgcacacctgtaatccctgctacttgggaggctgaggcaggagaattgcttgaacccggaaggcagaggttgcagtgagcagacatcgcgccattgcactacagcctgggcaacaagagcgaaaatccatctcaaaaaaaaaaacgcatttgcttcttagggggtttcagacatttaagagaatcctatgtattaaatgcaagattttttttttttttttaagatggagtcttgctcttgtcacccaggctggagtgcaatggcgcgatttcggctcactgcaacctctgcctcctgggttcaagcgattctgctgcctcagtctcctgagtagctgggattataggcgcttgccaccatgcccagctaatttgtatatttttagtagagacagggtttcaccatgttggtcagcctgttctcgaactcctgacctcaggtgatccacccgcctcggcctcctaaagtgctgggattacaggtatgagccactgtgcccagctaaatgaaagattttaattaaatgcttaaatgagtttaagtctaaaatcaatatttaggccgggcgcagtggctcacgcctgtaatcccagcactttgggaggctgaggtgggtggatcacaaggtcaggagatcgagaccatcctggctaacacggtgaaaccccatctctactaaaaatacagaaaaattagccaagcgtggtggtgggcacctgtagtcccagctactcaggaggctgaggcaggagaatggcgtgaacctgggaggcagaggttgcagtgagccgacatcacgccactgcactccagcctgggtgacagagaagactccgtctcaaaaaaataaataaataaataaataaataaataaataaataaataaaatcaataatgtgttttaatcagtttggattattaaatccataaatgtctatgtattagttgtgtacatagtgtataaatagaagaatatttaatgcttaaatgctatttgtttaataaattcataagagaaacaaaattacattaagtagaaataccttaatgacatttagacactgagagggtgtcccaggaaaagagaggggcacctgaacttgaaggctggtgacagatgtttaaggggccactaacataccagatagattttatcttcctagactcatcatctttgcacctattaatcatgaacagagttagttctcctgaattcatcatatgaaaatgtcacagtggacagagagactcaagagaagtgagttttgactgggtgagtcaagagggattatggtcctgagtagccagggagtgatttaagtacgggattcagagaaaggagggacagaggaagaggtgctaaagaaacaaccctctggccgggcggggtggctcacgcgtgtaatcccagcactttgggaggctgaggcgggcggatcacgaggtcaggagatcagaccatcctggccaacatggggaaaccccgtctctactgaaaaatacaaaaattagctggggatggtggcacatgcctgtaatcccagctactcgggaggctgaggcaggggaatcgcttgaaccagggagtcggaggttgtggtaagcagagatcacgccactgcactccagcctggcaacagagcgagactccgtctcaagaaaaaaaaaaaaaaaaagaaagaaagaaagagaaaaaaaaaacacctgctgcatcagtcacaactgccatcctgaggccaagaagaactaaatggtctcaaaattatttcacaacttgttgctaccacctttccacagtggggcttgtctagccagagaatcaaacattaattcactttaggctggtcatggtggctcatacctgtaatcccagcactttggaaggccgaggcaggaggatcacttgaggccaggagttcaagaccaacctgggcaacaagcgagacccccatctctacaaacaaacaaacaaacaaaagagtaagcacgtcatacacatcatagaattctaagaactgaagtaaccttgtaacatttagttcatggtaaatacataaaggaaactattattattatcacccaacagtgtgtgtgtaagtgaaaaatgtcttttttactgacaaatggctaagtgaatgctgtttgtttgagggatgaaatatttaaatgagaagccaactcaactcttcctcttgatcttagagtcattctctcaagtgtaactcccagtgcaaagcatcacatcaacttatcaatcgactgtgatgtcaactacagcctctgcaccagaccagccctcctctgtgggacgaagaactatcctgtggtcctgccaggactgcctcactgggacaacgcactgcattaggatctatcccttacgatggctcagggttttccagtctctaaggcaccttatcattatcttacctaaacttcctaataatcctgtgagggaggctggacatctgctttcatcccatgttacagatgagaaaacgaaggtccacagaggtcaatgacttgcctaaggtgacctggcacagaaagttgtgtggcagaaggggaacttctgtttcctaacttctggataagcgccctcctaggataggagaaatgaatgactcttgctactccagccaccacttccactaattaaccactaataaaaatgtaaaaatcagtatgccagcagtagtccctgttgcaaacattaggacctttctcatatcacagattactgaagacattccctctctttttgttgtagttgttgttgtttggtttttgggtgttgtttttgttgttgttgttgtttttctgagatggagtttccctcttgtcacctaggctggagtgcaatggtgcaatctcagctcactgcaacctctacctcccaggttcaagcgattctcctacctcagtctcccgagtagctgggattacaggcgcccaccaccacacctggctaactttttatttttagtagagacagggtagcaccatgttggccaggctggtcttgaactcctaatctcaggtgatccaccctccttagcctcccaaagtgctgggattacaggtgtaagccgcctttcttttcttttctttttttttcctttttagtcttgccctgtcacccaggctagagtgcagtggaatgatcatggctcactgcagcctcaacctcccaggctcgggtgatcctcccacctcagcctcccaagtagctggtaccacaggcataacaccatgccaagctaatattttattttttttaaagtttatttttgctcttatgatgatgattttttttttgagacagagtctcactctgttgcccaggctggagtgcagtggcacaatctcagctcactgcaacctccatctcccaagttcaagcaattcttatacctcagccttccctctagctgggattacaggcgtgcaacaccatgcctggctaatttttgtatttttagtagagatggggtttcaccacattggccaggctggtctccacctgccttggcctcccaaagtgttgggattacaggtgtgagccaccatgcccggcctactcttaattttttttttaagtgctcaagctaattttttaattactatttgtagagatgaggtctccctatgttgcccaggctggtctagaattcctgggctcaagtaatcctcctgcctcagctcccaaagtgctgaaattacagacatgagccaccatgcccagttccaccattttttaagcaacaactaacgttaatccaaagaccaccctgaggggactggccacatccccctgggaccctccactgttaaagtccatcttccctgagccatcagcaccaagcatcagatgaacttcactgccctggctcagtgttgcctgtgtgtgagcctcagctccccatcctctctgggcctcagtgtcttccctgtgcagtatgccccgcagtgcccacccaatggggttgttgtgaggatttgctggaagggtgtgtgtgcaagccccttgtccaggacctggcctatatgtaaatataataaaagttcgttgttatttctgttaattgcatattgtacttgaatactccctggacagataatgagaaaaatgaggtttgagtcaccacccctgtcacttgtaaccctgtgtgacttgcttaatccctctaaatctcagttcctccatctgtaaaaatctttttttttttttgagacggagtctcgctctgtcacccaggctggagtgcagtggcgcgatctcggctcactacaacctccaactcccgggttcaagcgattctccagcctcagcctcctaagtagctggcattacaggcaccatgcctggctaatttttgtgtttttagtagagatgaggtttcaccatgttccccatgttggactaggctgtctcgaactcctcaggtgatccgcctgcctcgttctcccaaagtgctgggattacaggtgtgagccaccgtgcctggccgcaaaaatcttataatgccttcctcacagagaataatgaaggttaaatgatgaaacgcacagagcattttaatgctgagaagggcttcatgaggttgttgaaaaatgtcagtgaggctctgggagggctacagccggagtgtagattagactctgggtgtagccgcatggctcaggaattgagtggaagaagagagatgatgagagagggggagggacagagagagaggatcagccattccttcgtgcctgctgagtgcctgccctggtccagaccctgttctttgtgctgggggtgcagcagtgaactaaagagacaaagcccctgtcctcgtggtgcttatgctctagtgagtctgtggaacagagcaggggactgttgacaccaaatttaaatgtgcgaataggaatgactatgcagaagaggccaccaggaagagggacagagagaaatgagactccaggcttgatagaatgaccttgggctggtggaagaggcaggtgctgaaaacaggcatggaaccccttgccctagggcagggagaaaccaagagagtccaagctgggaaaagaatcaggtgaggaggttgaggtgttgacgaagggagtgtgcttggtgatgggaaaggtgggctctgaggaaggtgttccaggaaggacttctcagtgtaggatggagccttatggcagacgctgggaccgggcatcttctccagaaatgcccatctgccactcaggcaggcaggcaggcagctccctaccccttgagttctggtgtttttcctactcctttctcccctcccacaagctgcccaactcccagggacctgactggatggagagtacatacacctggaccactgcaggcatggcacagggaagagagaatccagacccaaatcacctccaacccacacctgctgattcttccgtgcttttgtagcctgacccttcgctgccgtcactccaactcctgtgtgaggatgttgagctcctgggaaaaccgaagggagggcaggagagacaatactgtgaccaaaggctgagactgtgtcatcacttgggaatgaaagcatcaaatgccaccccaggtgggattgttggcttcaaggtttttttctccctttcctttctcccttttctcttttcctttatcgaggtctgctatttactcagcaactcttcaaagtctgtggttctgtgggacacaatgtgctaaatgatgcctgtaagggaggaggtcgatgtacctccacttccaagaagcttgactttccggggaagaaaagacaagtgaagcgtagacattgcgacttttggcttcctgtttctgtgagttgcaaggaatcctgtccacctggccctggagccgccttctgggacctcatccttgccccctgctgcaggtgccatctcaattagtcctgctgtccctcctccccctttcagattccagcacaattctggaacagctctcccacctggccggggtgagactgaggctccaccctcaagcacttgggcactgatcctttgtgaaggatggggatagcaagacagcgtctgcaggggcccctagagggccgtggggatggctagaaaacaggaatgaacagactcacttcagcttatgcccagactcacttcagcttatgcccagaaacaaagaaaccaaggagaagcaaattccataagtgcttttattttattggagatgagcaggggaggcactgaaaagtggggatagtgctggaaacatgctgacagggcctggattgagcccacacagcaaggggcgggagcaggactctaactcccaatgttgggtttccctctatcgtgctctagccccactgcaacctagggcttggaggattagggaagccagctgggatgttccaagaagagccaggagggcggaggactccaggaggaaatgggttattgatacctgggtatagatgaatattcccccagctgcctcctggataccgattaatattcccccagctgcctcctggataccgattaatatttccccagctgcctcctggataccgattaatatttccccagctggtacctgggggttgattattgataccccagattccctcagggtgtggcatgggcctcgttccccaaccagtcccagggcctccacctccccaggacacactgggattcagggtaccccaggggtgatcaggcagaaccctgtggatgagagaccagggagggcgttgggaaaggatttttcccccggctcccagtgaattagaacggggcagtcgtctggactccgagtcctggtggaggagtgaagccttgggtgagaggcctgtggcatcgggagaagactccccaggcaaagggccactgcccggagcgagggccgcagcactggagaggtaagagagttcttcaggcagcgcttcccccaggcggtcctcagccgcagcagccatcatctgccaaggatcctcagggggccaggaatccatggcaggcagcccccacgatggaggccacctctgcactgcagaacctcctgcaggtgggaagccatctgatgcaggcacgctgagcttcagaggaacccttgccaagtcattagacctagggtccagagcgggctgcggatgttcagagttagaggggccagtggaggaaggttgtccgagctgaggcaagttggtccccaagttttgggaaactttctcctccacaacaccgatgctccgggcaaagaggcctgagggaaagggaagataaagcaaccagtggtctccagtccccgagtccccagttccctttgcttcccctatgcctattcttccttttccctcagggacctaaatgtgtaccctcctgcctttacccctttccttaattcctgtttcctgggggacctccagtccctcctgcccaagggcatcacggcctccatacctgggagatgaagacagaccaggagcaggcccagaggagcgcagctccctgccacgcggccctgcatcctgctcagcacccgatctccctcagccccaagacagccagccctttatcctggtagtggggtgggggacagcagaaacaggctgggctagtggttgtgaagacaataaacctccacattccaccctcattcctaatgtggtctgtggcaacaggtgtcacttgaatgaatgtcccagaggaagctgggtgtctcccgccctggctcctttccttgacctccctgccccttcttggcccaggtgtcctggctcacagctcatccctggttgccagcctccccagccctgcttctctatacacaaggacctccaccctggggtcccactctcttaattgcctctctcagcaacagaaacacttgtttctttttgggagctggattgtttcctcccagcacccctttctcatgcatcctcatatctccttcaccttggccccaacctgcaggaggttctggggtgcagaagtggccccatctgaggagctgctcctacatgagaccctggatctagctagggaaatggacctggatgccatccttatgagatactgactaattcctgctgctgcagtgacaaattaccatgaaccgaatggcttacaacaacatggatttattactttacagttttggagatcagaagtctaaaacaggtctcagtggattaaaataaaggtgtcagcagggctgtgattctttctgggggcctcaggggaaaatccctttccctgctttttcaccttctagaggcatcctgtgttctttggctcatggtccccttcctccatctccaaagccaaaatcagccatttcttacactgtatcactcagacttcctcttctgcctcccatgtccacattaagggacctggtgactacactggacccacctgaataatccatgataatctctgtgaagtcagccgaatagcaaccttaatcccatctggaaccttaatttccctttgccatgtaacctaattcctacgttccagggattaggatgtggacatctttgatggtgttggggttgaagacatcattctgcctgctactggtggtcagatgtgccatagagtataagaaaccttgggagaaagtggctatttccaagtaacagtagaggagagcctttaaatgctgctgtcaaatggccaggacttgatccttgttgaagctgggcgatgagaatgtagagattcattaacagtttgttggcttttaaatatgtttgcaaattttattataaaaatgcaatggctttgttctctccatggcttccgggaggccccaggagtaggcttccctggctgcccaaggtctaaacatgagctgttggctgattctactgctgtgtcctccccacctgcccctgctggcttaaccactggaggagtgaagagctcctctccagaactggcagtggatggagcccagaggcctttttggatgacatgcatgagttttacacaagcttttaatttggagcacagcaggagactcgaggaaacaccacatcagagagccttctctccctgcaattcccattcatgaagcatctgaggacctcgattcctgccattggctgcagatcaggggccagatgctggaccaagggtgattcaatccctttctggtcaatgtaatacatttttgctgattccagacttggagtttcaacagttctaaattcaggaccagacagcaccaccctgataggagggaatgggttaagtgctacagtaggggtgaattcctttgcagccaagcagaggctctgagaggtggcctggggtggggggtggggctcctacagggacaagcacaatccactctgccctccttgggatgcgggaacttcgtccgcctcagcctctccctgcctgtctcaggacttaagtcgcatggaccccaccacacactccactttctctctcttctccagtggaagcgactcctctttcccactggggcactctgccttctcagccctcacctgagagccatgttgctcacactctcactctggaccccagcagagcagggagtgtgaagatggagagaccaccggcagctctgttctgccacaggctgggcctcttgatctaggccagtgagtcaccctgcttggctgcactccctgccctgctcccatcctctcagtcctttactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaaggtgaggaatgctaatggtggaagaaaaggagtttgggtggggaggggaggggaggggagggagaggaaacactgagggccctaaataaggggaagggggaccccacggtgaatgaggaatgggaagagaatggatttcctggagcaatgagagaggagggaaatggcggaaggatctgggaggccaggcaatctctgctttcagttcaacaaatatttattgtcttcctcctctgtgggagcagctggaaggtagaagagaaacacagcccgcttttgaaggaaaatgaggaacacagagacctctagaggcgtaggaagagcaccacccagactctcagaggagacccaggactccaagaaggcaaaaagtctgcacctagtccccacagtttactgagccatctgtccaggatccagggacagcagggagcctgcttcaacctctgagggtgccccagtgtctccctcacccagggaatcatctgagcactgagggaagtggccacaggaaggggctgagataagggccttgagaggcaatgggtgtgttggggacggtgatctaggagggcgtggtgagctctgtaatggagggtggggtggaattgggagcgagagcccagtggcatattgggtgggttgactagatgtcgaagaaaggtcagtgaaaagtggccactgtttccagatgatggtttgactttgctttatttggtaaaggggaagaggaaggtataacttcttcaggcgtcagaggtgctctgagagcatttcaggggtttcccagttgagaagctgatgggggtgttactcaatggaccatttccacacagtagagggaattgtaaggggtggtgatctggctgaggggcactgtggtggaatgggaatttaaacagtaggagagaatcaagagaggagctttgaatctaccattttgagaagaggaaggaggaaggggtgataagagagagtctgcaaccttggggtagtggagaaagcagaaccactcttttgggaaggagggaaactgagctaaccctatgcctgggcactggacttctcccatatgggatatagtgtatgtgcttgtttgtgcccaaggcatgcacacacacaacagttgacttcttatggactgttgagtaactctccttggggtaggaaaacttcagggtcagctagctggggccccagaggcttcacttgggctaggatatcccggatggagcggcaggggatctttccagcactgctggagccacagggcttggcaccagcggagggatcaggatggggagagccatcggggcccccagtcagtgtcaaggaggagacagacatgcaagggtgaccagaagagctggacttgctgccacaaggctgaaggatgattttgccactggattgggaactggagctgctgctgaaggagccggtgcctggtggggagcaggggctctgggaagcactgccgcagggatggtagggtaaaccggagctgctggaaatgctagaactgctggggactcgagaactggagggagagcagggtcccttggagcccgtggagccgcctccacagagctggaccccaccagtccccactggctggaatgcaatggccgaggaagctgccgactggctggggatgatggggttgctggagaagtatttgccctcagagatggggggcccagctgcaaaggaagggacccctggagagcctttcacagggttctctttggtgaagtagcccacagggtagattttacccttactgtaggtcatgcctggaaccagataactgtcagaggagccacccaccacctcgtagccaccataggatttgtctacagaggtgattgggggacagggcttgcctggaaggccaccattgctacaggggggaccttgaaccactccaggggcaccagaaccgtgctggtccaccaccaccaccacaggcctctgaccccctgacacagagtgggagctggggatgtaggggccggagtgcgagacgatgggccctccactgcagggagagtcggggatgtccgaactacagggacgctggttggagctgacgctttggccactgctggataccccaaaggtctgggaagaggaagagctttgtccaggctgggaagggtttagtattccgcggtaagagttgtcattggttggcagagcagagccattccctacttggaagctgctgctgctgaactgaaagctgctgctgctgctcgaatgagagctgctgcttcccgagtgagagccgctgtttcccgagtgagagctgctgctccccagctgggaggaaccggatgcaccttgtagactagagccagatccggaggagtagctgacctgggaataccccgttcctggcttaaaagatcctgcagaaccaccctgggcaatgctggatccgctggagctaccactggagccaccaccagagcttctggcactggaaatggagctgccagaactgctggagccactgtagctactgaaaccgctggagtcacccttcccagtgaggcaggggtcgttaggggaggtgatacgcgtggggtccttacaagggtctgagaaggtgccaatgctcttagccaaggtccctgtggaggaaagcagtggttagtaagggccaaggaggcttggcttcctccctcacctttctgccttatctcagtcatcggcctctcgggtttctcccaagcagagcgcagggagagtttagggatggagaaaggaggaagaactggctattgtctctaaaggatattgaggtggccgaataaaggcatttctttgtttgggaagggtgggcaaacaccaaccagaaaaatagaaaattaggtgccaaagtgagtggcctcaaaggaatacattgaatataagagggggctgggcacagtggctcacgccggtaatcccagcactttgggaggccgaggtgggaggattgcatgcgccccagagttcaagaccagcctgggcaacatagaccccgtctgtattttgttttttaattaaaattttttttaaaaagaagagggaatggagaaggggcaggaacaagtaggtctaaaagaaaggaccctgaagagacagagaattggggaaactgaggctctgaggagtccaggcgtaaattcttaggggaaaaatcctgggccagacagtgggaccaaagggaagaagacaaaaggcaaaacaatggagggctgagaagtggagacacatatagaaggagacactggaaaaagacaaagctgggggcagaggggctgaaataaaggaaagggcactcgaggactaagatttggtcaccagcttcttcgtgagagcccaggctggggtcaggaatggaaaccctatttcctatctcagcactggccatgccagtaaagctgggtgggggccaggatgtggggtcactacctgttgcttcagaacctgctggtaccagtgtgtcaggacaccgcaccctgagccagccctgctctcgctggcccagcccagggaaccaggacgaaaccccacgaacctccgaggctcctggccacaatcagcttccctctctgagcacacctgcctctgtccagcccctcatctgacttctgctgccttgacttccctcagggatgtggagccacatctttccttatctttcctttcctttgctcaaaaccccaggcccaacttaccccgtggttcctccatgactctttcacctgcgttccttctgccttccctagcccctccaggtcccacgtgttacaaacagagccacatactagcaagttactgaacctctctgagctttagtttatacattcagaggggccaaattttccctgccttcccacagcattactatgaagaaaactaaatgagatcatccacctggaagttttttcttcttcttcttttttttttttttttttgtgagatggagtttcttgttgcccaggctaaagtgcaataacacggtctcagctcactgtaacctctgcctccttggtgcaagcgattctcctgcctcagcctcccaagtagctgggaccacaggtgcccgccaccacacccagctaattttttgtatttttagtagagagggggtttcaccatcttggccaggctggtcttgaactcctaacctcaggcgattcacctgccttggcctcctgaaatgttgggattacaggcacaagctatcatgtgcggccagatgttttagaaagtgtaaagcattatatattatgaattattactgccactcatcctgatccctccaccaacaaccagactgccatcctctgtgatgtccctgttctctcctcagaaagaaattctctgcatgcacctccacgccgaaccccagctgtgccaattcccttcagtcctctgcacgaatccaccatgcattgcctctctctttcgctattccctcagacaccaaccacccactagaccatgggaaggtcgcagaaattcctcaagggctataagtacccggtggtcaacaacacaggtccaggggttgcccggcctggggttgaaatcttggctttgctgccttctaatgcatgatcttgagctactttcctaacttctctgagcctcagtgtcctcatctgtagagtggaaatagcaaatctcctttcataccgttcttgtaatgatcaaaagtgctaatataggccgggtgtggtggctcatgcctgtaatcccagcaccttgggaggctgaggcgagcggatcacttgagtcaggagttcaagaccagcttgaccaaaatggtgaaaccctgtttctactaaaaatacaaaaaaaagaaaattagccaggtgtggtgatgggcacctgtagtcccagctactctagaggctgaggcatgagagtcgcttgaacctgagaggtggaagttgcagtgagccgagattacgccactgcactccagccttggagacagagtgggactccatctcacaaaaaaaaataaaaataaaagttctaatatataatccaaatgtgcttaaaacagagtctagcatataaaaaggctctaaaaatgatattattactattaaatgtccaatcattatcttgtagtgctcccataataaaaatcaccaccaccatttatataaacctctagaatttccaaagtacatatcacatacattatttaatttgagacacacagactagagttaggtgtcattaaccccacttcagagtttcagaaactggggctcaggaagtttaagaaacttacctgaggcgaccatacagtgaggagcaacccccagactcaaaaggcagattccagagcccctgcctgtccccttcgctgggtcctctcccggagtctccctcccgcctccctcctgttcccagggcccccagcctcctacctggcaggaggagaccagccagcagcagtgccatcatcccgtgcccacccacacgccccatccagggtgcccgagacgagcccatctcggactgcacggcctcctgactgatggcagctcaaggacacccgggtcctttatgccagagctggacattccctgggcaggagtcactgtggggagaggaggagaggtggagggggtgggtgccccaggggaagttggtgtggccgggaggagcgtggtaatcagcccggtgcatctgcctactcagcagcagcagtggctgcagtgtggggtacccatggccacggggctctaacgatcctgccacctgacaggcctggccccggctcctcattgcctaacccggaaccaggcgctctgccccacggccacccactctggggcggccactcttgccacgggacccagctgcctggctccttaactctcctgcctaccgtagcttggcctgtctctccatctgccctccactcgcagtcgtgggtgtttcagctttttcttccacacttgggtgcccgctccagccccacccacccaaccccaatgaggtcccattcacagcccctgatctgctccttccttaggaccccatcactccacctccactttcctccttcaaatatgagttctgcccccatcccccaggctccccctcccaccactccccaagtaccaggccagccacatacctattacgtgttccatcacctggggaactttctccttctcagaaatggggcaccacattcccaaaaccaactccctgacctgtcgcttctgggggcctctggggacggcatggtggcgggggtgggggggtgctgggagccagggctcagccaggggaggggcctgggctgatgacctctgtcaaagctgggccttggttactcacagggcactcacagcccctccccatggctggtaacccagacctcaagggtgagcaagaggctaagaaggctaattgggaaggtggtggccccatagcccatctgctggccctgggctggatgagcgagcaggaagcagcagccagctctgggcaggtcgaggagggccaggcaggctcccgggtcctcaaaggatgaaaggaggccaggagaaccggagccctgccatctgctgagagggtggtggcttctcctccattgcgttggcctccctcctgctctggcccctgccccgccccagccaattaattgctcactagtattgcgggagtatcagtatcggagggaggtgcctgggagtccagcaagctgccctctcctcccccaggcctcagacacccctgctcccctcacccaaactcacttcccaaacctcatctcctcacaaaggcagctctgtccctgggccccttggcctggtctctcccattccctctacctcctgaccgccctttaagttcagaccagcaggaggatggaaatgtttcctgtctgtgctgtccgatacggtagccactggccacatggagcaagtttaaccaccaaagatttggagctttaattttaattaattgtaatgatgtggttggccacgtgcagctagtggctgccatctagtcttgctcttgacttgctagtgacactcagaatgggagtgggaggaaagaggggctgagggagctgtggagagaggaagggataggacagggtcccctgaagggggctaatgccttgggaaaaacaaacaaacaaaaaacactggcttcagaatgaagatgacgtgggttcaagtcccagctaacctcttggctttgggcggctcttcaaacctttctgaacttccatctcctcatctgtgaaatgggggtattttaaataacacttatttcacaaggtttttgtgaacatcaaatgggaaattatcaaaaaggttaaatgggacaaggggtgcagtcccccagtaggaagcccagcaaatggagccctgcaggtgctcctgtcttcatccttccactgggggagacaaataggccagcttcacccccacagccccaggctccctttcctgagtctccagcccagccaatgctagcagagtgtcttctgctcccttcctgccttgtatagaggtgcaggcacaaatgtgagacagagataccatttaaagtgatgctgctcggctgggcacggtggctcacgcttgtaatcccagcactatgggaggccgatgcgggcggatc

SEQ ID NO: 270 - DNA, 112604 bp, Homo sapiens
gaacaaggtaacctgtcttataactctggagtcatatatctaaactgacacaatttcagaaagctgtgtaaccctgtttgccctctgtagcgaatatatcatgatgcagagaaactgaagtagagaagtttctcagagtcaatggttatcagtgatgtcatgtactaaatatgaggtattcattccttcatctgcctggggtcaggagtagggacctatttatttatttgtttatttttataacttaagacaacagaagcacaaaagtaaaaaaataaaaaagcagagcagaagtaaacaaccatggcatcagtccacataattcaatatgtcaagagttagtaggcaaacaacaaagatagtaacttataacttactaaggcagctgcttggccaatcccctgagcagcggccgtcaggatgatgactttcccatcaagtcgacccataatggaacctgtggtttaatctaaagacatgtgtgtttaatgggttatactgtagaacatgatcttgagcaggcagtaacatctagaatgaatagttcagtgtgctcttttaagaataatttagtgagctccttcaggaacttgaagacagcacctctgtgcaagtagtcccatcatctgaattctcctagaatgcttactctgcatacctagctttgtatatcaaacacatttaccataacccactgaagtaatgactggtgacagacattggccattttttttttttttttttttttttatgagatggagtttcactcttgtcacccaggctggagtgtaatggagtgatctcggctcactgcaacctccgccttttaggttcaagcaattctcctgccgcagcctcctgagtagctgggattacaggtgcctgccaccacgcccagccaatttctgtattttttgtagagacgggctttcaccatgttggccagactggtctcaaactcctgacctcaggcaatccacctgcctcagccttccaaagtgctgagattacaggcctgagccactgtgcccagcccagatattgcactttaacctaccttatccttccttcagtacctggagaggacagcctctggtgctgagtttcctcactaccaccatcactctctccatgacccctgcacacattgctatgacattatttgtgtccttactactcagggctgcttcttgatttctcttccataaacttttgttgaggtttgcactatcaattgcttatgattttttttctcttgaaaagatttcatagttggtctcagatattcatcgaaaaaaaaaaggatggaaaaatcaaatcacatccaatactcccattttacagatgaggaaactgctgaaacatgcccaatgtcatagagccagtcaatgggaaagccagaactaaacttagacttccagactcttgctatgtgaacagtccagcccacaatgctgccgatcctcttataaagtttaagcatgcagtagtaacacattaacaggcataatcagtaatttctaaatgattgagaaacactgacaccggggctcatgtgcatgagatatttcaccagtgcttggattatagatcacaaagtgagagaaagagctagtagtgaggctgggggtggagaagagccaaatgaccatcaaatgaggctgtcttcaaggacacaggctccaagtcttgctgggctctgtcattaatgtgtgcctctgacctcatacgaactcacaaagtggctgctttgtccaaggcatcatatccacatttcaggcaaaaagaaagggaggagcaaaagccaaaaggctttcagagaggtctcacctttctatttaagaaggaaaccttctcagaaattcccacctgcagttcattcaccagatctatgctacttggccactcctagctgcaaagaggttggaagttgagacttttgtttccagctttgataaagtgaagaataggagaaagtgagttggatggtgttgatgaaccaacttacagtacatgcaaactagcctacacaatcactctgttccattatctgcctgattttgtacaggttgatagccttgcctaaagggcttatattacctagtcctttctctttgaacttatttcagttctctctttagccaaacttttttttttttatacccaatatgctcttccatttcaaacctccacacttggtccaaggtccacatggtgaagggcaagttactcctataggcaacagccactgaaggatttatggaaagggtgtgaaatgatcagattcgtattttggaaggactgctgtggagaacatacctgggcaggagcatggggtgccattaggaggctgctagggttatctagtgggggcgctggtgaaatagcagggctggagaaaatagcagggatggagagataggtggattggagaagtgtttcagagatgagataggtaggacctgatcaccaacgtggctaatttcaaagaaatgttatttgcccagtgttttgcagctatgaattcaaacctaggccttcttgttgcaggtccaagggaagatctcatggcattgtctcatggtactcaaagccctgcgggcctctctaaatccccactgtggcaccaggagcctgtgcctcgcagaccgctgaccccaggaagtaatggacaatgaggcgcagctgctgctgcctctctgggtttgtgctgaggccaccttctcggggccgttacaagccagtgcctgagcatgcatgcttactaaggcagactcatttctgggagacatagacctcctccccaacggatgactggctagagaagctccttattaccttgctgaagttctcttagactgcacagctgtctgggatgcttccactcaacctggtttccttcttttcctccctcgcgggtggacttgcatcgaggtctgatggctctcacagccttacctagttctctcctcattctctctcacaacagcatttcccctaataaaatccatgcatatttaattctatcttggagtctgcttcttggaggagcagactaacacaattatgtaagaactggctccagggatcagcttataatcactgacttcctctgagtttgtccacattttttaggcgatggggaagcttggctttaacagtgcctgacctactttgatgcaatgaatttttgcttttttacttcttacacaaaagataaacatggaatgtttatcatttcaacatggaatgacagtttctaaagtataactttagaaagatatactttatcctccttgaatcctaagcatggtgcacaaaagctattttacaacactgtcattagtgatattgggtgtatggccctgtaaagcctccagtcaaaggttttgctaggaatctttgccaaccgaagaagcacttccagaacaaatgccgaagcacagagcagcctttctatgcactctgaaaacctcctcttagctggccttcctgtctttctgggaccagattttggggtcaaagccttaacatttgataaactgtaatctcaaactaaaacagatttctttgagaaaatgagagcaaacacggcctgaaatggtaaaacaaggcacctctcaatatatccaatgtgaaaaccatacatgttggcttccttagtccaaaagttagaatcaaaatgttgatttttgattagcagagacacaaacagcatattcaggaagccattgttttcaagagccaggaagaaaactcttcacttaggataccgtaagaatccttttttcttgggctactttataaaacatacataccacagagtttcaggctctttaaaaacccatctttacactgatctaactgctcagattaattttgaaacaggcaacgtgcagaaaaaaacaacatctaaaaattaaacctcccctctttccgttctaaagtttcatttcaaaagtattaggaaatcttactttaagcagcgagctgatggcgttctccagaactcggtttgagcaacaaacttgagacaacctttgtctggaagcaagtcaagcgcttaataatgcatgctgggatttgtagtttccctgctttcagagtttagtggctccatccatacactttataaatgtatgtgctgccatctagtggaattcaggtagaactatgaattccaagtggaaggtgaaaagtggaaaagcaccttagagcttacttaggatgcggaaatcatttccttcacttcagtctctccacttctctgttttgtttatgcctactatatgcggtgccagggtagacgagattggctgagctggaaactgcgtgtggaagatagcagagcaacaaaatagagggaacccaggtcactgaaaattctggagccttcctgtcacttggcctggattgttttaagggagagaaataaaaaaaaaaatcctttttgtttgagatacagttgtgatttttattttttcatgctcagaatattctaacactaatgcacatttagtggcagaatgccaggagccttttactacactgggaatggggttggggagaacgtgaaacttggatgacagggtggaggcttaaaagggaacatgttaacagcgaaaaaccccagtttggctgaagagaacagagatataaggtcaaaaagaaaggactagatctcatgagccctctaggttaggatagcaacatgtgctttatctgtagtgccagtgagcagagtgattgtgtaggctacttgtacatgtactgtataaattggtttcctcagcacccatccaactcactttccccttttttcacttgtcaaagctggaaaacaaaagtctctacttcatagccttgtttgctgctaggggtggccaagcagcatagatgttgccaatgaaatgcaggtgggaatttctgaggagggcctccttcttaaatagaaaagtaagcccttctgaaaggcttttagcttttgctcctccctttctttttgcctggaatgaagataggatgccgtgggacagagcagccatttagtgagttcatctgaggccagaggcacacattaacgacagggaccagcaagagaaggagcctgcggccctgatgacagcctcaaggcaacaactcctctggacttcttatgtgaggacaataaactttagtgtttttcacgttttttgttacatggagctaagtgatttctaacagtcacaggggataagaacaaagactgtggcgtcagtaagactagagcaagtcccatatctctctctcactagctaagtgagtaaatcacttaaatctctgaacctcttatgtttctcatctgtaaaatgaaggtaaaatagcacctacctcagggatgtggtgaggaggaacgactaagcctgtgaatccatcagcacaatgtttgccacacaggtgcttaatacatgttagtgattcttatgatgaagacattgttggagaaatttaattataatggatggtaaaagttgcgctttttaatgttcttttaaaaactggacttagtttctgcatgtgtctatatgaggtctatggtaaaattgtccctccttgttcattgtttcagcaacttctaatgctggctctaacaatctgtaatcacatctagctttgttcctgctttactaataatgccctttgacttttgaggcttttggaacagactttatgagagttctctaatcaaagccaactccaatgcttcttgatgtagctttcttcagcatccctctgtaatcttcagcaacaatgcttacttgataacagcctaagtcacatggtattgcaaatacttgcttacccattagtattctcagcagactaaatttcttcaagggtggggactatgttttacacctttacattgtgattagctcgtattaaaagagtattagttacttgttttcttatctacaatatgagttccacattggtagtgcctttcagtgcctaaaacagtaattggcagatagtagatgctcattaaatatttgctgagtgaatggcagtttcttaataagtttcctgaatataattctgccaggctctcaagacaatgtttgtgataattaattttaggtgtcaacttgactggatttacggatccccagagagctggtaagcattatttctgggacatctctgagtgtttctggaagagatcggcattggaatcagtgaactgggtaaggatctacttcacccaatgtgggcaggcactatccaattggctgagggcccagataaaacaaaaaggcagagaaaaggtgaattctctctcttccggaactgggacatccatcttctcctgcccttggatacctgaactccgaccagattctcaggccttcagacttggactgagccacgctcctagtttccctggctctccagcttgcagacagcctatggtgggacttctcagcctccctaattgtgtaaaccaattcccctaataaacatcctctctctctctctctgcatatatatatatatatatttttttttttttcctcaagcttcagtggggttacatcccaataagcccattgtaaattgaaaacattgtcagttgaaaatgtatttaatatacctaattcactgaacatagagcttagccgagcctacttaaatgtgctcagaacacttgttagcctacagttggataaaatcatttaatacaaagcctgttttataacaaggtgttgactgactcatgggatttattgaacagagtacactgaacagtgtcagttgtttactcgtgatcccgtggctgactgagagctgtgtcttgccgccactgcccatgatcacagtagagtattgctatcttatgaagagatcagaattcaaagtaaagttttcactgaatgcgtatcgctctcacaccatccctaaagttgaaaaatctcaagttgaaccatgacaagttggtgaccatctgtgtatattctattggttctgtctctctggaaaatcctaagacagattttggtaacaggagaggttctagaggaacaaaattttaaggatgagtttcctgagttggttttggggttcctggaattggctcttagtctgattagatttgaaaatgctaaaggctctactctttgagatggggtcacactcttgaacaggttggagtgcagtggcaccatcatagctgactgtagccttgaatacctgggctcaggccatcctcctgcctcagccctccaaattgtttttttttggtagagatgaggtctcagtatgtagcctaggctggtctcaaactcctggtctcaagtgctcctcctgcctcagtttcccaaagtgttgagattacagggatgagtcactgcgcccagcctggctctccttttaatagtacagagagcactgattgtccaagaaatgaactgttcatagaggtatgcaaaatgtctgcattggatactcctaatcaaccacttcttagaggtgaggaacttaagtgactctatatataatacttttttttttttttccgagacagagtcttgctctgtcgcccaggctggagtgcagtggcatgatctcggctcactgcaacctctgcctcctgggttcaagcgattcttctgcctcagcctctcgaatagctgggattacaggcacacaccaccatgcctggctaatttttgtattctagtagagacggggtttcaccatgttggccacgctggtctcaaactcttgaccttgtgatccgcctgcctcagcctccctaagtgctgggattacaggtgtgagccactgtgcccggccctataatactttcaaatatttatggaaaactaagaaatataccaatgttggttggttgcttctaatattgttgggcaaaattatttaaaaaaaaaaaggatgacttcagggattcaaattcatggctcaagctccacataagtaacctaagagcttataggcgtgccctgaaagaggatcttctctcctgtagacatgaggctaaaattgctgaaaatcaaacaccagtcttcatcatttgattggtgcaattacaaaaggcctcagtgtgtctactggtaaaataagccacagtgactgggagagtgagattctataagttgggatggggacgtgtgggaagaccctgaagccaggaacattgagtttttttttttttttttttttttcagtttcaccctgttggccaggttggagtgcaatggcatgatctcggctcactacaacgttgacttccagggctcaagtgatcctcccacctcagcacccccgagtagctgagactatggccataagccaccatgccaggctaatttttgtattttttgtagagacggggtttcactatgttgcccaggctggtcacgaactgctaggctcaagagtcccacacctcagcctcccaaagtgctgggattacaggtgtgagccaccatgcctggccagttcctacattctgatgagtttttttttttaccagctgtagtggcctctccaacctcattggggttggtaatggcctttccacctttgtctgaagggttaaccctgcattgcctgaggaaataataatggcctcccctgaggcagctgccaagcaagacaatgctgattctcctcaggacctacccccaccacccctctatgctcctagacctataactagactcaagtcccagcagatccctaatgtgaggtacaaagtgtggcccatgaggagctgcatcacaatcaaaagaaccacttgagttttctaacttatataagcagaaatctgagaaaaatgtgtggggatattaagggtgtgggataatggtggcagcaaaagggacagagcttatttgaagaaataatggccacaaacttcccaaatttgaggaataaaatggacacccaaattcaaaagttaagcaatattctactaggctggctacctgacaactagatttttaatggctttaatgtagttttatcaatcaggtaaacaaccactactttgggttacttttgttcagtggagaagcagacataaagaatcaaacctgcaggcatgttagtgttttgtttggataagggtggaaagcagaagacagactctcaaggtacaggtctgggggaaaagattttaggaagggatagtttccccttagtctttgttaattcctttggtggtatgttaagatacggagaaatatccaatccacagactttgaaatactagatatgatgcaatcaataatctctccctttgaatgaatcttaccaaagagccgagaatgacttgaaatcactttacctctgttctataacctaatgcaacttgttttaagtggtttttcaaagtcatatggtataaaagtaatatcaaatatcctctaaaaccatagttcttagatttttacaggatcacgggcccctctaagaatatgataaaacaaagtataaaccccagtatcccctccccccaaataaatccacacaaaaaagttcataaaaaatttcaaaaattttacagattacaagaagtccatccatatatgctttatctatctgtggggactccaggtttagaaaactttactttgataaaaactctggtactgtttccttatgtctacaatgaagaggtagaataaatgatctataggttcctccaggctgggagtgaggggcaatgaaaaacaaagtctataataaaccaaccaatttagagagtttgtatagggattgggataggtaggttaccagaaatgtgagaaagaacttctgtggttattacagtaaaaggaatattagaactggaaagttaagaggacatagcctctgctatcctttaagaatttaaatccagatccagaaaacttgtgtatattttcatagcaaaatactgagtcaacaagagagactacctcaccaagaaaccattaacattatatagaagagcggtgattcagaactactaaacatttattgaatgtgtaaggtattaaaaacatttacaattttgttaataaaatgatgttttatattaatgtatgtattatgctttggaatatgctaagtcatgtagataactttacatttctttcaataactttattctttacaaaatatacaaataaataaaacaattcaacttttaaaagtattaccatatgcaagaagaaggtattgctatcaccattctaaattaccacaatgcattcatttcctgttcccttatctttcaactctagtggcaaagtaaagactgaattgaaattaagctgcactacaacatcattaccagggatagacacataaacaaagtcatttccaaataaggaatgctggatctccagagaagtgacaaagaggagtctactgagttttgcactcaggcacatccttgcctgaggaggcgtgccaaggacctggctgagaatccacactctctgctcctgcattttgcacctctgagaaagaaaatgaaaacaacattcatcctattacaaaaatacacaaaaaccaagcacagctggaagtggaaaggaggttaagacaggagagatgtgaagaatgaaaaatggcaacgtgattcaccgtgtttggtcatgaagatggtgtatttcacctcagagttggagaagtttactccccattttgtcctaaaatgaactattagacaaaccatagttaaactgagaggtaataaagttttatttggaattcttcaatttgaaattcaaagtgaatcaaacacgggctgattgagttttcttttgtcctgtttttcaaaataaatggtgtgctaaacaaatagtattttagagaatatttaatcatctttggaaagctttctgtgagcctttaaaaaggactttagctgcatctatttgcttataaacaatatttattttacaattattatatttataaaagtaaatctaccataactggtcttggcaattaccttagtttaaggtaatttagattaccttttataattaaaagtaaaaactcacatttatttttttaaagactggtattaattcaagctgggactatctcatttaattctgaattggtcagtttttgatttatgtattcttctaggctactcttttatttatctaaaaacagtaccagagagatccacatattaaaaaaggactcaaacatttttatttgcagtttgatgaattcacattatgcatatgcctctggcactagcagacaaaatcaaaaggtgattacagctgggtgtggtagctagcatgcacctgtagtccttgatgcttaggaggattgcttgagcctaggagttcaaggccagtttgggcaacatagtgagagagttccatgcaagtgttagctagccaatagaaggtccttaaatgtttgttaaatactatttaatgaagagaatatttcaaacatgtttttattccaaatgtttctgtgcctacctatctccctaagaacacttttagactgtcaacttgatctaattttgatgtagttgatgagaatggatagattttttcttaatcacaaagtagaggtttataaactctggcaaatagtgctcaaggttttaaatgatttggcaactgcctttcttactgtacaattttgttgctttagatttctacagttgcataacagggtacctctggtagggtaggcagacacactgtcacaaagggctgtgcacagtagatgctatgtggtgagaaagactacaagaaatgccgtgttaccgtttctcctgcaagtccccccacttctgtggacaacctccatgcagagctgggggtgatccttgatacctccccactcctttgttcaatcaggtgcctggtgttgctgattttactccaaaatctctcccgtcggtctacttctctccttctctactccaagtccacactaccatcatgtcttgtttagacaacagtctaactcctgctcctattatttgctggtcaccttagagacgaggtgatgttttcaaaatgtataactcatgttctcctgccattgcttaagatctttcaaaggcttcctctacacaataaatgaaacaattcctttatataatttataaaagtccagcatttctggctcttatttctctctttggcctcactgacttcacccacacaagcttgtactcactgtgctctgaccacaccatatttctttcaactcttcccctggtcatgttcccacctaccctaacgctgttgctgttccatctgcctgagatgtttttccctctgctctttattaagataactcatgttaaccttttagatctgatctgtttccttcctcaatactcctcaaatacttattatatttctcatagtcttttgtacttgcactgctataatttcacttttttttttttttaatcacttgattactgtctgtatcttccatgagaattaagctctatgaaggcagggatcatgtctggttttgcttatcaatgtgccaccaggatctaatccttaacacatagtaggggctcaaaacaattttattgactgaataaatgaataagtaaatgattcatctattatctggcttgggtaaagtaaatataatgctattggatattttggtccattgaattgataagacttttcagtaaaagttgctttttagggtagtatcttcatgtccttgagaaagttgcttgtctctctttggacgaaactaaaggcttaaagggtagactaaagacttcacttggggtaaaagtgaattgcacttcactgtgtggggtgccttggagaaatcaactttcttacagagtcagcaaatgaagcctgtcattgtagcttactcaactaaatcatctcttatctaaacttgccctttgggatcacatattaatgataagttccaactgttaccctctgatttccaagtaaccagtatatttacttacctggacaaaggcctaaacttgagttatcaaaatagcgaactggatgaggtgatggtaaagactttgatcggctatcaaaaaaacaagattttggtgattcctttggcacaggatcttgtaaattccgttccttgcattgagagggtgtaatttgtttctttttagaagctgttccagtcactttaggagactttggagaattctcacaagttacttgtttgtgagcctctcttttaagggttctttccttccaagttttgacctcattggaaagatgctgattattgcttaaatgtgggggaagaaaagagagactgtaagacttcttgattcttaagatgtattcacatttatatttaaaaattaaaaataaattgtgatgaaatatatataacataaaatgtacattttatcacatttacattttaatttcaacctcatgcttcctgttttgactattttcaaagttcagaaaacaaaatggatctatataaattgaataatatagtaagtttccatgatcatggagtcttgaaaagaaagctctaagtacaacattaggttttcaaatgaatcaatgatataatccagagtggcttatctattgatgctttgccacaataatttgacaaattagtctcctggatagatgaatctttgatgtacctttcttactgtaaaataaatattacactgtgcttttctagttacaatgctgcttcttacaggagatgccaccagcatttatccagttcctccggagagaaacctgggaagcaatcctagagacctcactctcttttattttaagtcatccaagtctcttgatacactctcatcctatctatcaaattcacttccttgtttttatccctattggggccaagctagtccatgctaaaattactttttgtctgaactaccataaacacattctaaaatttgatccctctataatgctctagcagccaaagatgctatatgatctcatcaggccactagcttaaaaccctccagtgcaggtaatcctgccattacatttaggataccactccatattcttcaaaatgaactataagggcccatgtaatctgaatctagttacctctggcaccttgtcttgcactttactctgtctcattctctacattctggccacactggatgtctttcagtcccaccaattagttattcttcttaactcaaagcccgtgaacatgttcccctggcctggaaaacttatccttcttccctcatctagcctaattcctactcatttttcatatctattctgatataggcataccttggagatattgcaggtttgtttccagatcactgaaataaagtgaatcgcggaaatcttttgggttcccagtgtgtatagtagaaagataagtgcaataaaacgaggtatgcctgtttgttggcttcctgatcaaccaaccctccacccctaacacctagataacgttggatctctctctttcataatataacccttttataatgtcctttttgtttttgtttcttttttaatagcactcatggcagagttagttatttgtaaaattatttaacgcttttttttctactgtatcatagtagagtgcttggggaaaagattctactcttccacgtggtagaagccgaataatttgttagatctgtttataaagtaaaaagcctacaataatggacgtaaggagttcctctctaagtaaagcctcactggcttgggtatatggacttgtggtgtatttcagctgccccctcaaaggtctttgtttctttcctatttcttgccttggttaagaattggtcagttgatagacagcaaacattggaatagtgctaccatattctcattttttaaaaaagatacttattacctgagctctaaaaattactttccccataatgactgaagtgttaccacctgcaaaaaatacgtgcatataccatgtccctacatatatgtaatagccgtaagcataatatccgtatcatgtaagcagatcttaccttaacaattcattcttttgttttattagctgttcattttgctgctttaacttagaaatttctttttctagccttatatgttcacttttcaaaataagagcttttgtgttttgtacaatgccgctgccacctccacaagttaagggtttatttgaaggctgaggatcagtatgttctgatatcactgtgggaggaaaatatacaaataggtgataattttaattgtctccaaagttcaaaataaaggaaatactaccaagtacaataagccattatagagacccaaacagctcaagtcttatttccctggaagtcacccttgacttctgccttctaccttactccctctgcttatttgaccaaccattaattctatgcctctagaatccccctcaaccaattccactaacatatcctgatcctgatcaccaagctctttcaccctgactgcagcaatagcaatcctctccacttactgctgtcctttattgatctatattttctacatcagttttcccctgaagggcttgttacaacacactgcgtgtgtggcggggaggtgaggtagggtgggagggccaccccgtcattcagtgcattatatgtattcaatacatattattaactaaatatatgttacaataatattaaagcacatattaaatattctacactatgtgtgtaaagagactgtgttttgtaaattgtaggcaaagttgcacaaaatgtgagatagttatgaagtggattaatccattaggtcactgggaattcacaaaagagggatagtgtgtgtgttgggggtgattcttgatgtctattttattttgaattcatctacactatgtacctgaaagtcatctacaaatcaagaataaatatcctcaaccttctgaaacaaagaatcctcacttctatttttacccctttaagttttctcggtaggtgctgtggttatcctgtaacagacactagggaagtttaagctacaacaggtactaggtaacaccttaacacctttagcaccatctatttttggaaacaagtggactataatacaagcaaatatcatcttatgttttgcttagtatttggaattttcaatgtgtttttacccacaactttcggtttgatctttatgtacgtgtgtgtgcgtgtgcatgtatataaataagtgtatatgtatatacacttttttaaaaaagacacttattacatgagctctaaaaattactttccccatgactgaagtgttactacctgcaaaaaatatgtgcatataccatgtccatatatatgtgtgagcataactatatatatgtgtgcacatgcatatatatgtgtatacacttatatgtatcctgtaacatataatatacagaattctatatattctgtaaatatataagtattatatataatatatattgcatattgaaaattccaaatactaagcaaaacataagatatttgcttgtactatatacttataagtgtatatatatatacacttatatataagtatatatatgtaagtatatacacatatatacatgtgcacgcacaaatatacacttacatatatatgtatatacttatatacttatacatacatatacttatatatacatatctatacatatatacttatatatactaagtatacttatgtatacatgtatatatacacatatacatatacatatatacacttataagtatatatgtgtatgtatgtatatatacttataaatgtatacatacttataagtatatataagtctgtatatatacttgtaagtatatataagtggatatatacttataagtatatataagtctgcatatatacttgtaagtatatataagtgtatatatatacttataagtatataagtgtatatatatacttataagtatataagtgtatatatatacttataagtatataagtgtatatatatacttataagtatataagtgtatatatatacttataagtatataagtgtatatatatacttataagtatataagtgtacatatatacttataagtatataagtgtacatatatacttataagtatataagtgtacatatatacttataagtatataagtgtatatatatacttataagtatataagtgtatatatatacttataagtatataagtgtatatatatacttataagtatataagtgtatatatatacttataagtatataagtgtatatatatacttataagtatataagtgtatatataagtgtatatatatacttataagtatatgtgtatatatacttataagtatataagtgtatatatacttataagtatataagtgtatatatacttataagtatataagtgtatatatatacttttaagtatatgtgtatatatacttataagtatatataagtgtatacatatatatgtatatattagaaaatccttcacagcagttctgtttattctcctgtaaaaaagtatgtatgagtatataagtacatatactcgtatatatacttctatagacttataagtataatacttctaattatataagtatttactatatatacttatatattacttatatatattacttacatattacttatatataatatataacttatatattacttatatatgttatacttatatatattataatatatattatatataatatataacttatatataatatataatatataagtaatatatattttatattacttatatattactcatgtaagtaataaagaagtaatagatatattacttatatattatacacttatactatatatacttatatatttattatgtatacttatatatgtataataagtgtatatatacttataagtgtatatatacttataataagtatatatataagcatacatatatgcttataagttagaaggtcaggtgctaaccccacgatttcatatagccattgagatctgcatcttagttcagtacttgttctactgcgtaaagctatctcaagtactgttcaagcattctttcttttcaaatggaacatgacagacagaatatgaataaaggtagtttgaggaatgcatgtatattgagaaatttgaccaacagatctaaaaagtatctcagataaatttcaaagacctttgcaagtaaatattaacttggtatttttagtttcaagaacaaacagaatagtatttatttttactgtacaccaattataacttattagatgcatacaattaaaatctacgaagacatgtgtttcgttttattgggaagcataattccatgttgatatagtataagtcattcctttattgcctgaaggtatcttcactaataggtaaagatttgacaatacaaaagcagagttcgtatttttcaagaatctataatggataagcatctaagattacaacaaacgatgtcacaagatatctggaaatatggttccaataaattcatttaaaaatagattagtggccaacttctgtttactctcgactgtcacatactacataatattagtcttcaaagtctgttgtgtgttgagaagtaaaatttcatctgaaaatatctgcattttctacttacctgaggtatcttgggcctgttgacttcttctgagattttctctcaatagccttataacttccttttgatattctacagtggcttttgtagcactgattctaacaaaaacaataaaaatatgtaaaaagctcagcaactgattttttacaggagaataaacagaactgctgtgaaggattttctaacacatcacattgacataatgcctgtaagtggcagtagataagccctcgtgatacctctctggtgccatgtgccttatggcattaatgccatcaaactagaagcattctgcttgggtgcagggacagtccgattttcttatattgagaaaccccagttcttttaaagcttctggaggcctaattcattgtatattgaacaaaattataattacctaattattttttaccatggggtcctagaaatatttgaaggtataaggagcatgaaagagaaagtgcagctttatttctgtatggtcaggaaagcaaaccctgactgcagctctggtctaaggtgctacaaaggtcaaattctgatcactgttctccagtagaaagagacattttatgagttgttagtttacgcattaatcagtaacgataaattataagactttctgcctttcttaatgactatgaattatctgtatctgctgaccctattctttacttttcttttctttttttttttgagacgaagtcttggtcttgtcccccaggctggagtgcaatggcgctatctcagctcactgcaacctctgcctcctgagctcaagcgattctcctgcctcagcctcctgagtagctgggattacaggcacctgccaccacgcctggctaatttttgtacttttagtagagacggggtttcaccatgttggccagactggtctcaaattcctgacctcaggtgatctgcctgcctcagcctcccaaagtgctgggatcacaggcgtgagccaccgtgcccggccctgctgaccctattctacaagtaaaattgtttttataattaagaatctaatagatctatgtttcactgaaaccaatagactgcttagagagcatgaaaattccaatgctacttcctgggcaaaataagagatcattaaatatttattcaagatttatataggaagaatgaaaagtgttaaaagccaggaagcatcctaacaaatcctctaaataaacctttccttattgattatgaatgcgaggaccagagagaataaacagtgtaaggtgatgcattagtaagtgagaacatatttctttttttttttttttttgagatggagtctcactctgtcgcccaggctggagtgcagtggtgcgatctcggctcactgcaagctccgcctcccgggttcacaccattctcctgcctcagcctcccaagtagctgggactacaggcgcctgccaccatgccggctaatttttttggtatttttagtagaggcggggtttcaccgtgttagccaggatggtctctatctcctgacctcgtgatttgcccgtgtagccctcccaaagtgctgggattgagaacgtatttctacttcagtttccttgactctctttaatgttcttttcattatgctataccacaaagaatttaggcatgctgttatgtataatgctacctataaataaatcaataaaaagaggatttgctcttgggccctagggaactataaactaaaaggaaatataatcttcacacagaaacacagtaaggccaacaaatgaaattaagagaaccaacagaagccttagtaaaactgctaaatacacacacacacacacacacacacactcttaatgttcactttcaggcatacaaaagccacttaaaattgtttatattctgtatgactaagaagtgttcaaagacacagcgtgttaattgatcagaattgtgtttagttttaaaaactttgcatatgtaatgagaccagtatatttaaaatctatggatgtgtacatttttaaaaaaagagctgtaacaatattttcataaattatattttaaaaagttaactaatgaaaagtatatgtagtttaggaagaaaatttaagctattaaaatcacattaaattaagacaaatacgtactccttttcaaattctttggcatttttcattttctctaggtctattttcacaagcttcattttgagatcttcaatttcttctttatatggcttagctcctaaagcaactttgtcctaaattttttttagagaaaataaaaataattattagaggcgcttcagtttctccagttgtaaagaatggttagctgtctttgctctaataaggacattttaaaatagcaaacaattccaaatatatgaaaaagcatcaattttaactgaataactagatattgatatgaagtctatttgaagctaatatgcaattagaaacatgattttttatttggagctatcataatatgcaattagaaacatgatttttatttcttaaaataaatattttttttctaattgaaaatacctacaaaatgaaaaaagttggaaataatgaaaagggtggaaaaaggtaaatcagaaaatgaaacaaaaagatgttggagcagtgatgtaaacatcaaactagaactaaatttaagccacaaaacaaagcattactaagtatattttgtactgaaacagttccatccagtgattcaaaacactatattttacagcagcaggtttccagaaaaatggaatggaaaatactgggagttcctacatacccagtgtcccctattcctttttccccatattaacatcatgcattagtatgctgcatttgttataagtgatgaatattgatacattattattaaaatctataatttccatgacagtttatttgtattgtacattctgtgggttttgacaaatgtaaaatggcacatgtccatcattacagtatcatacagaatagtttcactgtcctaaaaaaccccgtgctttgcctattcatccctctcttctccattatccctggcaactgtttatttttttactgtctctgtagttttgtctttctaaaaatgtcatatacttgaaatcatacagtatgtagcctttccagattggcttctttcactaaccaatgtgtattaaaagtccactcattttctttcctttttttttttttttttttttttaagacagagttttgctctgtcacctaggctggggtgcagtggtgcgatctcggctcactgcaaccttcgcctcccgggttcaagcgattctcctgcctcagtcccctgagtagctgggattacaggtgcttaccaccatgcctggctacttttttgtatttttagtaaagacagtgtttgccatgttggggaggctggtcttgaaatcctgatctcaggtgatccgcccgcctcagcctcccaaagtgttgggattacaggcatgagccactgcgcccagccctctcatttcttttaattgctgaatactattccactgtatgaatgtaccagtttatccatttacccactgaaagacagtcttagcaattatgaacacagctgctattaacatacacatgcagccctttgtgtgcacatatattctcagctcatctgagtaaataccaaggaatacaactgctcaatcatacaagtatgcttagttttgtaagaaactgcgaaaccatcttccaaaatggctgtaccattttgcatttccactagcaattaatgagaattcttgttgctccacacaccagcatttggtggtgtcaatgttttggattttggctattctggtaggtttgtaatggtcgattattttaatttgtgattctctgatgacatatgatatgaagcatctgttcatatggttatttgtcatctgggtcttttgccaattttaagattgattggttgtttcctattgttggttttaagagttctttgtatattttgtataacattccttcaccagatttatcttttatatacagtttctgccagtctgtggcttctcttgattctcctgacagtgtcttttgtaaagcagaagtttaagtctcaataaaatccaacttaccagtttttttctttatggattgcacttcttgtattatatcttaaaaaatcgccaaacccaaggtcacttagaacttctcctatgtcatcttcttggagttttctagttttgcattttacatgtatgcctatgatctattttgagttaatttttgtgaaaagtataagttctttgtctttttttgcttgtggatgttcagttgtctggcatcattagttgatcagactatccttttcccattgagaagcctttgtttccatctctcccagaatagaaatgagagttcttaaaatagcttacagggcctttatgatctggtcctctgctacttctcaccttattttctacctctatcctcttgcttattctgctctggatgcacaaactttcttgttgttttcagtttgctatttcctttgcctggaatatttctccctggctacacagttcaccctatcacatccttcagatcatcttactggtgtgacattcctcaactcctgtatatacaatcatctctcttcccacacatgtccactttcacccagaaccatgtacccccttgtctggcttaattttttccatttcacttttcaccacttgagatataatatacctcttaatatatataacatatataaaaatataccttctatgttttacatttttaattaatattctgtctccttcaactagaatgtaagttccttgatggcatggtctttgttttttcattggcctctagaacagtgagtgacacatagctggtgctcagcaaatatttgttgaatgaataaaaactgtgatcaattatttgtaatattaaaaaattacaacattctaaaactttacagttgaatttttttagtttctagctataacaattgttgaaaaaacaaatttaattttttcttttgcctctctgctcatgtctcactgaatagaccagaatttttagaacaatgttaaataatgaataaagcaggcattcttgacgtgttcctaattttaactggagagaaaagacactggagcagaacagcaaatttaaatatgccaatttggatcagactcgagtagaagaaatgtgggaagtggctggaactaaaacaagagggagctgtaagtagtgattaatgagtgtgtgatttgtctaatgacattcaagttgaaaaacatttcagttacggttcttccccccaaaacaggtcagattcagcccatgggatatcaggtgggactcagtaacagaggcagtaagtaggaaaaaaagaatttaaaaatttacttatctaatagtattatatattttgataagcaatttttgaaaaatgaaaaaatatacactaaactataaacaacatgtatatcttaaaaattattcttccaacataataaaaataatattttatatgacaatatgctcctacatttcacttctaagttaagctgcttctgcttgagtactgaacttcagaaacacataggtaacagtaagttgttgtgagagggaagaatagagcacaaggagatttgctgaattcaataggttaaacaaacaaacaaacaaacaacttttatttttatgtttaagttacctgaagtacttgaattgtctcttttgttttttcaaggcatttatttgattcatgaactttggcttgaagttttgctattatgtcattagtcacctcaagttctttctgcatctttataatcttgctttccttatgcatagcactttctttagcttcatgcagtgaattttccagctctcgaattttctattagaaaaagcacacattcataagctctatcatcaagacagaatcacagtatagaaatttgagacagagatgatcatatttagatattgttaatttttcacagattgtattaacaatggatagaagagaggccaaacatcattcaatctacagacatgttatttccctcatttagatgatgatttttggattgaaaatgtcaaaggtttatattataatctgtctgcaaattcttaaaacatgcagttaaaaacagcacagtggttatgcgatttattagttagcatagtgctaagcatattaaataggcactcatattttacatgaacaccacttaaacaaaggacattggttaattgactctctaaagtaatatatatttatctttccctttaattttattaattttttttttttgagatggagtcttgctctgttgcccaggctggaatgcagtggcgcaatctcgactcactgcaacctccacctcctggattcaagcgattgtcctgcctcagcctcccgagtagctgggactacaggtgtgtgccaccacgcctagctaatttttgtacttttagtagagacggggtttcaccacgttggccaggctggtattgaattcctgacctcaggtgatctgcctgccttggcctcccaaagtgctgggattaaaggcatgaaccaccatgcccacccttattaatcttaaatagaaaaacacaaatatgtggaaaaaaattcaaagacatataatgaagagtaagtctccccatctcagacccccagttgaccctgaagcgatgactactaaactttttcaggtgtatccttccagaaattttctatctataaccaaatatacatgaatatatagtttctaaaaatagtatacacacaatatactaaatatagttctgctttattttaaaacttgagaacatattttttccagatctttccattatcaacacatagatctctcctattttttgttttcatggacatatagaatctcatttcataaaggtatcatataattcacatgtacacactcttttttgtttttggcaaaatgtctggatttttgggggcccatttagaattcatttttgtttaatgaatgagataggaatccagccttacttttttccagatggctatcctgttgtatcaaaataatgcactaagcaaaccatcttttctttctttctttttttttttttttttgaggcagtgcctcactctgttgcctaggctggtgtgcagtggcatgatcatggctcactgcagtatcgatctcccaggctcaagtaatcctcccagctaagcctcccacatagctgagaccacaggtggatgtcactgcacctggataatatattaaaaaaacacttttttttttgtagagacagggtctcactatgttgtccaagcttatcttaaactcctaggctcaagtaatcctccaaccttggcctcccaaagtactgggattacagactcacacacctggccaagtaaaccatttttttttcccactgaattgaatgttactgttatcatacacctgtactaaattctcatacttaattgggtatatttctgaaccctctattctgttccactgctctacttgtccatttttgcatcaaacttgtctaatgatagtagcatgtattttattatctgctagactattttctttggtcattgaagattgaccaactttccttttgcttctttaaattactatattggtagatggatttcatctttcctctattttatctgtagcagctgactgaggtctgtaatgccctacaaatcaaaacactgtatactagtgatctagttctcattaagctggtggttgatgttttattataagtatttattttggtaaaaatgataaattgtaatttactattgggttccctacaagtcgttttgtgtgctaacaaaatacaacattttacgcatgttgttagattcccgagtaagggtagttaataaggtaatttggttatcaaataatgtactggttcttagatacaagttaacctgcgtaacaatcttgttatattttttaacctcttatatttttattgtgattataacattaagcaatattaaatacgctgatgataatgagaaaagctgaattgctatttctctccaagctaatatttgttctgcatacggacatagatcacagttcaacagaaagtcacataatttggaaaacttttgtggtaattgtacgttaactggtagtaacttaaactatagtttatgaatgtaataatcaaatgaagctacaatttatgttttataataatatcttacataatgtctagctttataattagtttagttgaacgatagccatagtagaactactagtaaaaatcaagcccatcacttacaaaaataaatgtgttcatgttcagtaataagtaaatactataattttgctctaaactctgtgatgaagctgcaaactgaagaacattttataagaaattatatacctctgtggttaactgtgtagctcttgatgtaacatgaggattcttattgtcttgtgtggtaggattaacctgggcaccagatgccaaggaagtcttcaatgtttggtagtttttaaatagtttttcatttttctctttcagtgatttcaggtcctgttcccactctttggatatggtagcacttctttcctcaaactctgttgattcattcattatggcctattgaacagtaaaataccattatagctctaaaacgatttatagtagtccccacttacctgcaattttattttccatggtttcagttaccctcagtcaaaagtggtctgaaaatattaaatgggaaattccagaaataaacaattcacaggttttgaattgcacatcattctgagtagcacagtgaaattttgagtcatcctgctcagtcctgcctgggatgtaaatcatcctcttgtccagcatacactacttgttcacttgatagccaccctgattatccgattgctgctgtattgcagtacttgtgtccaagtaacccttattttaattaataatggccccaaagcacaagagtagtaatgctggcaatttagatatgccaccgtgaagctgtcaagtgcttcttgtaagtgagaaggtaaaagttctcaacttaataagaaaaaaaatcatatattgaggttgctaagatctatggttagaatgaatcttttatccgtggaattgtgaagaagggaagagaaatttgtgctgtttttgctgtagcacttcagcctacaatagtgtgtgataagtgcttagttaagctagaaaaggcattaaatttgtggtagaagacaagaacagaaatgtgttccagttgatgacaatgtgttgtaccagcaagcattgagcatctaggaagacttcagcaagggatcccctgaaaaaagtgacaccaagccctttactgcaagtaagatttattcatggattcaggaatacagaaggtcaatagtagtctaagactatatcaaaatgtctaggtcattcatattccttcatcttatcaggtaggcactgtatcatctcacatcataagaaaggagagtgcagtaaaataagatattttgagagagtccacattcatataacttttactatagtatattgttaaaattgttctattttattagctgttgttactaatctcttactgtgtctaatttataaattaaactttatcataggtatggatgtatagaaaaaacagaatacatagggtttggtaccatccatggcatcccctcgggggtggggggtcttgatatacatattttaaaaaaacttcaaaaaaccctagaattctaggacagtgtatatgctgaagttcattatttagaacattctaaaacagtactttaaaagaatgtgaacattctttgtagtttgcatcagtttctgaaatttcagatgttggatgtggatgatgacaataaaatgaataatgactagagaggattcatattgatctgcaagatgataatctcactttattagatttgtactaacatatgaagagaacctgaagaattatccaggttaaaatcattatatatgctatggctgataatgaaacattaactgatatctaatagcagagcacagctagaaacttaacaattatctattgtcctgcttcattacaaacctcaatgttaatagggaaaataactcactgattgttggtaattaatctgaatatcttgtatttctgtacagggaataacaatactcttttatattgaaggctaactaactctgaaattattgatatcttttttacttcctaattcctgcagattgtactttctgctctcatcatgaatgccccattagtctcatccctaacttctttgtggctttgtggtcattctaccaggctttgtggtcattctaccagatcttaaattcgtcgtgttcctgacaccctggacactccttggctctggactatgcacctcacaccataccaagttattaatgcctactcttatgtgctggaagaagccacatatacatgctgatccacatagtagaaatccctgctttctaatcacaactgggtctccagtattacaagaaaaacaacaaattacaaatagacatgaccttatccaaacattggttttgtgcctttctctactgattgtggacttctttgttttttcttgaaatagccaactgctatttggctagctctgactaatcaataaacaggatgaactttccaagcgaaaactttttaaaaaaggcattgttccttatttcaacaagattccaatatgatttgcagatgaaattaaattgtcagaaaagaactatccaaacatatgaactataaaatgtattttggaaactataatattaatctagctaccattgctccaatttaatataaataagcaatcttttgaatattacatgttttaccaatgaaacagagaagggattacttctgaaagcagaatgaatactgcaattacttttgtacccaccaaataccaatcactgaaatgtaaaacaagttaacaaactggtcttaagcaatgttggtccttatgactcagtacatttgggctgatcaccttgggaacaatgattaaaaaaaaaatcaaaattttggaatttctagtttagcattttaggtgtttagaagttgccagtccaggacgggtgcagtggctcacacctgtaatcccagcactctggcagtccgaggcgggcagatcatgaggtcaagagattgagatcatcctggccaacaggtgaaaccccgtctctactaaaaaaaatacaaaaattagctgggagtggtggcacgtgcctgtagtcccagttactcgggaggctgaggcaagagaatcgcttgaacccaggaggcggaggttgcagtgagccgagattgagccactgcacactccagcctgggtgacagagtgagactccatctcaaaaaaaaaaaaaaaaaaaaaggagttacctaacaaggaaaaagcaaaacaaatgaaaaaaatccacaactctgcttagatccatcagagaagtgaggtcgcagggcaaagggatgctccccaaactggagaggcagagaggcagatacagagaattacaacttagagcagaaaccctttgcaggaaccagttatggggtaggaaaacctgaactgcaatgatgaattattggagctcagtgtggcaactctgagagttaaaaacttcggagacctagtcatacagtggccgccacacttttgtattttaccttcaggagctctaccaagtcatcacagttaatattggagaaatccctttgtgagtctggcaggagaggagaaaaggaaccattttaaaacaaaacacagcattttttttttcttaaggcctgacctcagcagaaactatttcaccagagcctaacatgctggggttttgtcagggcctaatatatctggaggagggggaaatactaagtttcagctggctcttgccttccatgtgaaggcagggaaatatactccgcctgccacccaccacacacaccttgccactacattactaaaggcctatttgctacagttacttttacccagtaaatcatgcctgcttttcagcaaaaaaaattacaagacatactagagggcaaaaaacacagtttgaagagactgaataagcatcagaaccacaggcagaaatgccaggaacatgagagttatcagaccagaaatttaaaaaaaatggattaatatgctaggggccttagtggaaaaagcagacgacttgcaagaacaaataaacaatgtaagaagaaacatagaaattttgagcaaaaaaataaagaaatgctagagatcaaaaatgctcttaagagaaacgaagaatgcccttgaagagttcattagcagactggctgaagaaagaaactcaacttggaaatatgacaatggaaacttccaaaactgaaaagcaaagagtaaaaagactgaaaaaatccctaaacaacatcctagaagtgtgcagtaattataaaaggtgtaatgtatacataatgggaataccagaaggtgaacagaaaaagaaagagcaggaatatttgaagtaataacgactaagaatttccacagattaacaacgtacaccaaaccaggaatccagaaaactcataatgctaaacgggacaaatataaaaaaaaaaaaaaaccaaaaaaacccccgaaaaaaaacccccaaaaacaaaaaacaacatctaagcatatcatattcaaacttcagaaaaatcaaaggtaaaaaaaaatctttgaagaagctagaagggaaaaaacaccatacctataggggagtgaagataagaattacatctgacttctctgaagctattcaagctagaagacagtggagtgaaaaaacatactaacctataattctattccatgtaaaattattcttcaaaagtaaagtagaaataaagactttctgagacaaacaaaaatggagggaatttgctgtcagtagactggtcttgcaagaaatattaaaaagaagttcttcagaggaaaggaaaatgatatagccagaaactcagatctacataaagaaaggaagagcacaagagaaggaataagtgaaggtaaaacaaaaacttattttcttattcttaactgagctaacttatgtatgcttatgaataagtgaaatgaataacggcaatgatacaatggatgggagggagaaattataaatattttgttattataaggtacttatattatctgtgaagtggaaagtgttatttgaaattgggctcagattagttgtaaatggatatattgcaaactctagagcaaccactaaaacaagatagaagtgtagttgtatgctaagcagagaaaatggaatcataaaataatttaaatcataaaaggcagaaaaaatgtggaagacaaaaataggtacaaagaataagggcaaaaaatagaaaacagaaacaatatggtagatattaatccaattatatcaataatcaccttaaacgtcaatggtctaaatacaccaattaaaagaccgactgtcaaagcagatcaaaaaataagagctgactgtatgttgtctacaagaaacccatcttcaatataaggacacatagattagaaagtaaagggatggagaaagatacaccatgttaaaactagtcaaaagagatgaagtagtgatattaatttcacacatagcagagttcagagcaaggaaaactatcagggataaagggacattacgtagtgataaagacatcaataccccaagaagacataacaatttttattttgcatgcacctaacaaaaacgcattaaaatacttgaggcaaaaactgataaaactacaaggagaaatagatcaatttattatagttggagacttcaacgcctctctatcagaagtgaacagatccaccaggcagaaaaatcaggaaggacatggttgaatttaacagtaccatctatcaactggatgcaattgacatctattgactacttcatccaacaacagcatattatatattcttctcaaactcacattgaatatttgtgaagacagaccacattctggaccaatcataccattctgctctcagaccacaatggaattaaactagaaatcaaaaacagctgaaaaatccctggataattagagatttaaaaaatacatttctaaataacatacgggtcacaggagaaataaagagaaattaaaatgtattttgaactcaatgaaaatgaaaatatgacttatcagtatctgtgggatgcagtaaaagcagtgtttagaggaaaatttatagcattgaataccagtattagaaaagaggaaagacctaaaaaccaataaatgaggctttaaccttaggaaactaaaagtgaagagcaaattaaatccaaagtaagcagaagaaataataaaagtagaaatcaatgaaattgaaacaaaatcaatagagaaaataaatatcctaaaaactggttctttgaaaagatcaataaagttaataaacctctagctaggcaaactaagaaaaagaaaaagaatacaaattactaatatcagaaatggatgacaggacatcactatagagcccatggacattaaaaaatattaggaacaactcaattattacaacccacaattatgaacaacccacaaatttgataatttaaatgaaatggaccaattctttgaaagacacaatctaccaatacacaagaaaggcagttcgattaggcctatatctatcaaagaaatggagtcagtaattaaaaactttccaaaacagaaagcaccaggtccagatgagttcaatggtgaactctaccaaatatttaagaaatttaaggaaaaaactatacccattctctacaacctacaatctcttctagaagatagaaacggaaactcattctatgatgtcagcattattctaatactaaaaccagatgatgacattatacaagaaaactacagaccagtatctcccataaaaagagatgtaaaagctgggtgcggtggttcacgcctgtaatcccagtactttgggaggccgaggtgggtggatcacgaggtcaggagttcgagaccagcctgaccaacatggtgaaacccgtctctactaaaaatacaaaaattagccaggcgtggtggtgcgtgtgtgtaatcccagctgaggcaggagaagtgcttgaacctgggaggcagaggttgccgtgtgccgagattgtgccattacactccagcctgggagacagagtgagactccatctcaaaaaataaaataaaataaaataaaaaacaaagatgtaaaaaaagatgtgaaaatctcaacaaaatattaggaagtcaaatccaatcacgtgtaaaaatgattatacatgaccaaatgggatttatcccaggtatgcaaggctggtttaacattcaaaaatcaattaatgttccatcacataggctaaagaagaaaaatcacatgatcatatcaatggatgcagaaaaaatttgtcaaaatccaatacccattcataatttaaaactctcagcaatagagatgaacctctacaacttgataaagaatgtctacaaaaaactacagctaacatcatagttaatcatgaggaactagaagtcttcctgctgtgatcagaaacaaggcaaggatgtcccctctcacctctagttttcaacactgtactggaagtccaaattaacgccataagacaagtaaagaaaatacaaggtacacaaatttgtaaagaagaaataaaacaaaactctctttgtttacacatgacatgatcatctacatagaaaatctgaaggcatcaacaaaaatactcctggaactaaataagcaactatcgcaaagttgcaggataaaaagtcaatatacgaaagttaatagctttcctgtataccagcaatttacaagtgtaatttgaaattaaaaatacattaccatttatactagcaccccccaaaataaaatacataggcaaatctaacaaatatgtacaagatctatatgagaaaaactaccaaactcttataaaaaaataaaagaatcaaataaatggagaaatattccatattcatggataaaaagacacgatattgtcaagatgtcagttctttccatctataaattagaagcaatcccaacaaaaccataggaagttattctgtgaatagggacaaactaattccaaagtttatatggagaggcaaaggacccagaataaccaacacaatgctgaagaacgacgtcagagaactgatgttacttgacttccagatttactataaaaatcagcagtttccagatttgctataaatgaaagaacaaatagatcaatggaatagaatagagagctcagaaatagatcccacatagtcaaatgatcattgacaaaggagcaaagacaatataattgtgctgaatctggacttctacaagcgaaaaaaaaaaaaaaaagaccttaagaacttcagaaaaattaactcaagatggatcattggtttaaatgtaaaacaaaaactatggaagacagcataggagaaaatctagatgatcttgggtttggtgatattttagatacaaactcaaaggcataatctatgaaagaaataattgataagctagacttttttttaacattaaaaatctgcactctgaaacacaatgccaagggagtgagaagacaagccacagattggtagaatatatttccaagacacatctgataaaagaccaatattcaaagtatacaaacaattcttaaaccttaacaatgagaaaacaaataacctgactaaaataagggcaacagacctgaacagacacttcaccagaaaagatacacagatgacaaataactataaaaaatgttcaacatcatatgttattagagaattgcaaactgaatgagataccactagaatggtcaaatactacacttactacacttactagaatggtcaaaatcccaaactgacaacaccaaatgctgatgagaatgtggagcaacaggaattttattcattgctggtgggagtgcaaaatggtaccgcccctttggaagactgtctggcagtttattacaaaactaaacaaacttttactgtatgatccagaaattgcattccttgatatttactcaagagagttgaaaatgtatgtccacacaaaaagatacatatgtatgtttatagcagctgaattcataattgccaaaacatacaagccaccaaaatatcctttggtaggtaagtagataaacaggtacatacacacaatggaatattattcagcattaaaaagaaataagctatgaaaccatgaaaagacatggacaaaacgtaaataaatattactaagtgaaagttgtcaacctgaaaaggctatatactgtatgattccaacatatgacattctggaaaaggggctactatggagacagtaaaaagattaacagttgccagggtttaggaaggtgaagtgatgaatacaggtggaacccagggaatttttatggcaggatagtaaaattactctgtatgatactgtaatgatggatacatgtcattttacaattgtaactcatagaatgtactatgccaagtgtgaaccctaatgtaagctacggactctcttgggtgataatgatgtatcaatgtaggttcatcgattgtgccaaatgtgccaccctgatgtgggctgttgataggggagattgtgtttgtggagatggggtataagagaactctctgtactttctgctcaattttgctgtgaacctaaaactgctcttaaaaaaaaaagtttattaaagcacatgaggcccatctaaagtagctggccaggcttgtctatgactttaccacagttgctgcccatagcttgaaacagactcatgtcttacgatctctaaggctactcgtggaaaaggctcagttcttacagaagcagtgagaaggagaagaaaaagaggacaatagtaagaggattcaagatttcacaagtggaaactaaatattatacaacaagatttcgttaccttgatcagtatgaattgataaggaagaataatacattagaggaagaacacgttttatcaaatcaatttttttaaagcatatacaaataaagaaaatatacataagttgcccttttaagaatgaggtaggacaattaaagcaaacagcaacaaaaaagtagtacagcaaaaagtaatacttacaattattctgttattaaagaagttattcacttgacaaatcctatcattttctttctggatgccatttttaagcttttctatatcaaaacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggactcttgcttttcttccttttaatatcatttcttaatattttaaagtaaactaagaaatataattgtaagttaaaactttattctagttatttgcataatataattttggcagtatacatgatgtaacagattgtacctattagaattaaagcttgtcaaaatgacaaatttgtgactaattgctacaatacctgaagtgcatcttaatttttattttttgagatggtctcactatgttgcccaggctgatcttgaacccctggagtcaagtgatcctcctgcctgagcctcttaagtagctggaattacaggcatgccactggggctggcttcatgaagtgcttctaaatgtagcttttcagtacatatagcagaccttacatacatgttgggaattggatgccagcctcacatagatgaatgcaagtaacacattccatgtggagttgttgtaataaagcggtttctgactcccagcatagacataagttttcctgtatctattgaggtctgaagagaggctagtccattatttgccagtctttatgtctggccaggtatcactctgcaacgtatttttaatttctggtaaatgaaaatagctctaagcacatgaaaaagtacctttctacttgataaaaaggcttaaaatctaactaaatccatttaaaataaattatacctcaatatgtagatccatattctggttcaatttgagatcccttaattctctggatggtacatcacaatcttgttgaaggtgctgtattttaattagcaattccttttgcttttccacttcatcaataaaatccatttcaaatttattgatggattcatgttgttcttcttttatttttgtaacatagcttaacacatacttgcagaaaaaaattaaacaaattggtaaatgaaaattttgtcacatgtagagaaagttttcatccttgagactatgaggtaggatgacatctcttatttacctatatcctctcacaagtgaggaaaagggaaagagcttctctctatccccagtttttcctcttagtatcttaggagaataactaactcccagacctataattccttatttctgacttcttaccagatatacttcttggatgtcttacaagtacttcaaattcaacatgtttaaaacgtaacatgatccctttctctacaagtcctcctttttctattgcccagtttttggctaattacattaccaatcacccaggtttcccagttaaactcatgagactcattttcaacatcctctcctgccaacgctgattgggtaaccaaaaagatgaagttacatgcctcaagacttccttgtcggccggacatggtggctcatgcctgtaatcccagcactttgggaggctgacgtgggcagatcacaaggtcaggagttcgagaccatcctggctaacacagtgaaaccctgtctctactaaaaatacaaaaaattagctgggcgtggtggcaggcgcctgtagtcccagctacttggaggctgtggcaggagaatggcgtgaacccgggaggcggagcttgcagtgagccgagatcatcacaccactgcactccagcctgggcaacagagcaagactccgtctcaaaaaaaaaaaaaaaaaaaaaaaagacttccttgtcaagcatatttagatatttggcttcaagagacaataatttcaatgccaaatgtctcatggacttcatgaataattctagatgtctgattaccaggatttgtggaagaattaccagggcccgaagggcaatctacccaggtagggcagataccagcttacttattcctcaacttccaccattccttaacctcttataatctggtctcttccttaactacccagttgaaactgttctctgacaatgatcactaatgagttctattatcaccacattgagagaatatcttcagtccatattctgactctctgaagtatttgccactcataacttcatctttgacatactcttctccactgatttgggtagcagtacttttgctagtttctctcctgtatctttgacttttccaaccttgaacccatgtgttgctcccttttctgctactgcctcttagacatttatcttttccagagttctgtttttatcccaaggctcttagtcttcattatgctttctggatgatcttacaaatgtattatctatcacctatatgctgatcagtctcaaatgttagttcttatttttctcctgccaaacctcaaactcaaatctaaatgtctacttggtttctcttcttggatgttccatcataggtatttcagcccccaaacatctcaaattaaacaatctcctgcctcatctaccttgtttctctttcttttttatttttgaatctcagttaatggtaccactatcgacaaacctgactaagcccaaatccaagaactccatctaaacttctctcccttatgtccactatcaattatttcgacctactattttaagctgctaaatatttctttaatctcgtttgtcctctccagccctgtgaaaccctccctagtagtacagtcacatataatatctcatctggaccactgtaactgcctcttattgctttctgctactaggcttatctccctcaaactcatttcttctgtattctttagtttagtacctaagtggtaatcagatcctgttaccaccaccacttaaaacaatagtctaatgattccccatctacaaaaagaactccaagctttgttattgagtctggcttctactacagtttcatcttctgtaattttatttagtacgtcatataacttgcatacacttctatcattgcacttaatacttgtttatatgtctgtctcaccccagactatgagatctttgagatgttaactcacatctgcctcctgaacatcctgacataatgtctaggcccacaggcagagttcaggtgttgctgatatcctacatattactatgctcagacccacataatctttaatttggtagtaagaatactaaatagcaaatatgccggcacctgaagcaggacttaaatacattgatgtttataactgaaatatttaaaaggatattactaaaaaagatggtaccttcagtttcttcatgattctgtggaattccatggagcatctctggtttgcagtaaaaagtttttcaatgtgtttggtttgtaaatagggaagtgagaggtttgctttaactctcattgaaagctctttttggaattcaatttccttctccaagtcaagagacaatctattcaagcactcataatgatcatccatctctgagtatctcttcaaaagctcctaaaggaaatgagaattcactcaatttataacaattcattctaatatcacaataagtagttacaactctagaattgtaacaaaacttatgctttaacattttctgtaggagagaaataaagacctttgtgtctaaaaacaaaaggaaactcttgttgtcattttggataacagaaataatagataattattatggcaatttaaaaaatttaagcaaatataacaaagaaagccaggaccaaccattcttaacattttgatgcattttcttttagttttttgaatatccatgatatgaatcaacattgacaaagtctgatgagaaatttgagtaaattcaattaagtatgtattgtagttcatggttgagtgctggtttatgtttatagtaggcagtctgagttagcagataaaacaagtgattaagaatcaaaccacctatttgtcagcttggtacagatacttcacacaatcctactatctgcctacaatctgttttctaaccctttatcagaggtagagttcaggttccagctctgccacttcttgactggggaagtcactgagccattttcacaacaacaggaagactacaataattaccacaaagttttctggggtcaagtaaaatatatgatctatacctatatacctatgtaatctataaaacagacacagtcatttaacttgaaggagacaaaattatgtttataaacatgtttctatacccaagttttgaactaagtcagatacaagtctgacttagtttaaaattctgattctaacaatttactagctgtgtaaccttgggcaactgctaaacttcctttctgaggaaggcagtttccttgtttatgaatggagcaataaagcctatatcatgaggtaaagcacccagtatggtacctggcatacagtagacatgcaataaatctggacccatagactcaagtgacttgaggctatgcaggtgacacactggtcagagcacaggtagagaaacatgtaaaattcaagttactgtaatcatgtagtaggtaacatgtttagttcaggctgctaaacaataaaacaagggcgttctcacaagaatgagccctttatttttaataatttaagaaaagctagatgttaatcaatctggaatgttggagaggggattcctgtttttggttttaggatgaatcaactacggtatacagcagcatattgaacactgacttatgtcaggaatgtgctaaatgatgtagtcataaacaaaacaaaaatgtccttagagatcttgcattccaacaggtgtgactgtaaatcctgttggctttcccttcaatgtatattcagaatctcaacacttctcactacctctattgctccctctctgggccaggccaggatgatctctgcctgggtgattgaaatcagtctttataatggtcttcctgcttccactctattttcaatataacaattaagagtcatccctttaaaatgttaagtcagattatgtttctcttgcggtaaaaattccccaatggatctccacctcacttaataaaactcagtcttttttcatgtcccacagcttgcctcttccctgctaactctctgatctcattcattagcagcttgccctcttttcgatattccttgaaccaccacagagtcttctgcctcaggaactttgtactcgctgttccctttgcctataatggtcttttcagacatctgtatggcctgaccctttacctcgttcaggtatttgctcaagtatcacttttctggtgaggacttaaattcacaagctcccattgttgtttgtgtatgtgtgtatatatgcattatacccacacacctgtactagattacaatgtttagaaaaatactgagcactatctatttattccagaggttccttcaatcccacttcaggtttcggtaagcctttggaagacaaccaataatcatttgtagttttaacagggggtacttacttttattctagagcacttttctctcaggctttccgtaaggtgctgttgtccatcacttagtaaccttttttcaggttttacttggtggttctgtcggtcctgctttggtaaaaagaaaataaacagggcttttgtcatgactatattcacatataatgtctaatcgcacacttctaaattacatgacatttcaataatggaattaaatattatacttgtcactcaaaagcaatgttaaaatgatcagaaaatgaataatagtatcagtaagttttatagggagtgaccttaactcattggtaaaaaagtagaaaaatcatctaatttttggagacaggatttgtttttcatagctacaaattaggttttagggccaggcatggtagctcacgcctgtaatcctagcactttaggagatcgaggcaggaggatcacttgagctcaggagctcaaaaccagcctcagcaacatagtgagaccctgtctctataaaaataaataaataaataaataaacaaccaggaaaacaaataaattagattttaatttctgattcctactcttccaaatctctgcattattcacttgtagttttaacagtggcacttgcttttatcctaatgcactttattggcgccaaccaaatatactggcaaaaccacctgtactgtctatggtgtttcaaaccctagtcatatattcttcccagcaccttggaaaagttcatatcctgtgtacattttgcatttctgattaaaaagtataaagtgaaacaaaaacattttctcccacttatcttgttcactacagtacctagaagaatatttgatgaatgaattaaatctctctataaatttagttcaggcccacataaagaaatatgagaataaaaaagatttttacagattttaataaacttgtctgaactctgttactttcaaaaagaggatttaattagatattttaagatatatgattctgaatatctataaatagtcataccagaggaacttaatttttatatttatcttcccttttttccttttaacttcaccaataagagcccaactctagaactccagcatgtataggtagagaaatgggaatatttgctctcttacaaatctaatccttcaaatatttctccatttagaataatgctatctcttgattaaaaaaaactttaaaatgttatattaagggaaatagactgctttaacacagtttataaaaataaagaattaaatgttattttctgaaaatatttttgcttcttttaaaactgttttctattgtgtaaaaattagagtaaccatttcccactgtcctttactgttcataggaatttccagagaaagaaataaaaacattgtaattcttttcaaaaaagcttaattcttattaatagttactacacaaaggaagactctgaactcactctagctatcatttcccttaaggttgctatgaattggtccctttccattttgagagattcttttatcctccttagctcatctctttctttagctacaattcttatttcttcaaggctttcatgaagtttcttagtcaactggaagttatccattctcacactttgcatagataagttttgggcctcaaattgcttcttcaactgttccatttcattaatttttttatgactcatattgacatcttctttcactctaagcagttgaagttcttttttctgaagttcttggatcttgagataattgtaaaacaagttagaatgtaagcagtttcttcaaggaaggcaaatagtgtctacttgtgttctatatgcacatatctatctacatatctgtatctatatctttttaattccacaaataattttgggcacagttacttccaaaagaagaacaaaacaacacatacctttttctgtaattcatcttttgatttatctaaatccttttgaatgtctgaaatttgaattgtcttttctgaaattttttctctaagtttatcaacagtttctttgtgttcttttgatagcatacgagcagtttttagttcctgttgtatttccagatcctttatggttagaagaaatcaagaaatgtaatgatataaaggcacgttacctttacttaatgattgagtttaaacaaaatcttaaaaattatacactcacagttaaaaacaaccattatacaacctcctaaattagaagagtaaagtaaaattttctgctggtagcctcacccatagccttctcctttcataccacttggacatctttctaaatcaatatcacaaaaagaataccccattcttatgcttagttttccattatacagatagtgccttattattggtggacacttagattatttctaggttttagtcaccagacacaacgctgcagtgaacactgtatttttgcccaaatatgtgaatataatggtagggtaaagagagaacacaactcactctagctttggtttcttgcaggctttccttgagttggtctctctccagtttgagtgtctcctctactcttcttagattatctctttctttcattacagatttcatttcttcaaggttttcatgaagtttctgagccaaatttaaattctctatttctaatttactcagagttaagctttggtcttttatttgtttctttagttgctccatttcagacacttttttctgtgtctcattgacatctttttttaacgtaataagttgatgttcatttgccttaagttcttgaatcttaagataatcataaaataatatgttaggtggctttttagggacagataaataatagtttctaaattgattaagacaactgtctacccatgttactctcactgatatcctgcacaattccacacagaattttactttcttttgaggtataatatatataaagcatgctcatcttcaatgtataacttaattattcttgacacaggtgtaaatctatgaaactacaacccagattaaaacagagaatatttctagcacttcataaagtttctgtgtgctccttcctagagacagccactattctgacctttatcatcctggttcagttttgcctgcttttgaacctatatatcacaatgtatgtatccattttcctgctgatagacatttgagttttcagttttttgttattttgaataaggctgctataaacattcttgtgtctttttatagaagtatgtacgtactcttttctcttatgtacatacccaagaagtggaaatgttgggcctcaggcaggctacatccagcattagtaaatactgccaaggtgttttccagtgtggttgaaccattttatatccccaacaattttaggcacaaacaaattagatatccaatcaaacaatccccccataaaaataccttttcttgtaatttagcatttgaattttctaaatctttttgcatatttgatagtttatctgtcttctcagaaacaattcctctgagtttgtcaatagtttcctgctgctctttcagatgcatgtgagcaattcttagttcctcttgtattttcagatcctttaccattagagaaattttaaaaacagtgacatatcttaatattagtttttaaaaaataaagtgatatattttcttagtaaaaataataacactgttactctatatctttgctgttgtttttaaggtacaggctttctcttccctgtcctcctctcttcacactctacttctgctttccagaggcaaacacattacacatatattactttttttaagtgttgcatagtatttcgatatattgttcatatttactgtttccttctgaggaacatttagattgtttcagatttttaattaaaatcactacaataaataacctgtggcatatgtatacgttgtgtttgtatatacacacacactcctttaacagtatatatgtaggctaaagtccgtaaggaaaatgataattgcagacttgaacttttcaagaacagtaccaaattatctgcttaaaaggctgtatcatttcattcttgccaacagtagtacttggttcaaagaagggttcattgctgtaagaacacaatacattgaattgccagggagaggaatgagcttactttagcttctatttctctaaggccttccctaagttggtcttgctccattttaaagatttcctctactcctcttaggccatcattttccttagtaacaaatcttacatcctgaaggttttcatgaagcttctgagtcaatcttaatttctgcgtttctacactttccagagttacattccaggcctctaactgcttctttaactgacctgtttgatacatagtttccctaagatcattttttactttaagaagttgaggctgggcctggcggctcatgcctgtaatcccagcactttgggaggccgaggcgggtggatcatgaggtcaggagatcgagaccaccctggtcaacacggtgaaacctcctctctactaaaaatacaaaaattagctgggtgtgatgacatgcatctgtaatcctagttacttgggagacttgaggcaggagaatcgcttgaacccgggaggcagacattgcagtgagccgagatcatgccgttgcactccaggcgacagagcgagactctgtctcaaaaaaaaaaaaaaaaaaaaaaaagaagttgatgttctttctcctgaagttcttggatcttgagataatcatacaataagttaggattatcagtagatataaaaagatcaatgatagtttctaaattgagtaggcaagtaagtcttcacttgccttcaattttagggtaattcatatcttgtttcattacacaaaaagtttgattcaaactctcagtaactgagataacttaaaaataaaatacctgtgcttttaaggcatcatttgagtgttctaagtccttttgcatatttgatatttcatttgttttctctgaaacaatccctcttagtttatcaatagtttcttggtgctccttcagatgcatgtgaacaatttttagctcctcttgtttttctaggtcctttatcaatagaaaaataaaaataatacattgagagtagtaccatccacatgctatagaaaggtatagggcaggaggtaaaaatcttccaccctcttctgaggcctcctagttctcaccctctaagctacttttagatgtcaatacattctagatacactattcctgaacttaccctgttccctaacaggacacttcacccttcaaatcagcactatagctctaccacattttttatttgtggcatagaattccatgacgtgaatgtgctgcacttatttaaccagtcccttaccaatggatggttagaattttccctgtttttgtttgtgttatttcattattgcaacttgttgcaaagaatatcctacaaatatctttatacagttgtgcaaatgtgtggaggatagttacaactggacttgtggatcaacgaataaacctttggaaaaatttggaaggtatttccaaatataccctcaccaactttcctcaatattggaccaattttatcttattttattattttttattttattttactttttgagatggagtcttgctctgtcgcccaggctggagtgcagtggtgcgatcttggctcactgcaacctccgcctcctgggttcacgccattctcctgtctcagcctcccaagtagctgggactacaggcgcccaccaccacgcctgcctaattttttatgtttttagtagagatggcgtttcaccatgttagccaggatggtcttgatctcctgacctcgtgatctgcccgccctggcctcccaaagtgctgggattaccggctcgagccaccgcgcccggcctggaccaattttatactcccaccaaccctatggcagatttttctcttaggactcaatgtcatagttactagaggtgtagagagatggtaactcactctagttatagtttctctaaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtcatcttaagaaactgatattctttttcttgagattctttcatctgagaaaattataaagtaagttacaacataggcagaatttttttaggaaaaggaagaactgttcctaaaataaggcaatcatttttacattgtaatctaatgtatgtagtactttctttcataagggatatgagtaacaataattagatgtcattttccaatttaacaagtcccactttttcctgtaattcaccatcagaatttcctaaatcccaatgaatatttgctacttgagctgtcttctctgaaatattctgtctactaacagtttactggtactcagttgaatataagcagtttttgattcctcttttatttccggtccctttatgattagaggaaaattaataaaacttaacatgaacaccgtcattatcaccttaacactatttctgtatccaaaaaaaaaaaaaataagatgggaacttactttagctacaatttctttagtgttttctttcagttggtctctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttgaattgtttcagttcattcactttttcctgaacctcactaatttgttttatattaaattgttcctctttctcataaatctcttggatcttaaacataattataaaataagttaatagtcataaaaatatgtaaacacacacacacacatacacaacttaagaggaaaaggttgcttcccaaaacaattaagcatgccaaatagtagtcttcataattcagttagctactccaaacccacccatttcctcccactgtttcttcatccccaatttaccttgttctgtaatttatcattgattgcttctaactgcttttgaatggttgatatttcagtttccttctctgaaagattcactcttaactcattaatagtttcctcttgttctttcaggcaacaatgagcaactttaagttcctcttcagtttccaggtgctttattattagaggaaattccaataaatttatagaaacattataactattttgttgtaattaactcccctttccaaatatttagggtttataataatatttggttacaaaatattttttaaaaacatggtgaaagatgaaacctactttagctacaatttcttttatgttttctttgagctggtcactttcagattgaagaacttcttgcagcctctgtaggtcatctttctccttagctacagatttcatttcatcatgactttcttgaagtcttttggacaatccgagcatttctatttctatccttagtagtgctgaatctttgggtttgaattgctccatctcactcacgattttggtagtttcattgtctttttctttcatatttaaggactgttcttgtttgctttgagactcctggatcttaagagaatcataaaacagtacagttgatatccagagatattgtgttttaggggaaaataaatcaggatgctttctaaaacaattaaggcaggattcagtgcctcatttacagagcaatctctccattctcccactcttccattattcaggcatttaatgctttttaaaaattgaggtctcactgtgttgtcagcatcttattcgaggctggagacaaaatgatgagacttacaggatctctctctttttgagacttatacttcaaggacaaagatagatatgatgttgaatcttaccaaatagagatgctggcttctcctacggcccaagtgtcaaatataatctattgtgaatgataggaagggattcctagaggagaaagctttaactgagatctgaaggataagagcattagttaggcaaaaaggagtatggaggtactgcaggtagagagacctgagaatctgaaagccatgagctgcggaagagagttgctggagaacaaagaataggaagaagaatgaattgaaataagaccggcaagatctgcacctagggcctcataggccacataaaggatcctggtctttatttaaaaagtagcaataagatattaaaagaatgtaagaaaggataacttaggcttagtatagaaactggattagagaagtctaagaatgagtgtgggaagaccagttaggagactactgcagatagccagggaaagaaatgatgttgacttggattagggtggtggcagtgtggagagaaaagcaggatgacttttaaaatacacactcaaatcaataagatttggtgactggattacagaataagcagagaaggaggcatattagtagggatagctcccagatttctgactaaaacaatgagaaagcacagtagtgctttatgaaacattaaaggaacaggtttaaaaaagaaaataaaacaatctcatatttggtttcaccctttcttgtaatttagaattattttttctaaattattttttgaatatttaagaaaacagttcttttctctgaaacatcttctctctgtttcaataccttcttggtattcaagagcaatttttaattgttctgtttctagtcatttcatgattaagagacattaaaaaaactggtaacataattataatacaaacattataactataacacaaacacaagccttgattcttataagacacttgttaaaatgggaggaaaatacgaaacttactttagccaaagtttctctaatatgttctttcagctggtcatgtttaacttcaagggcttcttttatcgttttaaggttgtctctttccttggttagagattttatctcttcctgactttcttgaaatttttcattcaacctgagcctttccatttctattcttgccagtgttgttgagtccttggttgtggactgttctgttaataactccagttcattcattgtttcctgagtctcactgacttctttcacattaggcagtaactcttgttcctcatgaagcactgggatcttaggacattcataaaataccaaggttactatcaggagattatgatcataatttttttttttttgagacggcatctcactctgttgcccaggtgggagtgcagtggcgcaatctcagttcactgcaacttctgcctcctgggttcaagagattctcctgtctcagtctcctgagtagctgggattacaggtgtgtgctaccatgcctggctaatttttgtatttttagtagagacggggtttcaccatgttggccaggctggtctcaaactcctgacctcaggtgatctgcctgccttggcctcccaaagtgctgggattacaggtgtgagccaccgcatcccactggccattatcataaatttttaaagggaaaagatcaggatacttttcacagcaaggaaagtcatcttgaaccctcaggcctaccttggatcacaaactgctcattattcattttccctcaattcctgctaaagctattcatgacttttctgggtcacattctgtcatacttttctttctttgtagcttagacccaaagtgaaccaattatactttgctagcagtctgtttcatacttatttctccactagtttccaagctataagagaaaaaccatagctgagcaaactatatcccaataaatgtatgatctccattttcagatgggctccaatgctatgtctcaatttttctatgtgtatagattgatttctctttccatgataaattagtggtaccatgtaattttgcgtatttctgcatttaccatattggaattaagggattttctttctagtttataatggggggaaagaacaatgtcttatttatatctacagtctcaatgtctggcatggagtaggcttttaatacaggttggcccagtaatcccaatgtttcactttctccatagcatttaccactatttaatgttttcttgttcatttgattgcttatttatcagctactttctttcactacaaatggatcagagggattttaggggttttgtccaccttgttctcattgcatttctataacctaggagtgtgcctgccacattaaacactcgacaaatacttacccagtcaattaatgaaccacatcctagctacttcttactgcttatctttccttcaaaggagaaaggaaggaagaagtgacaaaggatgaaaggaataaaagacatacctcttcttgtaatttggtatgggatttttctaagtcctgagtatttattatttgagctgtcttctcagatacgcttcttcttagttcatcaatagtttcttggtgttcttttaggtgaatatgagcaatttttagttcttctttggtttgtaggcccttggcgagtgaaatttaaagaatattgtaatattcttccaacattgctcccctctttccaagtggctcagattttaaaagaaacacttaatagatgaaggaaaagggtataacttactgtagcttcaatttctcttatatatcctctaaggtggtctctctctgtttcaaatgacttctgtaattcctttagaacttttctttctttggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctgtttttcttggagttgctggctcttaaaatgcacaatttttataattaccattttacttatattctcaaaattcttacacaaaatcattaacagccttgcctcctatcagcatataaataggtaagtagcattaaaagtaaatgaaactcacaggcataaatgtctgcagtggtttgaatattgtcccacccaaaattcatgtctcccaggaacctcagaatgtgaacttatttggaaatagagtctttgcagatgtaattggattaggattgagacgtgatcctactggagtaggtcttcattccaatgagtgtatttataagagacataaaagcacatagagaggcacagagaaggaggtcatgtgaagcagttacaagccaaggaatgcgaagggtagctgggagacactggaagctaggaagaagtaaggaatgattcttccttagagccttcagagggaatatggtattgctgacacttaaatttggacttctaggactcagaactgtgacagaatatgtctctattgtaagccatcaagtttacagcaatttgctatggcagccctaggaaactgatacaggctgattaaggagataaactgattaaggagataaggggaagatgagataaagtaaaaaagcaaagagactaattaaatatacaaatacagctaccaaataactataattcctcatcctcttaaaaaacttttggagaatttattttcacttccaataagatgcttatgggtggctcccccaaatactgagacattaaccttcacaggctattgattttaccttttttataggagtatgaaatagacataaggttttagtaaactcaattaggtgagatagtgaaagggatcagaattaaaagaaaacacatattaagaaaaaaacaggctgggcatgatggctcacacctgtaatcctagcactttggaaggctgaggcaggaagactgcttgagcccaggagtttgagaccagcctgggcaacacagtgagacctcgtttctaccaaaaatacaacaattagctgggtgttgtggcacagctaatttagtctcagctactcgggaggctgaagtgggaggacagcctgaacccagggggggttgaggctacagtgagctgtgatcatgccactgcactccagcctgggtgacagagtgagaccctgtctcaaaaaaaaaaggaggaaagaaaaaagaaaaaatattccacagaataataacagaaccgtactatattatctattatgcaagtggcactgcccttagcttatatagaaagatctctatgggtgcattttagaatctcttgggaactacagctgttacaggggtcttagctcttacacaaatatcccaataacacctaacttctatataagaaatgattcaggaaactgcaaacatctaagagatggtaatagtgataaatcttacatttcaaaatgactaatgcatctctgcaaggaaagaatctttgttttgttgactaatatatctcaagtgcccaaaacagtgcgtggcccatgacagtgctcaataaatatttgatgaatgaatacatcatatgatttgtttaaatgatacaaagccctctctcacctaaagactctggaataatataatcctcataaggtatgttagtttagatctcagtgtaagttaaaattgtccaaaatactagcattgaaatatgttcatttgggaggtatgtgctatttctggatttaggtctacagaaataaaaattaccaaaaaaaaagtttagttagaaaaaatggccagggaaataactttaaaaattcaccttttcctttagtttttcttcaacttctgccagtctgtcacaggtcctagaaagctctccttctttctttatggcatggttcttttcttgtgcaactatctcttgttgctttttaagttcatccccaagaagtcttaattcttcctggttttcaatggtctagaaagaaaaaaaaagttgagattaaagtaaatattagctaacatttatgaaatcaggtaaaacatcagcatttctctcagtctgcaaatgaagaaatcagggaaaactatataggaaaagacaaatttcaaaaaagaaagtccttattttaataatataagatgccaagaatctgctttttatactgtttctttactgctcaatttacattcctaccatgagaattagaattgcatttaacattctatcatgagagcttagcttatttctacctttaagtcaaaagagactttttctgagctatcactgagtaataatgagactacagctatagttttttcaaacactgggatggctttggttttagcacagatcactgccagcgagctcaaaatggcagccaccctctgctagcatgacttgggctgatcctggttattaggctcacacagtgacattctcacgtatcaagaccacaaaaacataacaagccagagactgagaagaaaataccattgtttgtttgtgtgcttatttacattctgctcttttgatgaaggagacaatccccaaaacttataaaattaaaacaatacaaatggtcgcattctactatgatccacagtgaacttctccaaatatttatttaaacttatacacattgtatcacccctaaacatagaaaacctaagtgtgaaaatattggcagacatcaacaacaaacaattaaaaataaaatttaaaaattatgacagcaaaaaaaaagagaaacatttaggaacaaatttaataaaatattaaaagacctatacactgaaaatctacaacatacctctttgagaacagacaaattacagaagaagatatacaatggtctagaagcataagaaaaaatgttcaacatcttagtcattagggaaaggcaaattaaaacaacagtctgcacacccattagaatggctaaaattaaaagcaccaataaatatgaagtgttggtgaagaaggatgtttgagccaccagaattctcttaatttgctaatgggaatgtaaaatgatataattactttggaaatcagtctagcaaattctcatcaagttaaacatattcttccctgtgacacagcaattccatttagatatttaccttaagtaaataaagctatgtaaataaaaagagttgtacgagaatgtttacagcagttttattcaaaatagccaaatactgaacggaacccaaatttccatcaataggaaaaagaataaaaaaattatggcgtattaatacaatgaactattccttggcagtaaaagggagtgtagaaagtcaaacataagagactacatactgtatgattctatttgtataaagctctagaagagacaaatgatttaaggtgaacatatcaggactgataatctggcggggaggaggtgatgagggtctgtgatagaggtgtgaggaaactttctgggggtgatggaaacatcttctatcttgactggggtgaagaggaaatgggtagagacatttgttaaaagtcgtcagaccatacacttccaccagatacatttattgtatataaattatacctcaataaagttgataaaaatctgaaacaaatgaagacaaaaaggtaatgccaagtatacagtgctaaatcctaccatttcaatattttcctttaggtcagtcttcaattgttccttttctgctataacactctctaacatttgttggagttcatttttctcctgtattaaagaaaatatcttcctttgttgctcaattatctcattatccttaacatctgcagttagtgtttgggtatttttagcttccaaatcctgttttttatctatgccaaccatctaaaacataaacacattacagaagaatttcttaagtagttaacaacaactttaaaaaataataaaaatagccaacacatctattatgtgccaggtactattctcatatcttaacacatttaatcttgacagtaactttatgaggtaggtattaccataatcttcatttgacagatgaggaaactgaactggagagaggtaaagtcacttgcccaaggtcactcagaggtttagctaggttttgaatccaagtgatctggctccaaagtttgtgctcttacgtctgttcactaatcagaacaatatggacaactacaaatattaataattgtcttcacgtatgataggttaacatgattctgcatgtttacttatttcaatgacattaatacattaattaaaggatatctgcctttagtttgtacacatcttccataaatattttccaagtttcattctagtagtagtttgtttatttactactaaacgagtaagcaatcttgaactctatcactttatctatttcctcctaaaagctgggaatcattccctgtctcccactccctgcaaatctttattttcagaggcagtcctacttacaaaaggctggagttttattatatgtagggggataaataattttgataaagatctatttcataagggtgaaattcatcttttcttaatatatgtatattttatatactgcttaagaaaaatgttatataaattcatttattcataaataagtcacgaccaaatgtaacctaatacgtgaacttattggtaaagggagacagagactgaaattactattgctggtacaaatttagggtattattgtatgacattacactagttcagcaaacagctccatattgcctacacaggtatttaaaagtttttataataatctataatcacattagaaaacaatagaaaaataaaggataaaaatcatccactgtcaccaacttcacacaacaaactattagaattctggtaaatttacttctggagttttttccattaaaggttttttttttgtttttttgttttttaaacatagctattataatgaatttatatgtgtgattctttttagtttttatcttttccacttagatcatatgtattttcacatgttgttatgtaacctacaaataatttttagtagctgcttgattctctagagtagatataaactgtactttatttagcaacccccttattgttggcaatatgcatgagcttctagaagataacagtgatcacagagctaactacatgagaaattaaggtagggaacacgtagtcttttgggactagtctgttagatattataattcagaatctcatatctttcaaatacaaagcagattgagacaaaattttctgtaatgatagccaaggtttatttcaaatctgaactcagcctagaaggtacttcaactaccacagttatgaataaaatctaatagatctaattattaaataaaaaattattagaacctgtgaaaaaggaaaaaaattgtcctttatataagaataagcttactaatcataaaatatttttgttgagatacattaaaaatactgcatttccagaaacagacacatcaagtaggactaaaaatgagcattccaaggagattcatgatagacctgctagtgcagctctctggtgcctagatgaacaggggagcacctggaaatccccatttccactcttttattcccatggcagattccagcatgagcatgatacaagaccaaattgatctcagccttccatcccagactttaggatccctggtgaacagaatggcctcagaaaagccccagctacatccttttatcaacatggataaatgactccagcatatacttggtaacataggatcttagctgttcccagtgagtataactctactcttcccttcatcttctattgtctctataactgcattttggatttgtttaaaacagttattgattgccatatattattgtcaaaagtctactaaaaaaactttcccatcataaaagtggaagttattatttctttctttttttttagacagggtctcactctgtcgcccaagctggagtgctgcagcatgatctgggctcactgcagcctcaaccttcctgggctcaggtgatcctcctacctcagcctcctgagtggctgagactacaggtgcattgctaccatgcctggctaatttttgtatttttttgtagagacggggtttcaccatgttgcccaggccggtcttgaactcctggactcaagcaatctgcccaccttggcctctgaaagtactaggattacaggcataagccattgtgttgagggtaaatttcaaattgaggtcaaatgcctttggcctatggttattccaaattataaataagctgagaacataagatacagaaaaagtgagagagaagaactaaagcataaggagatggaaataaaaaaaaagttccattttccaaggcagtattttgccccggagtaaatgggggaaaatgcagctcattttatagaagtaatatataaatgtacagatatttatttatatcaattggatcttactgaattactttgaaatgtgtatttgcttttatttaataatgtattctgttaaaaatgcatgactgtacaaacatcagtagcatttctgtacactaacaatgaacgatccaaagaagaaattaagacaattttatgtataatagcatcaaaaaagaacaaaatactaagaataaacttaaccaaggaggtgaaagacatctgctgaaaactgtaaatgttgctgagaagaaattaaagaagacacaaatggtaagacatcccatgttcatggattagaagacaatatttttaagacatcaatactaccgaacaatctaccatttaatgtaatccctatcaaaatcccaatggtgtcttttgcagaattagaaaaatctatcctaagattaatatagaaccttaaagggccccaaatagggaaacgaatcttgaaaaagaagaacgaagttggaggtcttgtacttcctgatttcaaaacttataaagctacagtaatcaaaacaatgtggtgctagcataaagacagacatataaaccattggaacagaatagaaagaccagaaattaatgcttgtgtatatggtcacagtatcttcaacaaggatgccaagactactcaatggggacaggatgatcttttcaaaaaatggtgttgggaaaacaatagccacacacaaaagaacgaagttgtaccctgaccttacactatatatacaaataaatgcaaaatggattacaggcctaaacgtaagagtgaaaattacaaaactcttagaagaaaacataggggaacagattcatgataagggtcttggcaatgatttcttggatatgacaccaaaacacaggcaacaagagtaaaaataaataaacttgactacattgaaattaaaaacttctgtgtatcaaaggatacaatcaacagagtaaaaagacagccgatggaatgggaggaaatttttgcaatattgcatataactgataaaggggtaatattcagaagtataaagaactcctacaactcaatgacaaaaatcaaacaacccagtataaaaatgggaaaagacttaaatagacatttctgcaaggaagataaacaaatggccaaaaagcacacgaagattcaacatcactaatcattaggaaaatgcaactcaaaaccacgatgagatactgcctcacatccattaggatggctactatcaaaaaaaaaaaaaaaaaaaaacagaaaatagtgtgttggcaaaggtgcatataaaccagaacacttctgtcctgttggtgggaagtaaaatggtgcagctgttatggaaaacattatggtgctttctcaaaaaattaaaaatagaattaccatataacctagcaattccacttctggatatatatatccaaaataactgaaagcagggttttgaagagatatttgttcactcacattcataggagctttattcacaacagccaataatgggtagaagcaacgcaagtgtccatgatggatgcatagataagcaaactgtggcatatacatataatggaaatttactcataaaaaggaaggaaattctaacacatgctacaacatggatgaagacattatgcaaaatgagacaggtcagtcacaaaagataaatactgcatgattccacttatatgaggtactcagagtagtcaaattcataaagacagaaaaataaatggtggtagccagggtctgtgggaaggaaaactggggagctgttgctcaatgggtatagttttggttttgcaagatgaaaagaattctggaaattggttgtatcacaatgtgaatgaattttacactagtgaagtatatacttaaaatggttaaggtggtaaattttatgttatgtgtattttactaccaatttaaaaaatatatactactatatactattccaagctatatatttacaaaagattatttcaccagtctcctattgaatattttaaaattctagcagtaaatactctggataaaataatatgaactataataaaaatgagacatgttattacaaaattactgttaccaatatatcttagaggtgttgtgggaaagtagaaaagaatactgttaataaatgaaaccctggtataacgttataaggcaatcccctctgcaatggactgaattttaaactctaagcaagtttagtatagtaaatttgacataaaataagtatcagctatgcaaaatttggactaatacatttttgggccctttccctttctaattgattataaacatattctatcataagttatttcaaaggcattagggataagcttgtaaaattattgttagttattaccattgtgagtaacaaatgaaattgagaatattatgcatttaagtatttgaggttaaagagtatatatacaagcatatgaaaactctgaaaataaacaccctttaccttttgctgaaattcatctttagtttctcctgtattttcctccatatgcaaattcctggaaacttcctcagaaattttcgattttagtgtattaattgtttcttgatgttgtttcagagactcaagagcatttcgtaattgttcttgagtatctatattctttgttagaaaaatataaaaacaatttccattagaatatgaaacaaaattattttgtagctactacataacataatcataaataataaatgatggcctctgcaatgtttttaagagtctccaatttttcaaagtttaatcaatcaaaaccttaccatgttaacagtatcgtgaatatcacttttgagttggtccctctcaatttgcaagctttcttggagttgttttagatcatctttttcttgagttaaagtttttacttcttctaaagtttgctgcagtttctcagtaatcagtgttttctccctttctacagtttgcagcgtagaatctctattttctaattgttccttcagctgttccatctcatttagtctttcttgaacctcacgtgttttctcctgaagttcttgggtcttgtaagaaagctttaaaaaagaaaaagtaaatgtcacacagtaaaagcagagcagtctgaggcatacatatatacagaaaccaaaaccccagaagactaaggagcatttctcaaaatagcatcttgtaccaacctcggtcttcaaagcacccaaactcgaatcaaatttttgggcttctttagagagattaactatttcctgattcattctctcattctcctcaaggaccatcttatacttttgctcaaagtccatatgaagggttttgaaattttggaattcttgatcagtgcttttataattcgactgtgtagttgctaggtcatcttttgttttcccaatttcttcaagtaaaccttgaactctactctccttatgaactacttcagaaaacaatttatctttttctgatgttattatatggagctcttcagatttgtcttgtatctatggaaaagaaataaaatttagggatgttagcaacatatgattcactgaagcaatttttaggaaaaaaagctttctctgcaaaaagagaagttatttacattcagcaaaaatttgactgtggaaaggcaatatagtagtactcttattgtcacttttccctaactcagcttgtttaactctacctttgatgttttattttctaatctctttgtattctagaaagtaaggtctgcatggaaaatagtaaaggcacataatcagattgtctttatttccttacctatcattttaaagtgttttctaactttatcatgtggcaggcatttctcagaatttgacatttttttccctaaaggctttgaatgcctctcaggtttccaaaaacttaatcaatgaataatttaagtaatgtttaatcatttaaaattgttatttaagaagtatcttaagtggtatggtccatgaaaaaaataaaaatagaagtaccacttaagtaatatttaaataattacataatttaaataacccatatcttgtatattaacagtttaatcactgtgaaagataagggcagagagagatgagaaaaaaagaagagataaaggagggacaaagtaaagacgggcaatacagcgtgtagctacaatcacgggtttaggaggcagatttatgtggctcaattatgagtttgataatgggttattgggactaaaaaactacctatttttgaagagtttataagacgagtaaatgaaataatgtttttgaagttctttagcatgatgtttgccatacagtaagtactcaaatttttgccatttttcttttagacaagtagaaagaaaaactggcaggccatggatttacagaaacattcaccagcctgcaaggtttgcattaacctctaaaactttatcagtgcaacctcttttccctcattactgtcttttattcaacataatgatactactactaccaaaaaaaatggtaaagactaagggtgggccgtaatactgtataaatgcaacatttgaggactacagaaatggctgctacatggattatattactaagtattctgttaaatacaccttgaaaaaatatattttttaatctagtagcataagaacaaattagaagatgaactatattcatttctatttctaactagtcaaaacgtttacagtatctctcttgtctgctagtttaaaataaactataccaaaatatttaaggcactattatcgcaaaggtttttatttcaaaataagggataagtgcttataaatgtgtttacctctttcctcagcctttctacttcagaaggtaaagatttcaattctgaaagcaaaatgacttcttcccgcaaagcttcattttcttcaacttctttatttagttctttctgaagatcagtaatctttccttccaattccaaattacagagcaaatctagaaagttttggtaaattgtataaagatccaatgttgccaaacaggtaatttaatttttaattgtccttgaatcacctttttcaggatcaggtaaagtttatttgaaaaataatcccttatgatttgaaacccatggaaatctttataaatattaataccaaatgaaactaaaacgtaatattgagtttttaaaaagtcagagtataatgaatttttaatcattgaaatatgcttgtcaaattgtttaggtacatttctagaagaagtcagatttgaaaaaagatgtttaaaattacaaaataccttttggaactttgccatctataagggaggtgagttttgttatctcattaaaagcagattgtaattctttctccagatcaacttgcattttcttttttgcctccaactggctttgatataactgaatatcattttccatttgcttgtatgtagttgcaagttctttctattgagaaaaacattgcaaatgcacaaaaatacactgatcattacaactactttattataaatattacaaaaaatacttaccattttctccttcagctccagattttcacttctaagaaaggctgattctctcttggcatcaagggctacagtttcagcatcaaacagagtctgcttcatttgttttgggtcttcaatgctttcctagacagatgacaaaaggggttcactgaaatctaattttcacagagttggaaaattcttaagagaacatgtatataaatgttaactctagctaatcaaaaagcgtacaaatatgctagttaccaaatatataaaaagaaataatgttttcctaataaaaataatttttaaaaattctggtcatatttttcaaattatataagcaatatatcaaattatataagcaatgtatcataatttagatctgttttgtttaaaggttaaaacaactgttgttcggcaaggctgatgaagttttctatgtatttttattttgagttattctcttcagcacatgataggtaagtggctaacagttaaattaaagatattaacccacaaattgaaaaggaaaaagacaaatgatctaatagaaaaatagagaaatgatatgaacaagaaacttacagatgagaaaatgcaaatgaaaaatacatgaaaaaaatctacaacctcatttctaaagagaagtggcattttaatatgactttagcttatatgaaatcaatgatatgtccttggaaaaaaattaataaattaatacatgaatgaataaggaaaaagaaatagtaatttttaaaaagtgggcagttctgcttgccacgctatgaacagacactccagaatacataaaagtgccttcctatccagggcctcagaataggatgatatgaaatggtatgaacccctttgaaaagaatcatttgtcacaaataaaaggcaacaaaagaatagaaggtaacaaaaactaaaaaactcaactgaaaacagaagaacagaaactagtcttttaaaagttccagctagaaactgttatcataaaaaaaaaagtattaaaaactggaaccaaacatatataagtaatcaggtatactgaaagcaaactgaagcgattaaatgacatcatcatcagattcaatgttagttaatgccaagatcttatatcaactaaaatcatctagagctataaaattgtgaaaaaatatcccagtttaatatttaagatcttgactatatactactgcatgcatttgtataaaactactgaaaaaaattcggaattttaaaattttactgatttttttttttttttggagacagagtcttgctctgttgcccaggctggagtgcaatggcatgatctcggctcatggcagcctcaacctcccaggctcaagcaatcctgccacctcagttacccaagtagctggcagtacctgccaggcttatttttgtatattttgtacagaccaggtctcactatgttgcccaggctggtcttgaactcctgggctcaagtgatctcccacttcggcctcccaaagtactggcatcacagggatgagccactgtgccctggcctaaaacttactgatttttaatgggagcctgtccttaacttccttatatttactcaaaggatgacatgatcaactttccacaaatgtgactttatctctaaaatggcaaatatactaacagtccctatctcatagggttattgacagatttaatgaaatatatataaatttattacaacaatacacagcacaaagtaggtccagtataagcatttgctaagatgatggtatgctatatatatttatgtgattacacaacaaaatacgcctgatttttaccaatgagtatgacaagtccatttttatattttctagcttttgagagtctatgtattcctgtagcttcttaatctggtcttccttttctctaagcagctctacttttgaactgagttcattctaaaagaatcaaaggagagagtaacaatttagaatctgatttgaagtctaagggattaaaacagaacttatatatattagtttaaattcatagtaaaattcaaagtcactaatattttaaaaacataattcccttatttctgacatcatgttcagttacatatgttgcatgttttatagttctaattgcttatcaatagaaataccaacatgaatgctcacctcaagatcttgattatatacttctgcatgcttaactaaattctttaagttcgaaatttcatgaattagttgcatctgtaagagcatgtgaacaggtaacagagcaaaccaatagttaataaagcaaagcaaaaaaaaaaaaaaaaagaaaaagaaaaaaaagggcactggttcactgcttcagaatcacccaacagttagaaaggactgagatcaattgttcaagctatcgcaacaaagcacctcattatttaaaaatactagaaatatcacccaaaacatatcaaacaaataaaaaaaaacccctcagcatgaccccaccaagtagctatatcatctgttaataaagctacaataatgtcaatagcaaattagtatgcactacttggaggagagatttaaaaagtggtaatcaaaccttgaaaaatacacgtttagtagatttttgttttcagtcagttaagtacagaaatgtattaattcttataaagttttttcttcccataaagtatccatcagctctacattagtgtactttttaataagttctgatttggaatctaggtttggattagggttgtttcatgcagtgcctttacaatattattacttttcaccagtgctacacaggtatggaatgatcaactatgaccttgatttattccagaggaaatattgcactccattatattgttcaaccatgtaaaagtataaaggtagaagtatttctattgaggtgtcctttctaccaaaatatctgtagcattaaatatctgagtaccaaaaagtttgttgaaaacaagtaaaccacacataaccaagataaacattttcccttagaattatttaatcttcataatcagatgagcacttacagagtaaaagcaaattctaatagtatgtaaggggcttgaaaatagtatcttatttaaatattttctggatgtttaactgagtcctgactagttttaaatttcagactagtgcaagtgttgacattactattttaggtcagtgctatccaagagaaacataatgtcagacacatatgtaatttaaaatttcctagtaggcacattaaacctaaaaagaaaaaggcagaattaactttgagaacatattttattcaacctaatatatcaaaaatatttcttccaaaatgtttcttcaggtaatctatccaacatgtttctttaggtaatcaatataaaaaaaatgaacaattttacattcttttttatatactatgtcaattcagtctggtcccatttcaagtgcttaattgccacatatggttagtggctaccccactgtagaacacagtcttagacatttgtactgcttttaatttaaattggctccttctttcaccttttcttccttatttttaacttctgtgaaagaaaatcacatttaccaataagaaagaatcaaaaatcaatcttaacttttaaaaatacttagaagagatcgggtgcattcagggtagtatggccatagataatgaaaacatttaaagaatactaatttagaaaagaaaattttcctacttcttatttgaaatagcactttatcttagtactggttcttatgcatagaaaataattagcttttataaaaataaaagtgtaatctcccaatgacatgtttaagatgcagagcatgaagtgaaagtgtgtgaaaaggaaaaatgatttaaacatatgatctgatctacagttaatccattgctaccatttaaattgcagatttaaatggtaattgtcattaggtgaaatgaaatatttaacttacatctccaagtagtaaaaattataaaattaaatacaccaagttaaaataggtagacggtaaagatttttctcattcctcgagtatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcagtggctcacacctgtaatcctagcactttgggaggccgaggcgagcagatcacttgagcccaggaatgtgagactagcctggccaacatggcaagacccccgtctctataaagaaaaagttttttaattatatgtcttttagattagaaagctgagctttgtgttttaaaaaaaaaaaaaagaaaaaaaagaaaaagaaatttaaaaagaacggagtaggattcttcctcctcaactgtggttaaaatgggagaaaaactgcagtgtgatacatgtcatatattctgtggtatttttgtaatctttctctgtgttgactcaattcaataagcttcaatttttcttattaatatattaatgatgtgagaaaaatattagagaaattattaccacttatcccaaacgttagttttatgtcatgttattatcacatataaaaaacatacaaaaattagatgaaattttaaagtcagaagggaccttggtgagcatctggtctctacttcaagggtggagaaatacaggaagccctgagattcagtgacttgcccaaggccttggcaacaattcataataggattggatctgcggtaagtttataagtggcaaaactgcggcttaaatccaggcaatttcactctagagaccatgttcttaatcatgacactaggccagtcccttccataaaacctagttttattgattaaagtccaatggttttgtcatgcatgacattttgcacttcattaacatgcattttaaaacaagctaaatgaaaccctgtggagaacttatagacttttacctctttgaatatagtacctatgaaataaagcaataattttaatttgtaggtagaatggaaataatagctttggcatagaattcttttttcctttaaaaatgaaaagaggttgagaaactgaacaatgatatcgaggaaaaagggtcatggccttttgggctagccacatagaagtctgaagagtagctgcaaattaattcatcttttaactacataaaacactgggtcttatttttttttgaaggggggatgttcacgaatcactttgcaagtctgataacaactacagattcttgttccagaaaaatgaatatgcattgaaaaattctgcaaaataatttcacagcatctgtggcctctaggttaaggacactttacactaataactccctttaatcttttggacaatttctgagtccctaaagtctgatggtttctggattaagttctcttaacgtgtagcctaatattttatacttagaaaatgagtgatctgtttctataaattccattataactatttagtattagttatactaattttcacataactctcttagatggagaaggaaaaacaaaacgtacaaaattagcttctccagctattctaatgttttaattatttagaaacatactttctaaagaaaaagaaatccattaatatgtagcatccatatataaaatagtcatctagatattaaaattcatactgatctcagtaggaaactgctgtgctctaggtagcatttatatatgctcaataaaatgtaatatacaaactataaggaaacaatttcaagacaaatccatcaagaggtagatacaccaacccttcccatagatgcttttaattcctttttctcttgcataagcaccagggaaagaaacatgatttaactatttttaaaatataaatgaagaaaatatttcttaaattttctaaattgtatatacatatgaaaaatggttagatcttcaacatctcaatcttagaaaaaaaaatctttaagacaatacttctgagtgatgtcaagaagatgacagaataggaggtcacctgctcacatccccccaaaacaacaagaattctgtacctattacagacaagtctttttgtgggagcctttggattcaggtaggaggttgtaaaaccccagtagaactcaagacctggaagtgttgtttttgagagtgcataccaacacccaggtgggagtcctgccaattgtgctcccaggttcatatgcagaaatggtcccattccttgaaggacttagctacagccctgtttggcctagagtctgcaaccaaaactatctgtcaaggggtccaggagaaatcacacactctagggtctcggcagatgggctcttctgcctgtcgacattggtcttggcagtggacccaaaagttagcctataacttggctcctgccctcctcaagctgtagtcctagcttagtactgcttgcacaaggacccagaagggaacatgcccatctgagccaccaggacaggcttgccggcctctgtctcatagcagattccgacggggacatgtactggctccagccctcccctgctgcagcctccctgctctcacccacacagagaactgccaagagatgaacctgtctgagccactgggtcaggcttgcagtcctccatcccacaatagactgaaggggccctgtctcagcttcaatgcctctttgctgcagtcaggaagctatctcgactgtattgggaactgctgggtgaagcacctgccccagccaccaggacaggtttcatgcatctttcccataatagatcctaaagcagtcttgtcttgactgcagcccctctctactgcagcctggcagttatcctgcctgtgtaggacaggcctgctggcttccatcacatagcagttctggaaagaaccttgaatgtcacagctacagaatgcaagcaatcctccctgcataaggaactgctgggagtcttgactgctggtgccaccaggttaagcttaccaacattggttccatagcacattctgaattaactctgaagcttggtttcagtttctcctagcgatagtctgagaatggttttacccagccggggtcctaccgggagacaggcgtatccaagtccctgtggcaggttttgcaacccttgtccatcagcagattctcaaatggccctggatcttgatactgacccctctcatctgtggaataagaacagctctgcccacctggggacctaaagagaaaggtgtccagtagtgcctctgcaggataacatggtgacctcagtcatactatagatcttgaaaagaccttataaagatggtgaagactaaaacaaatagctacattcatcttcaatgtgcagacactgctgcatgaccacaagcatcatgatcagggaaacatgatgtcaccaaaagcacaaagtaagatactggtgactgatcctaaaagatggagatgtattatctgccaaagaattcaaaatagctattttaagcgagctcagcaaacctcaagaaaacatagagaaacaatccagaaatttatcaaggagactgaaataataaaaaaaccaaacagaaatcctagagcaagaaaatacaatgaacaaaatgaaaaatgcaacaaagaacatcaatagaagaatggatcatgcagaagaatttgtgagcttgagacaggctattttaaaatatagagtcaggaggcaaaaaaaaaaaaggatgaaaaggaatgaagtttatgggacaacatcaaaaaagcaaatatttgggtcactgcagttcaagtagagaaaaataaagggacagaaagcttatttaaagaaataatagcagaaaattcccaaacctgaagaaagcaatacatatccacatataggaaggtcaaaggttaccaatcaaattcaatctaaatgaccctgccctaagatatattatattcaaactcaaaagtcaaagacaaggagaaaatcctaaaagcagcaaagcagcaagagtaaagaggcaaataacatagaagggagttccattatggttagcagtagacttctaagcagaaatctcacaggccaggatcattaaaaagtcaggaaacagatgctggagaggatgtggagaaataggaatgcttttacactgttggtaggagtgtaaattagttcaacattgtggaagacagtgtggcaattcctcaaggatctagaactagaaataacatttgactcagcaagcccattactgagtatatacccaaaggattataaatcattctactataaagacacatgcacacgtatacttattgcagcattgtttacaacagcaaagacttggaaccaacccaaatgcccctcaatgatagactggataaaggaaatgtggcacatatacaccatggaatactacgcagccataaaaaaggatgagttcatgtcctttgcagggacatggatgaagctagaaaccatcattctcagcaaactaacacaagaacagaaaaccaaacaccacatgttctcacttataagtgggagttgaacaatgagaactcatggacacagggaggggaacatcacacactggggcctgttggggattgggggcctaggggagggatggcattaggagaaatacctaatgttaaatgacgagttaatgggtgcagcacaccaacatggcacatgtatacctatgtaacaaatctgtatgttatgcacatgtaccccagaacttaaagtataattaaacaacaacaacaacaacaaagaggaatctcacaggccaggagggagtgcaatgatatagtaaaagtactgaaggaaaacagttgtaacatcaaaagttagaaaatcaaatattcagaaagtgggaggagataaagtgtggagtttgtttgtttgtttagtaatcaatgataatctgttatcagtttaaaataacctgcataactgtaagactttttcttgtaagcctgatggtaaccacgaaggaaaaaaacctataataaatacactaaaaatagaaaggtatcaaaacatactatcagagaaaataatttatccaataaggaagacagtgagataagataaaaggacctaaaaaacaaataagaaaataattagcaaaatggaagtagtaatttcctacctatcagtagttcctacctatcaatgtaaatggactgattctccaattataagatagagtggttgaatggattaaaaaatccaaatatatgctgcctgaaagagattaacttcacctgtaaggatacaaatagatggaaaggaaggggtggaaaaagatattccatgcaaactgaaattgtaagagagcaggagaagctatacttatatcagctaaaatagactttacatcaaaaactgtgaaaagagacaaggtcattacataatgataaaggggtcaactcagcaagaggttgtaacaattgtaaatatatatgcacactgaacatggcagaatatatataaagcaaatattaatctgaaggaagagagactgcaacacaataataatagaggattttgaaactacactttcagcaatggacagattattcagacagaaaatcaacaaagaaatagcagatttaaactgcagtctagaccaaagagacctaacagatgtttacagaacattccattcaacagctgcagaaaacacattcttatcaactgcacatggaacattctctaagacagatcatattaggccacaaaaacagtcttaaaaaatttaaaatcaaaattatatcaagtatcttttctgaccacaatgacataaaactagaaattaataatagcagaaattctggaaatattacaaatacataaaaattaaacacgctcctgaacaaccactgggttaatgaattaaaagagtaattttaaaaagctaagacaaatgaaaatggaaacacaatataccaaaatgtataggatgcagcaaaagcagttctaaaagagaagtttatagtaataaacatctacatcaaaaaagaggaaagaaatcaaactacctaaactattacctcgaagaattagaaaaacaagaacaaactaaaccccaaattagcaaatggaaagaataaagatcagagcagaaataaacaaaatagggactttaaaaaaatccacaaaataaagagttttttttttttgaaagaaacaaaatcaacaaacctttagctagactaggtaaaaaagacagtcgactcaaataaataaaatcagaaataaaaaaggagacattacaattgataccacagaaatacaaagaacaattatatgccaataaattgaaaaacctagaagaaatgaattcctctaccacattacctaccaggactgaattatgaataaatagaaaacctgaacaggccagtaatgagaaaggagacttgaatcagtaataaaaagtctcctatcaaagaaaggcccaggacctgatggcatcactgctgaattctaccaacagttacagaagaactaatagcaattcttctcaaagtattccaaaaaattgaagaggaaggaatttttcctaacttattctacaaggccagcattacactgataccaaaaatagacaaaaaaggaaaactataggccaatatccctgaagaacagacagaaaaaccctgaacaaaatactataaaactgaatttaacagcacatttaaaagataattcaccatgaacaagtgggatttatcccaggaatataagaatggttcatcataaacaaatcaataaacatgacataccgcattaacaaaacaatgaaaaaaagtcatacaatcacttcaacagatgcagaaaaatcatgacagagttcaatacctcttcatgataaaaactcttaattaggtatagaagtgatatgcctcaacacaataaaggccacatacaacaaacccactgctaatgtaataccaaatggggaaaagctgaaagccttttactctaagatctagaacaggataaggatgttcccttttgccacttttattcaacatagtacaggaagttctagctagagctattaggcaaaagagaaaaataaaacataataggaaaggaggaagttaaattgtctctatttgtagatgatatgatcctatatacagaaaaccctaaggactccatccaaaactgttacaactaataaaaaactcagtaaagttgcaggatacaaaatcaacataaaaaaaagtagtatctctatatgttaatggcaaactatccaaggaggtgtcagatctctcaaatgaaaactataaaacgttaatgaaagaatttgaagaagacacaaatgggaagatatgcatgttcatggattggaagaatattgttataatgtccatattgcccaaagtgatccacagatgtaatgcgatatctatcaaaacaccaaagacattcttcacaaaagtagattaaaaacaatcctcacattcgtatggaaccccaaaagaccctgtatagccaaagcaatcttgagcaaaaagagcaaatctggaggcatcataccatctgcctccaaaatatattacaaaactatagtaaccaaaataacatgctactggcatagaaacagacaacaggccaatagaacagagaacgcggaaataaatccatgcatatacagtcaactgatttttgacaaaagtgccaagaacatatgttggggaaaggatagtctttcttcaatagtggtgctgggaaaactgaatgaatatctatatgttgaagaaaaactagatctcctgtctctcatcatatacaagaatcaattcagaatgagttaaggacttaaattctaagacttgaaactatgaaactactagaaaacaagatagtggaaatgcttcataacattggtcaggacaaggaatttttgaataagaccttaaaagcacaaccaaaaagaccaaaaacaaataaacggaattacaactaaaggcaaaggaaatcatcaataaagagacaatatttgcaaaatatttgcaatatttgcagaaatatttgcaaaatatttgcaatatttgcagaaatatttgcaaaatatacatctgacacatggttaatatccaaaatatataagaaactaaaacaactcaatagcaaaaaaacccccaaacaacccaattaaaatataggcagaagacctgaacagacgtttctcaaaagaagacatacacataatatgttcaatattactaataatcaaggaaatgcaaatcaaaaccacagtgaggtattgcctcatcccaattagaatggcttatcaagaaggcagaagagaacttgttggcaaggatgtggacaaaagagaatccttttatactgttggtaggaatatatagaaaacagtatgacggttcctcaacaaagcaaaaatagaactaccataagatccagcagtcctactactgggcatgtacccaaaggaacttaaatgagtatgttcaagaaatatctgcattcccatatttactgcagcactttccacaacagccaagatatggaaccaacctaagagtctaccaacagaagaatggataaagaaaatttggtataaagtcacaatggaatattcttcagctatttaaaaaaaaaaaaagaaatcctaccatttgcaacaatatggatgaacccaaaggacattataaaccaggaacagaaagacaaatactgcatgatctcactcacatgcagaatcttaaaaagctgatctcttagaagtacaaagtataatggtggttattggaggctggggtgtttttcagggagaagaaaatggggaaatcttggtcagatgacataatgacagttagatagcaggaataaatttcaacagctctattgtacagcaaggtgactatagttaatgacaatttattgtattcttaaaaaacataaaatttgtggatactatgtgctatcaccacaaaaacaataactatgtgaggtagtacatttgttagctagatttaaccattccacaatgtatatatacttcaaaacatcatacatcatgttgtatacaataaacacataaaatgttatctgtacatttaaaaaaaattaaaaaagcttacattatagaaaaaagagaatacttcttttaaaagtatgcttttagtttagttttacatttctgtctctcttacctcttgatcttttttagtttttctttctagagcctcaaattcatccaaatcattcttttcttttaatttcaattccatttcttctttttctgttcgtagttgttcatagtctaataccagattatcatagtcagcacgaagtgagttcaactcactttctatattctcctattataaacaagaacagattttccaatcagaaaattcaaatattttttgtttccttaataaaatttgaattatttaaataactactttaactttgatttgatatctttctaaagttctacattttggcaaactagctaacttagaatagattattttgaaagaaggagaattttaaaaatatatcaataaagtgtatgtttgcctgtgcctgacagggaattttgaccataagtcctcaagctcctcagtaataaaactgataattgaattccccaatctaactaactcttattttatgtctcagatggttctgaattcaagaatggaaacagagatattatttattgacttctaaagctaatgacaactgtgttttactataaagaggcctatttctattttctatattattataagagaagagataaaccatgagttaaaaaaatacttttttacaccagagattgtaaaaaaaacccaagaaacttctaatgtatgtattaggaacaaaaaaacactttatcaataatactttataggaattaactaacaataataagtagtaatgcaattatattctaaaattcaaatgaaaatgtctattactttatacaactatacatctttaaacacgagcaatctacaaagtaaacacggaatctaaacttactgatgtattcaccaaaattacctctccctgatatattattctatacattataaatgcctgagaattgacacttttaaaatcagtcttgttaccctaatgaagtttaccaaggcaaaacagaaactttacaaacattgtgaatactaagatctgctagtaaagagctagaggcaaaggtttacctactagcacatgtctgccttatgaaatttttagccttcctctaggtgcctgatggttatagagtagaaatgtaaagagaaaagccttcattagagccaaaatcattactgaaattaaatgagaacaagtaacaaaacctaataacaaaagaattttaaaaagagtaaaagcattatatgctgtaaaatacattaagttacctgatttagtagctttgttgctggattccattctatctcacttaatgtatcaagagtgttactgaaaacatcagactctgaacagacagctataattagagaaaaaaaaaatttgtccatgaacatgtttaccaaatttcctaagtcaaattaaagattactaaaaaaattcttatcagagatactaagaacttcaaattaactactatgtgctcagagtatgaataccaaaagtacattaatagatatggtcatttatgttattgtatgaattaagatgatcactggttggaattagtgacacaatacaggatccttaatgaaatataggttaaaaggacaaattctgaatttgagatttgatcattataagtagatttaaaattcccccccaacagactgtactattgaagaaataattttgaaacagattcctatgtcaatgccactcttttaagattagcaaaggcagatgccatataactaacaatttaattgaataataattagaaaataaaaacacctgtctcatgtgtgtttcaactagtgcatcattcttaggagattcagaataaagaacttatgattactttctatttatttatttatttatatttgtttgagacagagtttcactcttgtcacccaggctggagtgcaacgggtcttggctcactgcaagctccgcctcccaggttcaagcgattctcctgcctcagcctcccaagtagccgggattacaggcgcctgcaaccacgcacagctagtttttttgtatttttagaattacttattttaaatcatagtctccattgtaatcacatatgaaatacacagtatttaaacatgtttatcacattaactgagctataaacatagtttctctttataaggatgcttttataattaaacatagttccacttgaaaaaagcactcacattcatcaatttctcgtaataaatttatagaaagcttatgtgtttttgttgttatatttgttggtatattaaattgatctgcatagtttgagttcttcattttgttaattttgccaaggcaccaagtaactcttcgttttcttttagcctaaagaagaagaaatcaaaattatgtcatatagatctgtattcaaacataataaaacaagggaactagtttctatttttgaaaaccattgacttggtagaattcttattaagcctagtttaaaattttattagtctaaggatattgcttaaaaaaaaaatcaaactcttgactctttacttcactctaactaccattttctttttttcctactttgtcctcctcatcatttatccactccttcctcaacacttcagggacccatctcctggttcttaccttacccagctgctgtccttaccactcactctgctttgctagtttctcttcctgtgcctgcctcttaagtgtgtttctccaggtttcatagccaccattcttctcttgactctttactgggtgcaagtatcatctcatcttatttgactctctcggcaaccctagggttgtaatcacatctgaaatacacaaccctaaggttgttgagagaatcaaataagatgagatgatacttgtatcgagtatcaaccttactacatctttttaacagatgagttgggtgcccaacaagtttggagaagttgcataaggttgtatagccaattggtggctgagcccattgtctattacttcagagcctatccatgcaaccattccgtcacattgcctcttaagattacttgttgtccacagaatatactgcatactgtcatgcctctctgagtgctgtccttctgcttgaaatggccagccctttccacaccctgctctgcaaaagccccatcatattcaaatcctcgactccaataaccttcagtttaatgccagttgctaccaaagccacacctggaccttgtcattatctgaaagtcataaactagacctcttgctctcattgccgttgctgtccttccaaatcattaatttagttaatcccactatagctatttagctcatcaggggctatttagctctgttcccttgttgcatgacttttttttttttttttgccatctccctcttggttctcaccctatcatcttagattccatagatcactgtaatcatgtttgaaatttgaggtcaatgttctcaaattatttgacccactctctgtcccttacatgtaccctacacggcacactcaaatggcactgtgttcaagacctttatcagcctcctgagcactgccagagccacacagccagaagaccggctgacaagataaactggacctttaatgttgcatggcaatattcccttcccccttgtcagctttctttttcattacctacaaaggctagcctatttcaaacccttagtatctctgcaaacttatgactctaccatcacctgccatctcagcagaagaattaaacctatttcacaaagaaagtataaacctaaactcctaagagtactacctgcacagaagcctatcctttcctccatgtttgctccaattcaagaggtatttctcctatgttagtccaattctttctactatattcaagattccatccatctaggccacctcaacacactataaggtggctttcatccccatcacttaaattacttttgcaaatgagctctgtgtttctaaatgcaaataatttttgtccatctttatcttatttaacttctcagcagaatatgacactgctgaccactacctccctgaaatattctctccccttagctaccatattcactaggttttattcttaactgtacagctaaacctgggctgctttatggattcttctttctctgccttacccaattggagttttgccttctgtcactttgcctcctgttgccttctctcaacatgcaaccagaacaaactttaatttggatctgtagtagttaatgcccaaattgatatttatatctcaaatcttctacctcatattcacacatttgcattttcaacagcctgacatctcaaacaaaagaaatcccaaataaaacacccaccatttccactgctctttattcagtgtgccttaactcaaccaatattgttaccagctacccatgaagccaaggaattgcttgcaagtcattccggacacctccttctccctttctctgccctcaacatccaaacaatcacaaagtcctgctaagtttaccttccaaacatttctccaatttatccaattcactccaactccagagccacaatctttgcaggcccaagcaatctgatgtgcacagtagctacatctttctcaactataattctgatgtcacacacaaggctgttctttgttgttagcaaaacatcacattcaaatccctcaaggaggtttaaaacgcccctgctactagaacatcttaagtgcaaggaatgcataatgtttcttcacaactccaagcttttgtacatgtaggtctcttttgaaacattcttctctaggtctttcattgggctacttcctgctcaccactcaaccaatagttcttgattgtcttctatatacctctgtacataatgcttattcacattaacaatgtacattagttgagaatatgctgtgtggaaagtgctgtgttgagctaattctacctattatctcatttaattctcacacaacacttatgaggtgagtatcaagctattccacactgctacttccacaggaaaaagcagcaaagtgaattcaagaaattgtccaaggccaagagtcaggaaatgacagattcaaatccaggaagtctagctccagaggtcattctcttatccatgacaccctcacaccccaaaaagtctactgaataaataaattcctactcaattaaaaacaaacaaaaaatcacaccaacaaagtaagaattttgttcactatgttgtttttctttcaccagagtctacattgacacaattatgttgttttatattctacaccaattttcctgagattaatatttctgtttaagtagaaaataatatttccacatattctagaaacctatggcttccaatcacccagtttctctagaatttattaagcagaatattgcaaataaattatttaaatacattccaaacttgttgaattagaatctctacaaataggaatcagaaattggcatttttaatgaatctcttaggtactatgaaacacaaaatcttctgggtttcttgaatatactgtatcaaaggatagaaagtgcatactatataataaacatatagaaataccaattctattctctgtacatcaagtttaagctgtcatcttttaattttacctttaattcctgttgcaacgtgagggaagaagaggtcaccagcatccgtgttaagttttcaattttctcattctgtactttctgaagcaaatctttttcttccaaaagttgggccaattggtctttttccattgcctgagcccgcgtctctaaagaaacctatagaatgcaatattggattatgttaataataaatgtggctaagttttaaaaccttaaagtagcataaaagaataaaatattaaatttgtatatgaactataagaattttaatttcactgaaataaaatatactctaactgtagaacaccaaaatgcagttaccataatcaataatttctcagacttacaataaaatacacatttcttctcatgtaactattctatataccatgtataagacaccaatgctgttaatataactctattaattgcctaagaagatatgaatagtcagaagtcataaaacaaagacttgaattctgatagtaaagatagagatgttctcataagattaccatttgatattttagctcattttaaaaaagatccttaatgcgtgattttttacaaaatatgggaccatgatggttaaaacaaactaaaatgataagtaattatgctatattattagattgctatctaagggttagaagaggaattcaggataacatgaaaacacagaaggtggttctaagtaactctgtagtttctctttttaatcgaattcatatgtatttgtgaaaaattttaagaaatgtctctacttggcccatttgataatctcagattttgcccgttgaaaataaaaaacaaaatctaaaataatttcaagaaccaaatcttacaatttatagtaaattaaactaaaatttttatgagtggatttcttcttctttaaaagtgattaaaaacctaagttgtagcaactcagatattcaggaatgaagagtctctgagcatttgggcaggtctccattctaaattggttctttcaatttaatgaaataaatgattcatacatacctcctctaattgttttttaagatccattatttcttttctataccttttcaggagagcttcatcagttgatacctcattaacataaggagtattcttcatatatttagcagtactggcaaactggaaaaaaaatacgaaagtgctaagtgttcaacacttaaaaaaattcgaatttaattaataatatttagctttcttatattcaagattaaaaaaatcaatactctttctagttggcttaatacttttgaacaaagggaacattctatgtccttataacaatgctctgtaacttatcctgggtgatagtcttcgggagaataaaaaagatatattgagagaacttaaaaacatcagcttattggaatctcatttacccctcaaggtccagtgctaacgcctcctctactctgaagttttgcttctagccaaaaatatctctccttcctttaaactctatactagttattaaccacttaactactaatcaaaggcaattatgttgcaagacaagtgttatgtgccttgtcacagaattcattaattctgttaagccagggactctagtttctctttgcacctctgacagtaccttgatctggtgctcaacagctatttaaagcaatgtttctcagagtataagtaccataagtaactttaggtgggtacaccaaggtgaccattagataacattgaatccttcattgagaaagctaccctactgatatttctcatttttcctttccttttttttttttttgttttttgttttgagacatagtttcgctcttgttgcctaggctggagtgcaatggcgcgatctcggctcaccgcaacctctgcctcctgggttcaagtgattctcctgcctcagcctccccagtagctgggattacaggcatgtgctaccacatctggctaattttgtatttttagtaaagacagggtttctccatgttggtcaggctggttcctttcctttttaaaatagaaaatgtaggccttaggctcagagaaaatgaaggcaacagttaactaccaggaatttcagaattattttgttatacagacagacacacaattttttttgttaccttctatttgtggcaagtaataatagtttcccattgataggactaatattaaagtttccttttacaataaattaagtacaaaaagtgagttattttaaaaatatcaagtcaatttcagtaaaatagtgttgggtgtggcaaaaattatgaaggtaagatacaaataatcgaagtctggcaaaattaaattaagaaatgctatttagtagacaacatatcgattataacaggcgagttaattaaaaaaaactatgcttaattttagtaggtaatgttttcttcttcaagctgatcttcccctatattaagctgagataaaaatcaaactcacctggagagcagtaagtgtttcatcaaaagatactggagtaattgtgcagataatacgtgtctttgcatttcctcccaaggaattctggagaattcgtgttaacttgctatctcgataatttatgaaaccacttagcaaggaataagtttacaggagaaaaagattgagaacgtttatataataaagtagttggtttttaatgcagaactcttaaatcagccagagtttcaaaaattagtttacaagttatatgaggcagattaaaactactaaaaaatatttaaaacagaaagtaaattcagtagattataatcatatgtataagtttttgaatatatggaagaaatcagtacatttgagtgtcatcgaaatgttgcaatgttcaacctaatgaaaaatataagaatcagtaggtaagtgcacaacgggataaacttacccaacttgtccatcactaagtttcttgatcacttgtcccaaaataaataagcttcgatttatattacagccttccttgagccgcacacctgaatttattaaacaaatatgaaaactaaacttgactccttttctagatgataaacttatttatcactaagttaatgagagaaattagagggcagatgctaaagtctatgctctggtttagacatgagcccatctttaatatcagtggtagaaagagctctctccctattggtcccacttcaagtgaatcagaaaggttattacctgagaaaaatagtaaaaagaaaaaaatgaagagggagggaagaatgcagggaaaaaaaacctgtttcctgaaagagcttctctagctcttcagttcaaatcaatttttttccaacatctaaatataggcaactatgaacttacaaccaaattagcctctaatttcttatttttaaattgttaatatgctcacacggttcaaaaagtttaaaaaaaaagtacactttgaaaaagctcccttccacttttatccccattcaaccagttcctatacctctaccaggaaaccactgttattagtttttttctttagagatttttaaaaatacaagttcgtatgtatttatttccttccttcttcactgatatcaatagtaacagtccatacatactattttgcactttgctttttctcacttggcaacatatcttggaaaaatttccatatcggtaaacactgatctttttcattcttttttaaagtataaaattccattttacggctgcatcagacttcattcacccaccccatcccctgttgaaggacatgtaggttttcagtctactgcctatacaaaaaaaattgtaaaaataattttgaacagatgttatttcacaggtgcattaattagctattgctttaacattactacctaaccaaccggctaaaacaagcatttattttttgttcacaggtctgaggatggactggtttggtggatgtaggctaggctcagttgagtggctctacaataggttgcagaatgagctcaagtctgttgaacaaacttctaatcttccttggatcagcagctcttctaatggcaagagtgcaggtgcaagctaaaccatttaagcattatgaactattcatttatatcctttgcccagttttttgttggtttcttttaagcttttaaggcatctggactttgtatcagttacaaaagggttttcccactgtaagttgacttccaacaatttttagtttttttatattgaaatttttgagctacttataatgcattccttggtgtatgatatatggatccgacttaattttttttcccaaatggctatcaattaatgaataatctatcttttctttacaaatttgaaggaccatctttattgtattctaacttctgtatgtatttgggactcttgatggattttctattctatttcactgggctgacaattcacacagttttaattactatggcattataatatgttttactatcttatagtaagatagtaaaatcttaaattccactttctgctttttggaattttcctggctactcttgtctgtttttatgtttccatacaaattttaaaatcatcttacctaatttaaacatgaaaatgtactcttgatagtcttattaggattgtgttaaatctagaaattaacacagaggcctgatatccttgtgattttgaatcttttccatttaagtatgcttctccattttttcaagtatttgtttgtgtccttcaagtctgatttacaagttttcttaggccgggtgtggtggctcacacttgtaatcccagaactttgggaggccgaggtgggcgggtcacttgaggccaagagttggagaccagcctgaccaacatggcgaaactctgtctctactaaaaatacaaaaattagctgggcgtgatggtgcatgtctgtaatcccagctacttgggaggctgaggcatgagaattgcttgagcccaggaggtggaggttgcattgagctgagatcgtgccactgcactccagcctgggagacagagtgagagtctgccttagaaaaaaaaaaaaaaaaaagttttctttatatcagtcttgtacaaatctttgttgagtttcttcctagatatcacatcttttaggttattataaatggagtctttttgtctactaaatattttaacttgtttttattaatattttaacttttaaaaattaatatctgcatattaattttgtaccacattatctttcttaatttccttattttgaaagtttaaatggtttttatggaattctcatgggctttcctgctgtacaatcccatcaattgtataattttcattttttaattgatgctattgtagactaaaataaaaattaagcagatacagatgctgatttctatgttaaacttttatcagaaaatcacaattaatgattcattattattaataatgaatataattactttatcaatttctaaaaatgcctggtagtactttttaaacctgtaaaataggaagacattaagactaacatatttcatgagttttaattacctgcagcgcctgtttgagcagctctttcactgcctgcaagatcaaccaaattctgtaagatagataaaaataaatccttagggcagataatttgaaataataaaattcaaactactgaaagaacatttttaatacatggtatatctgaatattcgatctgtatccatgtctcccatgctactgtttaggcattcccttttttctctgagtcaaactgttctctatctgttcctttctttatatcttccataatgccaccagtataggttctgtttcctatacaaggtccaaaaacttactatggcaaatataattctttataagctggcacttgcactgctccaactttgtatttatccatcccttattcttacctctagctgaactactcactattccccaaacaccccatgtacttctacacctccaagcaccagctttttgctatttcctttattcagttagttctaatgttctattctgtccttattctttattcaagaaccaggcacaaagattatctcctcagcatagctttgcctactttatccttcctccccgccagatttcagatgaactgctccttgaactgcataaccagaaatctttataaacatgacttatagatacgacttacatttatagcacttattttgttgggctagtcatgcatgctagctgtactatgctgtagcaataccatgactttactgtggcatctttaagagctggacctctctttcatttcacaaatattactgaaaagaagtggctgcttattatgctccaggaagtacatcaggtgctagggctacaaataaataaggtctctgctctcatggagcttacattctacatagaggaggaggctggtaagaagagataaaaagacaaataagaaacatgttgtgataagtgtaacagagattatttaaatagagctggaaaaggggccagtagctttaggttcataggactggatagcagtggaaggcttgtcattaagctgcgatctgaatgacctgagaagaggaagctggtcccaaaaagatcaagggaaacagtagtctagacaaaaagaatagccaaaacacttagtcacaaagcagaatgtgctcagtgtgttcaaaaaaatagaaaaggcagtgtggcacagttggtgaagtgaagacaggaaaagacagaataagagaagtagacaggggccagattatgcaggactttttaagtgagatctaaaactctgaaatgtttatattcaatgagaagccattgcagggctttatgcaagggagtaatagaaccctgccttgctagattggggaagttctcctggataatatcctgcagagtgttttcctactttgttccattctccctgtcactttcaggcacaccaatcagacgtagatttggtcttttcacatagtcccatatttcttggaggtttgttcattacgttttatcaaattcaggaaatacagagaatgccacaaagatactcctcaagaagagcaactccaagacacataattgtcagattcaccaaagttgaaatgaaggaaaaaatgttaagggcagccagagagaaaggtcaggctacccacaaagggaagcccatcagactaacagctgatctctcagcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagattttgtcaccaccaggcctgccttacaagagctcctgaaggaagcactaaacatggaaaggaacaaccggtaatagccactgcaaaaacatgccaaattgtaaagaccattgaggctaggaagaaactgcatcaactaacaagcaaaataatcagctaacatcataatgacaggatcaaattcacacataacaatattaactttaaatgtaaataggctaaatgctccaatgaaaagacacagactggcaaattggatagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagagacctacaaagagacttagactcccacacaataataatgggagactttaacaccccactgtcaacgttagacagatcaacgagacagaaagttaacaaagatatccaggaattgaactcagctctgcaccaagcagacctaatagacatctatagaactctccaccccaaatcaacagaatatacattcttctcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactgcatggaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaacttatagcactaaacgcccacaagagaaagcaggaaagatctaaaattgacaccctaacatcacaattaaaagaactagaaaagcaagatcaaacacattcaaaagctagcagacggcaagcaataactaagatcagagcagaactgaaggagacagagacacaaaaaacccttcaaaaaatcaatgaatccaggagctggttttttgaaaagaccaacaaaattgatagaccgctagcaagactaataaagaagaaaagagagaagaatcaaatagacccaataaaaaatgataaaggggatatcatcaccgatcccacagaaatacaaactaccatcagagaatactataaacacctctatgcaaataaactagaaaatctagaagaaatggataaattgctggacacatacaccctcccaagactaaatcaggaagaagtgaatctctgaatagaccaaaacaggctctgaaattgaggcaataattaacagcctaccaaccaaaagaagcccaggaccagatggattcacagccgaattctaccagaggtactaggaggagctggtaccattccttctgaaactattctaatcaatacaaaacaagggaatcctccctaactcattttatgaggccagcatcatcctgaaaccaaagcctggcagagacacaacaacaaaagagaatttcagaccaatacccctgatgaacatcgatacaaaaatcctcaataaaatactggcaaacagaatccagcagcacatcaaaaagcttatccaccatgatcaagtgggcttcatctctgggatgcaaggctggtttaacatacaaaaatcaataaacgtaatccagcctataaacagaaccaaagacaaaaaccacatgattatctcaatagatgcagaaaaggcctttaacaaaattcaacaacacttcatgctaaaaactctcaataagttaggtattgatgggacgtatctcaaaataataacagctatctatgacaaacccacaggcaatatcatactgaatgggcaaaaactcgaagcattccctttaaaaactggcacaagacaaggatgccctctctcaccactcctattcaacatagtgttggaagttctggccagagcaatcaggcaggaggaggaaataaagggtattcaattaggaaaagaggaagtcaaattgtccctgtttgcagatgacatgattgtgtatctagaaaaccccatcgtctcagcccaaaatctccttaggctgataagcaacttcagcaaagtctcaggatacaaaatcaatgtgcaaaaatcacaagcattcttatacaccaataacagacaaacagagagacaaatcatgagtgaattcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcattgccatccccatcagctaccaatgacttttcttcacagaactggaaaaaactactttaaggttcatatggaaccaaaaaagagcccgcattgccaagtcaatcctaagccaaaagagcaaagctggaggcatcatgctacctgacttcaaactatactacaaggctacagtaaccaaaacagcatggtactagtaccaaaacagagatatagaccaatggaaaggaacagagccctcagaaataatgccacatatctacaactatctgatctttgacaaacctgataaaaacaagaaatggagaaaggattgcctatttaataaatggtgctgggaaaactggctagccatatgtagaaagctgaaaccagatcccttccttacaccttatacaaaaattaattcaagatggattaaagacttaaatgtgagacctaaaaccataaaaaccctagaagaaaacctaggcaataccattcaggacataggcatgggcaaggacttcatgtctaaaacaccaaaagcaatgacaacaaaagccaaaattgacaaaatgggatctaagtaaactaaagagcttctgtacagcaaaagaaactaccatcagagtgaacaggcaacctatagaaagggagaaaatttttgcaatctactcatctgacaaagggctaatatccagaatatataaagaactcaaacaaatttagaaaaaaaaaaaacaaacaaccacatcgacaagtgggcgaaggatatgaacagacacttctcaaaagaagacatttatgcagccaaaagacacacgaaaaaatgctcatcatcactggccatcagagaaatgcaaatcaaaaccacaatgagataccatctcacaccagttagaatggcaatcgttaaaaagtcagggaacaacaggtgctggagaggatgtggagaaataggaacacttttacactgttggtgggactgtaaactacttcagccattgtggaagacagtgtggtgattcctcagggatctagaactagaaataccatttgacccagccatcccattactgggtatatacccaaaggattataaaatcatgctgctataaagacacatgcacacgtatatttattgtagcactattcacaatagcaaagacttggaaccaacccaaatgtccaacaatggtagactggattaagaaaatgtggcacatatacaccatgaaattctatgcagccataaaaaatgatgagttcatgtcctttgtagggacatggatgaagctggaaaccatcattctcagcaaactatcgcaaggacaaaaaaccaaacaccgcatgttctcactcataggttggaactgaacaatgagaacacgtggacacaggaaggggaacatcacacaccggggcctgttgtggggtggggggagggggggatagcattaggagatatacctaatgtaaatgacgagttaatgggtgcagtataccaacatggcacatgtatacatatgtaacaaacgtgcatgttgtgcacatgtaccctaaaacttaaagtataataaaaaaataaataaaaataaaaaaacgtaaaactggaaaaaaaaagagaaccttgcataaagctcagcaatgactctcacaatggatccactatgactactgggtggaggatggattgggaaggggcaagagcagctgcaggcagccccatcaggcagctggggcaggaatctcggtgagagataataccagcttgggttagggaggtggcagaggagactgcttgtaagagaagcagtgaaggggtgtcttgtttattgtttttttaatctcagagcccaacaccatgctcagaagacaataacaacttagtaaatattgtgagtgatttgaaagaaagtcaaagctttacgttatttctctctgtggagatttttgagactaggcaggtaaatatgtattaccagttaaggaggctaatttttcttgcacagtgtccactacagatgacacagatacataataaaagggcaaagtggtaatgaaggcagcatgagtgaaggttaaagatgagaacaagcattcatattcaaagatactcagaggcccaatctatgagggaggagttcatgtagagcagaaggaaataaagttagattggttaagagtggccaaatcttgccccaggaagtgatatacaaaagcaatggttagtatattcgaaatccttatgatgacttcaagaaacaaagacaagggtcatggagacaaggttccaggagactgacatagtaattcaagagagatgagaaagtaaatgagtgtagcacccatggaaatgtttaaaggtaggatcagtaagaaatgggacaagtggacaaagagaaaggcagaaaaagatgagtcaaaattgacttaggtttccagcttaggcagctaggataatgctggttttactggaaataaggaatattcactatggtaggaagaaaatagtttcgttttagacatattaaagtttgagataatgatgggacacaattataaccatctttaggaagacatgaattagaattcagagactataggtaaaatatttggcagtcatcaacatggaaatgatgacagaacatttgagagcaagaacttgagtaagaaacgtcacagaatacctccaagtttttttttttttaattatttttttaggagggtagggaaaaagaagccagggtagaaaacagaggagtacagctaagagaaactggatattatcatcccaccaaggccaggagataatcagaaaagagccacctctaaagagacagagatgactctttagagacttctttccaagaagattcttagagtaagtgggtaggctggagggttggaacagatggaacacaaatgacagagcatcacgtaacatgaggaaaatcatcaagtagatcactgaatatgccaagagtattaaagctaaattattaaaagttaaaattatatgaaatatcacagtcttggatgagaaaactaaagaggttagggtttggttttttattgttaaattaaaacaagattaaagtctactaaaataagttatacaattttatagcaaaatagctaaggtgaaattaggattgaatattaagtaattaataatctaattttataaaatctgaaaatgaataaacatattatagattgcttttttccctgaagttttctaatcaaataatcttaaatcatatcccacatcaagctaaagaatttaggccctaaaaatgcagaataaagcaatatggtaaaagatagaaaaggagcaagaaagaaacagcaataatttagtgtggaaagaaggaagtgaaggtttactaatgtggaatataggaatgtttgcataatgcatatattcgcttattcagcaaatctatattagacataaaataggtataatgtgttggggctaccaggatgaatgcagtatcactcctcaatggatttacagtctaaagtactacgtttacaatacaaaatatattttattgttgtacttaagtaaaacctaaagtaatgtgattactttttaaccatccaacctagatttttgttgatcacataagtctaaattacattggctgagattttacaaaaagaccctcaaattctaagatgatctaaagtgttaaatgtgtatagaaaaaaattctactgcattagtggttagaaaaaacatcaattcctataaccctatagccctgacatttaaattttaggagatggcaaccatgacataacaggaagaaagatcctctgaatttttcctacgacattttagctaggaatttgatgatactgacaagactaagcagacaatttgtagatttcctcccacatttagtttagttaacagttcttattaaaccaaacatccagcaactaaattaaattttgttttggcccatacagtacattattatggttcattaatactcaccaaatgggataccttaacagatccttcacaattagaaggttcacccttctctctgctttccaaaatctagatagaaaaggcaagctgtagaaaaattagtgcattcttacttggaaagatctaacagatagatagaattacctaccatcctaaagatggtatgagaacgactgcttctttgattcatttttgtttctccataatgcctgctctctgtaaaaatgagttatatttcagctgcatatataataaaatccatagaaacacaataatttttattttaacttaaaaaagtatgatttgaggtccaaacgtgcttgattgaaaagatagtttttacaagtgttctaaagaaatacagcataaagtcttactttctccctttgtaatccatttcaaagccatttctgatgtatatacaacttcttctgtgagatcagcaacatacacattcctctgaaacaagtttaattatggaaagattagagaaatagaagtcacaagtttgcttttcaaaagaaggtgcaaactattatagaattcatttgtgaaagttaaaagtggcaaatggaaccataattctgtaggaatgtaacaaataattctatgaatacccacaatttatttcacataccaaagcacaacaaattctaacctgatacttccaacttgctatttttacacttaaaccaaaatattagagctgtcagtattttaaaactattcatattgtttaaaagatgaatataaatacttcaaaaaaaccctcacatactatagaaataggagacactttaaaaactatagaaattaaaggtaaacattcaagaacaataatctcaataagtcagtcaattttaaagctcccttaagtctgctactcacattgacatcttctcgaataattaaaggtttcattttttgagtgccacagagtaaatctgtaatggtttcattgtatatttccatgtaagatacacgtaagagaaattccctatcaggaaactagaagaaaaaaaattatataaaaacaccaggaagcatccaattgtgaaaacctaatgctaaatgctcatgtgcttaaagaggtaaaatgtatgtaaaacaaactaagaaaccccttggttctactgttgacaaaataatgaacacaaaaatataaaagcatcgttacagaaataatgaaaagtgaagtaccataaagctgggagaacaccaactctaggctcaaactctaggctcaaaataaaaccctctcaaaagatgttcttattttaataaaaatgctaatttgaaaccaactaactcggttgcctattctggctttctgcttcccttctttttttacctacatccactttctactgttcctttataatcactgatagttaaatggttaggtggagctaaccattctgataacattttcttgttccttaatgcctactttttgttgagagtattattgttgcagaattcaagagaaagaataaaagaactttaagctttataaagtaagttgtggagataaaagtgaatctatgctatgcctttcttctttccccatggataatcaaacaataactgtaaatctacttcctttcatctttacaagagaaatacactaagactggtacccagtttttactagttttacctgtacgtactagaaatccagttaagttacttaccttcttaattttttggaaaatgtcatgaattgccctgggtataactcccaaatgatcttctgaacccatcatggtatatgtttttcctgaagcagtctgtccataggcaaatatagtacctgcaaaaaacaaaacacacatacgcaaagattaaaaacaaacctataatgggtaaaactatgcatgcttgttgcacagacgcccaagactaaaatgtttctgcagcattgagtgaatacaaaccattgtagccttgtatggcagaatcgatgattggtgctgctatttcttcatacacatttttggtagtttcattaccatgaaagacacgatctaaacaacaacaacaacaacaacaacacagaagttaaatcaaatgagtccactgtgttttcattccaaattagtaattattcccaaaagtaaaactgtcagaatgtaggatgatcaactatttaagacacagtatttttttcaactttttggttctctgaaaatacccttccctaaggtaaaatgagttcattttcacacacaaaaaatacactacaagtcaacttttctatgttctttcaagaggcaataaggtatagtgtttgcacatgggggtctggaatctacctagatgcaaattagataactgtgattataactgttttaaatgccaattggttaccttacttaaatacatgatggataaacaattttgtttccagtgaagcagtttatagaaggcttagtctaatctttagtgacaaatctaatattattgataagccttttgtacttttaatagcaaaaggataacaaggtaacttttgatgctattataagcttaccaaaattgaaggatttacttccatcaacttgataaatgacattattgtcagttttccagtaaacttgggcagtttctccaagtgattcttctctaaaagaataaaaacaccgcattttaaccagtcataaaagtcatgtcataggaggaataattgaaaagatttcacctgctaaagaatattttgaaagatagtaacataagagaatgacagaaagtccatctttgaggattcaactcttaaatggagcttcagtgaccttctgccgcctcaaaagtgttttcttgtgaaggctttcattctcaccctctcccccagtactggtaaacaaagggatggattcaaaatgcaactctgattatgtctgtcttgcttaaaattcttaaaaccttttggaaacttatgaaatcctcagcagggcacgagtcctagatcatgtcatttctctcttccattttcctctgaattcctagatacatcctaagctctacctgaaggtcttccccaaatgacagatgtaacctctctgtgcctggaatactctgacttccctttccattaagtaacatagggattatttcactcatgaaaagcgtcaagacttttctgacaccagttcaccccacgggaagctttcgtctctgatgggctaataactcctctagcaaacattctctacctgcccatcataacacttgtcaaaaggtatcctaatggtttctttatgtagccgtttaaggcattagataatgagctcctcaaaaataggaaattcctgatcttggtatttgcatttattaaaccccgtgttcaataaaaatttctcacacacacaaagtgttagcatttcgggtcgagggccagaagctagtgaagcaaaccgatttcatttattcctcttcctgctttttctccctagcacttattacctacatatcaccacttaacatcctacattttcaactttactttctgtctcgtcccattagaatggaagagccactgggcaatgacgggagtgtctgtgttgtacaaagtcactaaaaaaaaattgataaatatttgtagaatgatcttgagtgacgattgaatgtaatgtgacaagacagactagcccttgtcttcagagggtctggagacagcagttaggtgtaaaatgactaactgtgatgagggccaggaaggcacggtcccatacgacttctctaggcggggaatggggcagggaggagcagatgccgcaaggcagagcagcacagaagggaaggtctgtatgtcagcgagactgagttaaatttaagtgaatctcgcagctggaaagtatcttctagatctccgatcctcccctgtcactttacagaccctgaaacgatggccagcagccgagtcactagacagcagagccgggaagcagcggctcctggaaacatcgtaggcctcgcccctccggctcagggcggcgccgcaggcccagcgggcaccgggccgtggtgtggcccccctacctgctgttcagcggccgcactcgcacgcagacggccacggctccttcctccgccatcctatcaggctgaactggtcccaggaaaatggccaggaccctccgcggccggcacttcagggctcacaggccgccccgcctttaaatttaaaatttcccaaacgccgcatctgattgagccgtggcctcgtgacgtcatgggccattccacgtgcggagcagcgcgggggacgcaaggcgggcggcgtgaccactgctaaacaggagaggggatttaaagggcccagcagagagtcggaggagagggccgaagggaggggctcccaggagtgggcagagagtggtggtcctggaataccagaatactattatctgccaaaagctagcgaacgtcatcctccaccccatccttaaaaagtttggaacctgtagacgaaactaggtagagatacatgtatttttcactacccaaacagaattgccgtcttttaaagaaactgcaccaacagtttaaaataaactttcaacagcaagagttgaaattcgctgtccagtccagaaacgtgacaagcctgttgtgcgccttagaaaatctgagtttaggcttttctcctgtttctctctctctgtaactcgtttccattagctgtggcttcctcagaggttgaattagggaaaataaataccgaggactgaaaaactcattgagtaatgggttgatactttttttttcttcttttttttggaaacggagtctcgctctgtcaccccaggctggagtgcagtggtgcttatctctgctcattgcagcctccacctcctgcattcaagtgattctcctgcctcagcctccccagtagctgggattacaaggtgcccgccaccacgcccaggtaatttttgtatttttagtagagacggggcttcgccatgttggcaaggctggtctcaaagtcctgacctcaggtgatccacttgcctcggtctccaaaagtgctgggattaaaggcgtgagccaccgctcctggcctggtttgttacttttattaactaagagggaaagctattctaaatacagtgattttttcccaaaaataatgcttattttccctttcttctctctctctcttttttttttttttttttttttaaataaacatgagttcttgctttgtcacctaggctagagtgcagtaggctgaacacagctcactgcaggctcaactcctggcctcagcccaagtggggttcccaccttaacctcctgagtagcttggattacaggcacatcacaagcccagataatttttaaatttttttgtagagacggggtggtggggggattagggtagggagtggggtctcacagtgttgcctaggcaggtcttgaactcctaggctcaagcaatcctccttgccttggcctcccaaagtgctgggattacaagcatgagccatcgtgcctggcctagctttttatgtgtactttagaaagctatccaagatgtttcatttattaagagaaattcaaggtgcacggttatgtacacagaatatgtctggatatacatacataatttttggaaagatacacagaatatgcctaatttccttgcagagtgaggactgagttagatggtagactgagttagatgaaagtagtttctttcaatttaaagaaactagtttatagataagaacagtaaagaaaaatgagtctattcattcaagatttgttttggttaactagctgtgaggtagtataaacaactcttttttattgctagactgtaaagatacttggttgtatctagtaagaaaatacagagttaaggaaggtatattttaactgttgtttttgttttaattgtgggcaaatatgagacagctgaaggcaaggaacctatgaagaagaagggagatgtgattaatcaaaatttctaatgagacaagaggagattggttcacgagtaaagagaagtcatcagcctttcatagttgtgcttatgatcgttgctatgactgtctttttttatcatcacagcaggtgacatttattgaagatttactatatgccaggctctctattatatgctctctatccaattttttcatctgactttccaaattgttcatcaagaaatattcattgaacaactgttatgtgccagatacggttctaaggtcaggaagcacaacagtaaatagaatagacacagtacctgttgttgtagagttgctattctcttagaggagatgggtaatacagaaaaatctcagtctctctctctctctctctacacacacacacacacacacacacacacacacacacacacacacataatgtaatgattaataggatcaggagacagagagagagtgataaggtgggttaagagtgctagtttcttatgaaacacattcttgtgggaagcagcagacaatacataacaaatatatagtaaaataatgtgttgggaggaaggtttattttagatgagatgttcaagaaagacctgaggaggtgacctttgaagtgaaacctatgtgagaagagtgagccagacttgggaggacaagagaaagggcgtaccagacagaggaacaagtaagtcaaagaagccaaggcttgatcgagtttgtcatctgtctgagacacaaaggggagggccctgtgactgaagcatttgtggcaatggagagaggtaggcaggtccaggtccaggacccatggggccttgtgggctgtgataaaatgtttggatcttattctcaagggtgaggggaagcctatggagggttttaagcaagggggtaaaaagggattcattaattccttcaaacaagacactctttatttcactatgaaaatagaagcttccagaaaagactttgccctaattcctgtcaatctggctactcactatgtgcatttgtgcttgcatactcgccttccagactgtaactttataaacatctgtgtgttttccactctggaaactctccatgtgtgcactggatacagtcctctccttctcactctctgtcctgcttgtcattttctcctgctctagaaaaccagtcttaacagcaaacatatgccttaattcctcccatattgagtgtctaatatatatggcaaacttaaaatgtctaataccaaattcatgctcttcccctcaaaatctgctcaatcagcagttttctgcttctcagttgttggcaagtccatccttccagttatccaggtgcagactctggagccatgctgctcagcttctcacctgaaaattctgtcagggccaccttgagaaaatttcagactatgaaaagtttgtcacaacttacgcttcagctacctggtccgaaatatcatcatctggcactgagctaatctcagtgtttccacccttgcccacccccactgccagtctgttctcaacacagcaatttgaatgattctgtgaaaatgtgtcagatcatgtcactcctctctcaagacccccagtgccacaccttcacccccaccctctgatttctctcagaacaaaacccaacgtctttcagttgtctcccaagcctcacatgatcttgccctttgtttgtgctctggccttacctcctaccactgtccctcccctttgctctccccactccagccacacgggccatgggcagtttcctgaatcccagacaaaccccctcttgagacctttgcactggctgctgtgtctggatggaaggctttcactccagatatacatgtttccctccttcccattgattccagtgtttactcaaatgtcaccctctcatagctctctctctataaaacaccaactccattgtatgttacttctatttcttaaatcttcttcttaaattagttacaagattatttgtaacttttagacataatatgtgtatgagtattaatttatgtatatatgtctcctcccactagagtgacatagtttttgtttactccttgtcccctgtgtgtacaaagatgcttggcatagagtaaacgttcaattaaaaattacttattacttaagtattactcaaatacttattggcataatttctggaaagatacacagaatacacctagctttctttggagggaaaggactgagttggaaaacagattcacctttcattttatattatttcataacaatattttaaccacatgaatattagtttctctcaagttaaagaaattagttgacataaatcagtgtgtaaaatggagtctactcattcagatttgttttggttatctagctctgagctcatagagattatcctttttcatgactaaattgtgaagaggcagggctgcttctaataagataatccagagtattgtggtgtatacatactatggaatactactcagccatgaaaaggaatgaaataatgggattcacagcaacctggatggaattggagaccattattctaagtgaagtaactcagaaatggaaaaccaaacgtcatatgttctcacttataagtgagagctaagctatgaggactcaaaggcataagaatgatacaatgaactttggggacttgggggaaagggtgggagggggtgagagatgaaagtctacacattgggtacagtgtacactgcttggttgatggctgcaccaaaatctcagaaataaccactaaagaacttattcatgaaataaataaattaaaaatcaataaataaaataaaaggataataaccaacatgcatggaactggaggccattgtcccaagtgaaatgactcagaaacaggaagtcaaaaactgcatgttgtcacttataagtgagagttaatcaatgagtacacatgaacattgtaatagtctgttctcatggtgctataaagaaatacccgagactgggtgatttatagagaggtttaattgattcacagttctgcatggctagggagccttcagaaaacacaatcatggtggaaggcgaagcagaagcaggcaccttttccacaaggaggcaggagagtgagtgggagcaggggaaatgccagacacttataaaaccatcagatctcttgagaactcactcagtaacagagaacagcatgagagaaaccatccccatgatccagtcacttcaggtccttaccatgacacatggggattatggggattaaaattcaagatgagatgtggtggggacacagccaaaccatatcagacatatagagtgaataatagacactggcaactccaaaaggtgggagagtgtgaggggactgagggatgcaatactaaccatttggtacaatgttcactatttgggttatgggaacactaaaaacccaaatttcatcactacgcaatatatccatgtaacacaactgcatgacatgcacagatgtaccccctaaatctagaaaatatttcaaaaagagaaaaaagaaataaacatgttctaataaaaaagagatggatcaagtaaatctgactaaaaaaaagttaaaaaatataaaaataaaaagaaattgagtggtaagggaaagcataaagattaaataacctatctaaagttatggaacttctggcaagagaggcttaacatttggatgcctaccatttctctgataggcaatcgaaattttttgttaatttttttttttacctgaaagattaatacctgcatatggtcaaaagattcaaatgaacagaagattcacagtgaaaaacaaatcttcctacattgactcctaaggtgtcatttcacctccccagaggcaactgtgccatttcctaaagtgttctcatcaaaataatttacagataggcacacatatacatctttttctatattgcatatcttttacacaaaaaggtacctgtcatacatgctgtagtgaactgtgcttaaatatgatctttatgtaagtgttttcattcagtttaggaagaaaagtgaatttctgaggcatattaattgcacacacttttatgttgatgtttcaattactgtttttttccccaactgtgttatttatgctgaagctgcagagggcactgtaatctttcccaaaacatggcatagccttgaatggtattttgaagagtgtgaatatggtgcaaactgtaggattcggagaagctactgatattaaaaatatacatcaattcaaattactcacctgttctctctcattttaatgcatttcatagaaaattaatagtaatatacttattacatataatcaccttcaatggggtaatttttatttcaaattttattttaggtacaggaagtacatgtgcagatttgtcacatgggaatattgtgtgatgctgaagtttggggtatggatatcatccatagtgagcatagtgcctgataggtagtttttcaactccctcctccctccctctctctcccttctagtagaccacagtgtctattgttcccatatttatgtccatgtgtggtaaatgtttagctctgcttataagtaagaacatgcagtattttattttctgttcctgcattaagttgcttaggattatggcctaaataggagtaatttttgtttaacagagagaatgcctaattttcaaagcatctatttgaaagacatctatttggagacatctatttgtaatgatcacagacatagtatttctcaccttttaatcacagtaacaggggatttgtatggcatcatgggaactgctctggcctgggtcagtccaaagactatttctaagctatgctgcattggaaaatcatttatctctgtgtgtcaccattttctcatccatacaatgagataattggatgagaaaatttctaagggtttttttcagcttcaataattctataatgtcttcattaaggaaagaaaattgaatcgctaagagaatagattttaagttactcacacaaaaatatgtgaggtaatgcatatattaattagcttgatttagccattccacaatatatacatactattaaactcatattgtaccccataaatataagtactttttgtcagttaaaaaaaataaaaaaatttttaaaggaaacttgttcaaattgagtatggatgagtgtaaaattgaatacagatttgtgagggagtaggaaaagtgatctgtgttaccaagaaaatctaagatagtcacaatgtggcagaggatgatggcagcccaccaaaatctattctcttctttctggccagaaagcaagattacattcccagcctgccttgcagttaagggccacttctaggcctatatagaattccaggggtgcacttttcctgcctcatccttggtgagcatcctttctccttttcttcattgattcttccaaatcctgaccactttcttcaagcccaggtttcatcttcatctttattgagaaatcaggaccatcaggcaagatgtctcaacttccaggtttcccaccctacctcctgcacttctactgatttatatcctcaccaactcttccctcttttcatgcacgtccagagtgaagtgtctgtggtgtctgagatgagcccttccatttatgtccttggctcctttctctccagtgtcctctacatccttgctcaggcagttattttctctcttatttcagaaaaatgctagaaaataacaaaaagaatcatctgtaatttcaccttaaaaattatctaaattgcctagtgaatgttccttctattacccagtcatcaaatttcatcttccctaaggtaatctatgttaattaaatttatatttcttgaatatatgcaataaatctatgtggataaccagatgttttcatattttcaagaataagattattctgtaattgatctaaaatttgctttttacactaacaaatcaatatatagatctgccttttatattggctgcataatattcaattatatggcagcattatagtttattcaaccatttctttcttttcttttctgttttttgttttgttttgtttttttttggagatggagccttcctctgtcacccaggctggagtgcagtggtgcgatatcggctcactgcaacctctgcctcccgggttcaagtgattctcctgcctcagcctccccagtagtggggattacaggcacccgccaccatgcccagctaatttttgtatttttaatagaaacaggatttcgccatgttggccaggctggtcttgaacccttgacctcaggcaatccacctgcctcggcctcccaaagtgctgggattacatgtgtaggctaccgcacccggcctcaatcatttctttatgtatatttagattgtttctaattttcaatattgcttataatacaaaaatccatctgcatatgtctttccatacttacgcttttattttcataaactagattgctagaagctaaaatgccgactcaaatgatgtgcttgttttgaattataacaagtactaccaaattacttctcaaataatttgtaccaattatattacaaccaagagtctgtgagtgtccacttccccatttcttcatcatcactgggtacaaatcaatatttctaatttttgtcaattttataggaaaaagatattttattttcatgtgcaattccctgattactagtaggattgagcatctcatcactgtttattggtaatatttatatcttattttttgcattgtacatttgtactgtgtagtcctttgctcctttgcccagttttttttcatatggattgtccttctaattgacgtgttataagtctttaagtattacagattacctatctagcaaatatttccatttggtcagtcatcatcttctaaattgtctttgtgtaaggtttctttatagcgtccttgtttttgtccatttgggaaattcttccctactttgaggttataaacatgttttattactttttcttttaacttttgttattttatttctttcatttacaaatttaattctttcttgtggcttttgtttttaactctcttgatgggtctgtccactcagtgtataaatattttaggtcttttttttaatatatataatttgaaagcttttctttgtgttaccctgcatgtatctgaaagcctttctcatttctttcttttagtctatgaagtaattatatttactgtctcacttctttgttttccatttaatcttcatatacttataatttggcttacaatcctactgtcatgttaatacaattaatctatgtgcaccacagtaagtaaatttctgaaccaaatggacatttttcagtgctttggggcatttttagtgcctttgggcattaggtagtctccaaagatggctgctttgattttctcccctcgctgttgtgcattcaccactctaaccatcaaaagatggattcgatttaccctcgtctttaatctggtcctctttcttcctagcacagtagtctcaggatagctaaatttcttacatgatggctggctttgcagaataagatggaagctgctaggcctctgaaagtttaggcccagagctggcagagtcattcccaccgtaatctcttgggctaacttcacaagcccaagctagccacgtgacgaggccacatggaggagctctaacatgccagacacgagtgaagcctctttgaccttccaggttagaccagtttctgatcaatgctgctttgtaaatttccctggctaatgctgcatagagccaaagaagcatccaactaactccagttgatcccctaaattgtgagaaataataaaattcagtctctttggtgaatagttctaatgaagtttgacaaatacacggaattgtgtgatactcaccagaacagttccatcatcctccaaaattcttttgtgctgcttgtttgtagtcaaccctcccttacatccaagatttggaaaccactgatctgttttgtgtgctacttttgccttctccagaatgacataaatggaattttacagtttatagctttttgagcctgatttctttcacttacgttaatggatttcagattcattgtgttattgtatcagtactttgttccttttaattggtgagtaggattctgttttttggatttatcacagtttgttttattcaatcaccagctgaaggaca

SEQ ID NO: 271 - DNA, 51430 bp, Homo sapiens
acaaaccaaagaaatgacaatgtggcaaacccagtcaacgtggtccctgcagcccagctgctgggtcttagccatagtgcagcagccgagctggctgcttaactcaaatactctgagcactttggccaagacattggccaagctagttaggctgcttatacgtgtatggttttacatagcctaaaagagactgtaaaacctccctgctgaattttggttccccacttatgacttaggctctttaattatattttgtactagataatgttacttttctacatataatctttccttatattaagggtacacatacactgcaaagttctaataaggaagaaaaagtctattgtgaaactgcaaagagcaaaaaatatcagaagctatcattactattggtttttctataattttgtttaaatttcactctattaaaaaattacgtatcacaggaatttaccaaaaattcttttggggaactaaacattcattaaaaattttaggctgggcacggtggctcatgcctgtaatcccagcacttttagaggccgaggcgggcagatcacttgaggccgggagttcgagagcagctatgcagcatggtgaagccttgtctctactaaaaatataaaaattagttgggcgtggtggcacacaactgtagtctcagctacttgggaagctgaggcacaagaatagcttgaacccgggaggtggaggttgcagtgagcaaagattgcaccactgtactccagcctgggcaacaaagtgagaccctgtctcaaaaaaaaattttttttaaggttcacgtttctttatttaccttaaaagaaggcttaatgaatgttctcatctaaattaatatcaaagtagaaaaaaattaattctaagagacattggaacaaggtaatatgcccttaaccattcatttttagaataattctgaagcactattcagctcaacaaatgagttattgaatgtctgatatctgcatggcactgtaatggatttagcttgcaacttgataaataaaggtacttgaggctgggtgtggtggctgacgtctgtaatcccggcactttgggagaccaaggcaggcagatcacttgagtgcaggagttcaaggctagcctgggcaagataacaaaaccccatctctacaaaaaattatccaggtgtggtagcacgcacctgtagtcccagctactcagaaggctgatatatgagaatagcttaaacccaggaggtggagattgcaatgagctgagatcgcaccactgcactcccagcctggacaacagagccagaccgtatctcaaaaaaaaaaaaaaagaaaaagaaaaaaaaagaggtacttcgtgccttcaagtaatttataatgtataagactagtatacagagggaacatataaacaaggcaggatgcaggtataagagagcactataacaatgcagaagctggatagtgtggtttatgtattcgttattgtcaatgtgtgtatcatgctaggatggagaacaggacttaccatattacttcacttttctaaatcagattaaatgtaactctgagctctccactagctagggagattgagaaattctctgttctgtttggggattcagattccagagtcaacaggaatctttcttggtgcccagaaaatggagagaaggaaaggcctctggtcttcaatctacactggtgactgcagagatgcctgtcattgtattacactttataaaaaagtcacccatagaacaagcaaaagcagttcttttagtttaatggtcaaacccagtatggttcactcaaggacaggtgactctgaaacatccctgacaagcgtggacctggggtctttcagtcttcaaggctgtaacttgactgttatattagggttcttcagaggaacagcgagtaggagaggaagcaaagaagagagacggaaggaaggaaaggggagggaatggaaagggaaaagaggaaagaaaaagaacaaaaaatctagaaagagattaattataaggtattcatcatggaattatggaagctgagacatcccatgatttgctgcccacaaaacctaggaaggctggaggtgtagttgaaggcctgagagccagagagctcagagtggttcctccacccaagcctcctaagactgtgtgcaagtccctccttactcagctgaccacctgggactcagcttactcagctgaccacctgggagcttctgagaaatgaaaactctctgccgggcgcggtggctcacgcctgtaatcccagcactttgggaggccgaggcaggtggatcacctgaggtcagaagttggagaccagcctggccaacatggcgaaaacccgtctctactaaaattacaaaaattagccaggcgtggtggcgcgtgcctgtaatcccagctactcgggaggctgaggcagaagaatcacttgaacccgggaggcggagtttgcagtgagccaagatcgtgccattgcactccagcttgagcagcaagagtgagactccatctaaaaaaaaaaagaaatgaaaactttctagccctgccccagatccttaagttcggaatctgcattttaacaggatccccagtgatttgtgtgctcattcatgttggagaggccatgctccagactctctctgtcttgttccttgcttagctattatttggaggcattctctcttagctgtcccagaggaaaaacatcctgataaatgtatcccctcccagatattgctgataatgacctagcctaatgtctaaatataacttaacctgttactcctaaaagccctaactcaaagactaactcaatgtgggatgtctgggttcctgaaaaaggaatttttgagaaaggatgttccctctaatgcttctcaaacaataccatagaaagcattttagagcagtagaagataaactcagaaaaagattataaataaaaaatgattaaagggtataaacaagacccaatgctaagaaccgtgtctctgaaggaaatcagttctcttaaccctaaattgcttttgcaatttcagataaagggcacaattataacatcttagggactgtattgcgaaattttgttttctgatcttgtccaggaaattaagcatttttagagaggagagcaaaggttttagtcaatctattactgaacactgactacctacccatgtattttgtaaagtaccatagttccataaaatttagactttagagtctcaaagtacgaaactataaaagtataaaacccaagcaagtaaagcaagtattataccataaaactatgcttatcacaaataccccagcctgtgtagctaaagctcagaattctcacacagatagcttgacaccctgatgataaaactctactgcaatgcaagcctagccaggtgatttatttacttatttatttatttattttagacagggtctcactctgttgcccatgctggagtgcagtggcatgatctgggctcactgtatcttccgcctcctgggttcaagcaattctcctgcctcagcctcctgagtagctgggattgcaggtgcatgccaccatgcatggctaatttttgtatttttagtagcgactgggcttcaccgttttggccaggctagtctcaaactcctggcctcaagtgatctgcctgcctcagcctccgaaagtgctgggattacaggtgtgagccactgcacccggcctctagccaggtgatttcttattgcaacccactctttcttccaaaccaatgaaagtccatgggcttccaactggttatttcacacacaacagtgcctaatctgcctatatgacatgatttaatattttgtggaaggttggcctagagattgaggatgttaaggaagatttgaaatatgagtgaaagttacacaaaagaactagtagtaaaactgagagcctaaatcaagatgttctttctcctttgggaaaggaatacaatttagttaaaccatcagataaacatttatgcatccctattgtgctatggaaatgtaagatgttaccataggaggaggctgtgtgaagggcatacaagggattctttgtactatttttgcaacttcctgtgtgtctgtaatcattttaaaatacatattttttaaatgatggatgtctactggatgccaggcattgaggagcacactcagtgcaggcttggtctgacactctatgacctgggcaaggaggctgatcaatacacaaataactgaacaaagatagtctgcattacaaggtacaaagtgctctggttgtgtgggagtaagagggatcaaactggaagaatctgagaggtcattttagagaaggcagaatttaagtgtggaatctgagtgatgggcagtgtgctaggaataataagggatcgagggtactccccaacagggaacaaatgagagtgggtttggggacagccaatgggcccacacagctggagcatgagacttagggaggagaattggggaagagatattagggaggtaagactaggaaggtagaccgggccctcaaatgccaagtgagggaagttggactttatcaaaggcttctgaacaagggaatattttattagttttagtaaatttagtacaataatttttttcataatatttagaatggactggaatggcacaaaaccaacatgatatatagaaactggactgttccatattgacaaaagtacccactaaagtcctatatttaatacatgtaagttattaggtggcattttgcagtcgttgggaacataagctctgaaatcagactacacgggcttgaatcctggctttaccactatactagctgtgcagccatgggtaagtttttgaacctcactgtgcttcaatttccttatccataaaatggggataacaatggtctacttcatagagtgtttgtgaggagtaagtgaaataactcctgatgtttagaacagtgcttggcataggatagaaactcataaatgtgagctactatgttaagataagggggaaacattgtatatatcaatcactatgtaacaaaccatgaaaatggaggggagccatgattcaagaaataaaataataggaaatctctaatatacttttttgacattagagtatgttagagtggggtaaggtagaagaaataaacatggctttagtatgtcttgaattaatttgaaatttccaaaaattcagcaaagaagcacatgggaaaatcaatttagagcatgatgagtagtttaaaaatggtttctatatttattaccttcactttttttttttttttttgagacggagtcttgctctgtcgcccaggctagagtgcagtggcgcgatctcagctcactgccacctccgcctcccaggttcactccattctcctgcctcagcctcccgagtagctgggactacaggtgcccaccaccacgcgcggctaattttttgtatttttagtagagacagggcttcaccgtgttagccaggatggtctcgatctcctgacctcgtgatccacccgccttggcctcccaaggtgctgggattacaggcgtgagccaccgcgcccagcctactttcactatttttaaattatgacatttcatatttgcaaaatatacaaatatgccatctatatctatgtagatatatagttacatagattgcataaataatagtaaaatgaacatgttactactactcagttaaaaaactgtgattgagacagcttgatggccccccacaatacccactctctcacttttcaataataatagaaatgttttggccgattgtggtggctcacacctgtagtcccagcattttaggaggtcaaagcgggaggatcatttggggtcaggcatttgagaccagcctggccaacatggcgaaaccccatctctactaaaaatacaaaaattagctgggtgtggtggcacatgcctatagtctcagctactcaggatgctgaggcaggtgaatcacttgaacctgggaagaggttgcagtgagttcagattgcgccactgcactccagcctgggtgacagagcaagaatctgtctctaaataaataaataaataaataaacaagtaaaagaaattttagctgggcaggtggctgtctggctaaagattgcatttgcaggctcttttacagttaggcatagcagccatgtggccaggctctggccaatgggatgagagcagaagtgatgtgtgcaacctttgatcatggccttcagaagaaaggagcatagcagccccttctctttttccccttcctattggttgggagtcatggccagccatttttgatcacaaggacaagggcaacatctgaaaggcggcagactaataaaatggaagaagtctgtgtctctgacaccatcgagctgccatgtagccctaccatgcctacccagacatcaatgtgggaaaaataaacctctattccatttaggttgctgtagtttgcccagctgtagtctaaaaaattaccaatacctttgaaacttgccatgtgcccctctataattgcatttaccttcctttctatcaggagtaaccactatcaggattgtacttataattcttttccttttcttcatagctttgccacatgggagctgcaaagtgcagtcacatgtttttgaagtttatataagtaaaataatactgtgtgtattttgcctatggcctgctgttatggacagaatggtatcctgcccctgctccacccccaattcatatgttgaagccgtaatcctccacaatgtgatggtatttggagatggagcctttaggatattggatatcatgagggtggggccttcatgatgggattagtgcctttataaggactttataaggagacaccagagagcttcctctctttctctctctgtctgtcatgtgaagacatagaaggtggccatctgcaagccaggaagagagttctcactaagaaacacactttgactttggacttcccagcctccagaactgtgagaaataaattcctgttgtttaaactattcagtctacggtattttattatgacaatccaagctgactaatacatctgcttttttttttcactcaacatatgcttgtgcaattcattcatgttcataagtgtacctatagttcattaattttttactgccatattaaacttgctatataatattaaattacttgaaaataccagtttatttacccattcaatattagtggacatataagttatttacagcttttagttattgtacagacaaaggtgtcatgagtattcttatacttatctcctaggatacatgtgcaagaatttctttaggatctgtttctggatcagaattgtggtgtcagagtacacacatcttcaacttcaccagatcatgccaggttgtttttcaagtggttgtaaccatctactcttcctagcaaacacttccacttgggtacgccacataattaagttctggccaatgagatacataatacaacagtccccttatctccagagacatattccaagacccacaactgttgcctgaaactatggataatgccgaaccctatatgtactatgttgtttctaataaccaagatggctaataaatgaataaaggacaggtggcttatatagcagggatacactggacaaagagatgatgtaagtcctgagtggagaagagtgggactgggtgagatttcatcacgctactcagaatggcatgcaatttaaaactcacactttatttctggaattttctatttaatatttttggactgtggttgactgtgggtatctaaaactgcagaaaagtaaaaccagggacaaagggagactactgtatggagaagtgttgtttgggagttttggagaggcaccccagtttgctcaccagccagtgatatctactttttgtttttcctgtcctcttactccttcctgctgcttgaaacacaaataagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaatacacctgcttctttttttttttcagtcaacatatgcttgtgcaattcactcatgttcataagtgcaccctggaacattaccatgttccagggcttctcctatagaaacagaacatagcccagttgattattttttattctgattgatttttaggagttctttacataatctgggttctactcattgtgggttttgagggaaataccttttcccagtttatggcttgtcttttcattctcttgatgacgtcttttgatgtacattaaaaattatctttaatacagtgaaatcggctaatctagaaaaggattttttccttggactgttcatggcatcggtaaattaaaaagtagttactgtcaagttcactgcacataaaccagcattgttaaaagtggatctccatcattccatttcctttcctgcatttgtcagcatcgtttttcacactaaagatgaggagatccatattcctaagacatatacgcttggtctgtagagaccctcattgctctaaggcagtggttgccagttttttccttaaagggcctagtaggacatagtccaggctttgccagccatacggtctgtcacaactgaattctgctgcccttgtagcatgaaggcagccaaacaataggtaaggaataaacatggctttattcgtggcactgaactttgaatttcatataatttcacaacacaaaattgtattcttttgattttttccaatcatttaaaaatgtcaaaaccatacttagctggagggctgtaggaaaacaggtggtgggctgggtctggcacacaggcagcagttcgtggacccctgtgccaagtgtttgacgaagcccgtgaggcaaactgcacttgccgatagaggttgcgccacacaagtgtcttggaagcaatttctggcttgtcctaggccttagaaagtgcgtgcagatcagagccatgaagtgaagagcaaagcaagtgacaggcctgtctcaggttgtgcaacagaacgtgtttatgacagatgtcccctgtccaagtgagtgcactgtgagataaggggccggtgacctaccaatgcgtgtggcaagccagcctgttcccccttgcagggggaggacactcctgccctttattccagggaagagtatgtgtaaaaatattcacccttgttggtatcaaatgcgctgaagaaaataggtatcggggtttcagccattcggtctccttgttagtgtttctaagccctgattttcagtttcaaaaccttggtctctgaatccgcagtgatgggtctctagagcgaatacatggcagggccgccttcctccgtacagaaagggagaattgtgcttgtgtgttttaccaagcaggacagatggggccgtcacccccgtgacccgagccctgcaaaactgtgttctcacacgaaaacccccaggctctgcgggcagcgtggtcctgcagtggctaacactgggcgaccggagtcgtgttccgacccctaggagaggaaccggctcggtcgtggtgcagcccgcgaggagacgacctcagggcgtaatccgacgccgtgggttaagacatcagacctcaggcgcagtgcagccggcccctggggagtcaaggaccttgatcgccgataacaagttgccgttggcgggcgccgagggtgacccgcgagcgcggcacccgcctccccgcccctagcaggaccccctccgccccgcccccagccggacccctccccgaggccccgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggtagggctggccgatcgcccgagccgggccccagatgcgctgcgggcgggtcgctggaggcgccgggggaagggcggacccacgcgcggctgagcctctcccgggccccggaggggcggactggccactgccccgggcggtgtccgccctgggccgcctggagactgtcacgccactatcccaatcccgtgaccatcccaagcctcccctgggcagcggaggggctgttaaggtcactgccccaggtcctatgtccgcgcagatcctccccacggccgcggacgggccggagggcgcctgcccagccgctatcccatgcggcgccaacctgtgagacggacccgcggtcgggtgctttgcacactggggactgaacacccccatctccgtcctgcctggcacagggacttgtgccaagcccgagacgccctttgaatactttcgtaaccgttcgtttctggaaggttgagctagtgatcttgaaatgaccggtagcactgatcaaagatgagttaagaggtaacttcctctttgcttcatcgactttttcaagaaaaacaaactggaatgttatcaaggcaataatttttttgtcatcacaacctagggattaaaaaaaccccaacattttattagcaataattacatttgacctttgtacaaaataaggagtaaatataggctttggatagctgttcatcagaagcaccctttgggctgagtgtggagggatagggggcagagtggagttcactcccatctatagtttatactacgtgggataaatattacattgcacattctgtgacattactttctattctctgctccaaatagtgaagtccctttataatcatttgagtgtaggccttgtggaggactcatggaggttgaggttggattaacagaaatacagtggaaatatttcatgccctccatgcatgcatccattttgttgttgtttttgagacaggggtttactctgtcacccaggctggagtgccgtgccgtggctcgatctcggctcactgcaacctccgccttcagggttcaagcgattcttctgcctcagccttccaagtagctgggattacaggcgcgtgccaccacggccgactcacttttgtgtttttagtagatacaaggtttcaccatgttggccaggctcatgcatcctttaaaaacaaaaatttgatcgagcctacattttaaaatatcttgtcaatggattggtatgcttattatgtatttcttttcttttttttttttttgagacagagtctcgctctgtcacccaggctggagggcaatgtggtgatctcggctcactgcaacctctgcctcctgggttcaagcgattcccttgcctcagcctcctgaatagctgggactacacgtgcctgccaccacgcccggctaatttttgtatttttagtagagacggggtttcaccatattggccaggctggtctcgaactcctgacctcaagtgatccgcctgcctcggcctcccaaagtgctggtatttacaggagtgagccactgcgccaggcttattatatatttcttaatagacattcccattgtcatttgccattgctattcatttacatattacatatgaaaaagtaagctgctttagtttttggctgttttgctgcctgtttctagaatttaccagagggagtgtgttagaatgaaaggatagctgggttggaagtggaggtcttggtttctaactggctcttccaccacagacctgctgggtctgtgttcccacagatacaatagaaaataatgcctgccaaaacaacttgacaaggatgcagtgaggaccaaatgatatatatgcagataaatgtaaaagattgcgatgtgcctaacaaattaaaaatatcactcaacacattaaaaatattactgttatcagacaacatcctgaaaacacataataaaatttagttttgattgggtccagatttagctaacagcatttgaatgtttctgatattggccagttaagttgtggactcttcaatgttattattaatttaagaagcatttgttgaacacttagaaagagcagggcttaccaaaaaagtcaagagcttctgcctagggaagtaaagggaggcctgatggaagaggtacgtttatgattaattagtttttaggatcagcctcatgtgaaaaaaaaaaaaaaaagggtggagggtggggattggaggcatttaaaaataaagtgcaaaatcaaatggcccaagaagggtaaatgagagttaaaaacaagagtttctgaaatgtatgtcactagaaccttcatatgcttctgagtgactgatgcagggaggggaaacgccattacaggatccacattgcttgtttggtgaaagcccagcaacagtgtgaagagtgtagcagtttctggctattttctcttaagttcatagaactagcaaatgactggatcaggtaggattcagatctaagttggtatgacttcaaaaataaaaagatcctatgttttacataatacaaatatgtaaagtgctttcacatccatggttgcatttgtgtcttgttatcagccaaagaggttagcaagttttccgcttcctacaatggccctcctaccacctcagtatttcttctatccatctatcctgaagtaacagtagtatatgttttcataagaggaaattgaagcccagagatgtcaagtgactttcaactggcttgggacttgttttctgattctcagacttaagaattcttagtgtttttttcagacttgacagattgcttccagaaagagtcagcaaaaacacataaggtttttcgatttagatgcttgggcttatctactcatataggctttaatactgagtgcatgaataataacatttgatacgtttttaagcatgatgctaatttctagaacatgactggggataaagggaaactaatagaaaaaagttgtgatttatatttagcttctgcaaactgcttttcaagccatcatttccaataaggaactttgtactccagccaaattgaacttcttactataacaaggatttctctccttcttatccctctcttttccccttcctcttcctttcttctgtaccagttatccaactatgtacccatctttcaatacccaattctaacactatatccttatgaaagttatcttccttttcctaagtcaaatcaaccactctgaattcccatgataatgacaataactaacttttactggatttttactgtgtatcagggatgattttaagtcacttttattctttcattgactcctctcaacaaccttatgaataaggtactattagtatcatcattttatagatgaggaaactgaaggaaaattaacctcttctagagtgacatacctttaagtgggggccaggattccaagccagaagctatgcttcctttgtagggctttgtagctctcctgtggatctttaccgttttattttggttgtctgtgtccttattgagcaggacaacttaccagattttaagttcagacagcaattgctcgttcatttgtataatctctatagcacagtgctttacatcaaacagatgcttataattttgcatcaaacagatgcaattatttagaaaacaaacatttgtttgttttctaaattattggctgcaggaatgaaataacacaatgtgatgtcaagagatgatgtttttcaacccttattcagttttagctgttcttgggttaaatacctagcaattgtttggccttggtagttttaagtagagtaagcaagtgttagggcaaatggagaaaacaagaactttgtctcctcactttgatgaagcagttctatctgaacatcaccctaagtaggtagtccctggcccccattccttggctacctaatcttaaaatagaatcacagattcttagagtttggaaggaccttagagattatttaatgtaactcctacatttatatatgtgataacccagtgatttgaatctagttcttctaactccagcctagtagcagtctctcctactaactccatgcacttgtgtttgactggtataaactgttactccattctctattacatatctgattaaatgtttctgccctgtcttcgtgatctgtgcatataaatccatgtcagtgtctttattaagaatatgtttatggcagggacaagtgcctagcttaaggtcaggtcaaagggcattaattaatgcatttcttgtgtttatgatgataaagagttgaactgaaaagtaagtatacctgagcatgccagaaacaccttaagaaatggtttattctctgtttaaataacttatttaaataactcatattttaaacacagaataaaccatttcttaaggttatctttgtactacatattgcctttgtattacatattatagagttattttggggggaataatagaaagaaaaggaaataacctttagattcctactcagacttttttttataggtttgatttctttgagatctagtatatttcctttttaagcactcttttactcccactttttttaaaccagctcagtaacttttcaagcatcatttattaaggcaggactcttgtaagggcgtgacctctctcattaaaacaaaatgtgaactccagatttccaggagatagaagcagggagggacttagggtgaggcaagccaggactcaaaatttaaggaggcctttgcaggactgtgagaatgaatgtctccttaacttctgcagccatggtgcctccctgcctcacccttagtccccggccatctagaaggagactcttcagataatgtggaggtagcttcccttgattcctatggcttcactatacttaattcctaacgaataaaactgtttctcctttcaaattctggttcaagtgtggataaaacgtggcatcgtggtatttagaagaagctttgaattttcctcctggtgcatttgattggggtagaaggctacaaccagaccacttgggttttgcgaagttgaagaacagaacagaagcaacccagtacagttgatgtggatgatagatttggcctcaggggaattctcttcacacccctctctctttttgttccccttagcacagtgacaggctggcattttcaacaagaaccctaataagtattaaagaagaaagaaaaccaaaatgattcacactgaatataaaaataaaggccagctttcaaagtacagatttatcaggtcatgagaaaaccccattggccctgaagtgctggtttaactgcatttatgtgcgatgtctgtctggtttcctttgccgcagcttataacctgcctaatttcctaaaaatggatgtgctcttctcaaatgctggttcctaaactgagccaagaccaaaggtctgggtcgaaagcagtgagcccctagggccttcctcattggcttggcagagagtggttttaccttttctgaccaccaaggctcctctggagcctccccaggcctcaggtgggaaccctccctccgtaaacaaagaagcaccctccccatcacaggctcccagtaaacaatgtcataagcacatcttaggcacttattgggttagagcagttgcaggaatggagcaatcagtcatttctacttcttatgtcttccagagtcaggttagcagtctattagaaactccataaattctcttttaaaaatcgtagaatctcttgtgatccctggaataatgaaatgaaaaaaaaaatcttaagagtcacctgtctgggtagaaagtctacctttaacagcatactcgcattacatgtttttcacatatgcacaatatgtcttctaatgtcctttcttcctatgtcttagaaatgcagtttctatttttatgaagaaagaagtcaatgtttggataattgaaatcttcttgttaccagctgacctaatggttattggttatctaattcccttctgcatagatgtcaattcatccaaggccatttcaagcaaagaggtttttttgttttgtttttgttttttttcagtataaaaatttacgtaatgaacattgtatagttctagtatttcctagtttgggaagattttttcttttatatattatctatacttgcttttatttactatttttctttatgtcaactttaaatcaactcttttaaaaacttagactcttactctgacttaatatttataaaatcatagatatgatatgctatttttcttttttttttttttgagatggagtttcgctcttgttgcccaggctggagtgcagtggtgcaaccttggctcactgctacctccgcctcctgggttcaagtgattctcctgcctcagcctcccaagcagctgggattacaggtgtgcaccaccatgcctggctaattttgtgtttttagtagagatggggtttcactatgttggtcaggctgggctcgaactcctgacctcgggtgatccacccacctcagcctcccaaagtgctgggattacaggcatgagccaccgcacctggccctgtttttcaaaatacattaaattttttcaaaatatattaaaataaacataaacattcaattgaaaagtttacctacagatcacctaaaattatctgatggagtatcagtaataacagtaacagtaacaaatactgagctccttccatatgcccagcacttttataaacattttacatgtgataagtcatttaattttcacaatgagagaggagcaatgattattaccattttcaaatggagagactaaggcactgtaaagtgattcatccaactcatttagccagtaagtagcagagcaaatgtgggtgcaagtagagtctagagtctatgcccctaaccactctgcaagaaaaacctggggcatgtattcttcccattgcttttttgttttgtttgtttgtttgtttgtttttgagatagggtctcacttggctcactgcaaccttggcctactgtcctcaagtgatcctcccccctcagcctcccaagcagctgggattacaggtgtgcaccaccatgcctggctaattttgtgtttttagtagagatggggtttcactatgttggtcaggctgggctcgaactcctgacctcgggtgatccacccacctcagcctcccaaagtgctgggattacaggcatgagccaccgcacctggccctgtttttcaaaatacattaaattttttcaaaatatattaaaataaacataaacattcaattgaaaagtttacctacagatcacctaaaattatctgatggagtatcagtaataacagtaacagtaacaaatactgagctccttccatatgcccagcacttttataaacattttacatgtgataagtcatttaattttcacaatgagagaggagcaatgattattaccattttcaaatggagagactaaggcactgtaaagtgattcatccaactcatttagccagtaagtagcagagcaaatgtgggtgcaagtagagtctagagtctatgcccctaaccactctgcaagaaaaacctggggcatgtattcttcccattgcttttttgttttgtttgtttgtttgtttgtttttgagatagggtctcacttggctcactgcaaccttggcctactgtcctcaagtgatcctcccccctcagcctcccaagtagctgggattacaggcatgcacccccacgcccggctaatttttgtatttttagtagagacggggtttcactatgttggccaggctggtcttgaactcctggcctcaagtgatctgcccgcctcagccttccaaagtggtgagctaccacacccagcctgattttcatcatctacgtatttagctcctacagaagatttttaaaaatagaatacgtggctgggtgcggtgactcatgcctgtaatcccaggactttgggaggcctaggtgggtggatctcaaggtcaggagtttgagaccagcctgaccaacatggtgaaaccccatctctactaaaaatacaaaaactagccaggtgtggtggtgcacatctgtaatcccagctactcaggaggctgaggcaggagaatcacttgaacctgggaggcggaggttgcagtgagcgaagattacaccactgcactccagcctgggcgacagagtgagactctgtctcaagaaaaaaaaaaaagaaagaaaaatagaatacgtgtctcatgcccatgagaggatcacattctaatatgaaagatagggccacatacaaatgacatcacatcgatctagagctgaaacatacctcagaaactatctagtctaccattttcatttagagaagacctaagaacatgttccagaaaaatcagtattttgaggctgtaagtgaaatttgtccagtgagttcagtggatctcagcatgcagctttcacctgatgccagtgccatgctcttgggcttcccaggctccagaaccatgagccaaataagtcttttctttataaattacccagtgtctagtattctgttatagcaacagaaaatggaattacacaactcttatttgaaaaaatgggaggctataattatgaaacaattaatgacttatgtggaattacttcccttggttaaattagatctttactttcattaactaaagatgataatttcaaagctttgctttttaaatttgttctgctacctgtgaaatcatttaaaatcaaggaaactagacaacagaaacagtgcattgttataaagtcatgaacatcattgtcatgtagttccttatatttgtatacctgaggtactaaccatctaatgagcatattttgtacaacagaaggcctatatatttgcaaagactgctttaaccctgaaaaatatttgtagaaggtgtatttttaagggagtaggtaggaatggaatgactggagataggtaggtttgtgtcctttgatttctccctagatgaagttgtaggtggagtaagaggtgtatcaggcagtccttgaaggagggggcatatgagtgctttgctgaattgggtgagaagagtgtttagaaaggaaaaagccatgagacagtattaagtcataaataaacaagaggactttgtgggtggaatggagctggagtatgaaggtgggtgattgagagttatgctgcaaagagactcttatcagtgagtaaagagcttgtggtaagattagtttaggagtggccagaagagctgttcctaaactcatgtgctccttggtgtgctcctaaactaagcccatgaaggctctcccctaaatctcctgtaatacaaatagaaaattatttttgcacaaacacctttattgtcacacttggtccattaattgagggatattggttaaacatatactgtgtgccagagtaatgttctagagtactgggaatgtaggggtgagtgagaaagacacaatccttgccctctctgtgctttaatcagttcagccttagaaaatgaaatatttaaggtgagaaggcaaggaaaagggaagacttaattttggagttttggattgggtatgtggggggcaggtggctttgattagggagaccaagatgaaggtactagtgctgtttctcagtgagttacagggttgtgggcaaggaagaagagaagtagatgcctcctctctcacctcaatctttctccttcagtcactgcgtagttccgtctcttaatatggaaacgttaagattcttatacttatgggcctttttccagagaatgcagagagcatacaggattttgtcagaggtgcagttcacctctggatgttttctggaagagtaaatcatgtgtgaaaattgaataaattaatggactatcagacttgctgtttgcttttttccagtataagctttgtgtctttgagactatggtaggagtgtatgacttcctggctaggatgtcagtttaatttgtttgtgcttctatacgatagttacagtgttgtcagaaagcattgaggaagttttaaaatcataatttagttttatctaatcctgtaatgaatagaatcctatgaataattcaaataactagaaaagctaaaatttcccaaatatgtattttatacagctctttttcagtgtataattgaaaaacaatttaaattttaatcagtgggtttttttttaatgacaaggggttatgattgatttttagtagttattttgttttctagaataaatttatatgaaatttaatatatcaagtaaaattcattgttagggaagctattacttaaattatgatatagccacataattgaataccatgcagtcattaaaaagaatgatgtggatctctgtgtttgacctggaaagagttctgtaacattgttaaatttggatacagtagatattatgaaaactatataattaaaaacgtatttattcatttatttaattatttagagacagggtctcactctgttgccccagctggagtgcagtggctcacttcaacctctgcctcctgggttcaagcaattctcgtgcctcagcctcctgagtagctgggattacaggagtatgccaccacagctggctaatttttggatttttaatagagacagatttttaccatgctggccaggcttgtctcaaactactgacctcaagtgatcagcccaccttggcttcccaaagtgctgggattacaggtgtgaaccaccacatccagccataaaaactttaaatgttagaatggaatattacctagagaagttctactacttggaatagatctcttctaacaaacattgcttatggctttataattcataatccaagggtggctttttcatccttacatttaacttttttgaaaataagttaacatgaaaactagaattgagttagggaggctctgtagctcccgtttccatgaagagtctcttctggctaggcacggtggcactcgcctataatcccagcattttgggaggctgaggcagaaggatagtttgaggccaggagtttgagaccagcctgggtagcatagccagatgctgtctctacaaaaaatttaaaaaattaaccaggcatggtggtgcacacctgtagtgtcctagctactgaggaggctgaggtgggaggattgcatgaacccaggagtctgaggttacaacatgtgcctctgcactccagcctgggcaacagagtgagacctgtgtcaaaaaaaaaaaaaaaaaaaaaagtctaatctataattgtaccatttttggaaagggatacctggaaggaagttgttctgctgtgcctggccaaataaatcccagcctgtttgcagggataacaagttagaaaaaaagtgagaaaatgcaacctatttaatcgctttcacctaggaatggaggtggtgaccaaaggaaaaagagaagataggtctggctcctgaggccttgggaagactgggaaaacttggaaggatttgggaagaattggaaaaggagtgaaccaaatattggcagatcattgtgcctttctgggtttaaaggaaagactcttgtggctggcaccatttcctgtggctcactgctacttgaaagtgtattgtgtgagggggaaagtgcttatcagcaggtttgatggaatagggagtttgtgaagatttcaggtgaaaagttccattcagtctgtgtggcctgtggtaggataaatctcatcgaagggcaagtcggaagacccgatctagttcctggacccagcctaagtgcttgccttgatgtaaattatcactcctccgtatgtttcactttcatctttaataaaaagaatatgataataactgccctatctctgtggatttctgtattaattgaaataatacattagaaatgctgtttatcagctgggtgtggtggctcacgcctgtaatcccagcactttgggaggctgaggcaggtggatcatttaaggtcaggagttggagaccggcctgggcaacatggcaaaaccctgtctctaccaaaaatacaaaaatttagctgggtgtggtggcgtgcgcctgtaatctcagctactttgggaggttgagggggaggatcacttgggcctgggaggcggatgttgcagtgagccaagatcctttactgcactccagcctgggcgacagagcgagaccctgtctcaagaacaaaaaaaggaaagaaaagaagtgccctttgttgtactgttgaagatcacattacctttgcaatattatctcttgtaaattacctgttccaggaacatggatctagtcactgactccagtaaacctttcactttcagtcagaaactttggtttctgcctagacttcctctcttctctgtttacattcccagtctctccctatttaaacgcctctagtatcctaatgaagcacttttaaactggtgaacagtcttcatttcccttttctaaattaagagcgggatataatttggggtagagtcaccaccagttgtggtgtaagggttaatcaaatttatttcagtatgaatttctgttaatacctgaccatgagacctgcctgtagctagtttctcagatcagaggtcagaattaagctttcaatgttgacttttagagttctccttgagaagatccagattttcagtataaagagttacatagagaaatggaagatccctctgacattttgtcattacagaaattttaataacttcaatgtccaattttacatatgtttgacgtgtaactttgctttccttcaatcatcaaaattaaaaacaatttttcatagtagaaaaaatgggtaagaatttgctagtttgatatggtcaactaatttttgataagggccccaagaggacacaatggggaaaggatagtctcttcaataaataatgctgggaaaatgatttccataggccaaaagaatgaaattggaccttatattacactgtatacaaaaataaactcaaaatggataaaatacctaaatataagaacaaaaactgtaaaactatacccaaaggaaatgaaatcatcgccgtaaaaagatacttgcactcccatgatcattgtagcattattcacaatagccaaaatacagaaacagcctaagtgtctgttaacatatgaatggataaagaaactgtagtatgcacaatggaatattactgagccctaaagaacaaaatcttgccatttaccacaacatggatgagcctgggagacattatgctaagtgaaataagccagacacagaaagagaaatatggtatgatcttgatctcgcgtatacacagaatctgaaaaaaaaattcagagatagagaatgaaactggttatcaggagcagaggggcataaaggggaggaaatgggaagaggcaggtcaaaggatacattacagctttgcaagatgagcaggtctagagatcttatgtacaacctgaggggtataggttaaaaaaattgaactgtaaaatgaatagattttagctgctcttgccacaaaaacaaaaaaatgggtaactatgtgagatgatggatatgttaatttgcttcagtttagtaccgtttccatctatctacatatcccataacatcatgttgtatacataataaaatttatctttaaaaaagaatttactagtttgaaaagaatttactaggttaacagaattgttctctgtaagacactttgggattctttcaaaagattctgggtgggatgtgttgtttttcatttttgtactgtcgtgatgactgcttagttttgtttgccctttcttaaattgtttcacagtttccaagataaacttttaagaacgtgctcactggaactgaatatgatattttatttattttatttttcaagacagggtctcgctctgtcacccaggctggagtacagtggcactcactgctcactgcaccctcgacttccccaggcttgggtgatcctcccacctcagcctcctgagtagctgggactacaagtgtacaccgccgcaccaggctaatttttatatcttttgtagagatggggttcaccatgttgcccaggctggtcttgaacccctgggcttaagcaatctgcccaccttggcctcccaaagtgctaggattataggtgtgagccgccgaacctggactgtgattttctgcttactactagttttcattgatttaattacgatgtgccttgatgggtgtttaaaaaatatttattctgtttggggtttgttgagcttcttggacatgtaggtttatagatttcatcaactttggacatttttcatcatttatttcttcttatatttttcgtgccccatccgctcttttctctttctaagactctagttacatatgtgctagactgctttctgttgtcccaccactcgccgatgcacagttcaattatttttagtcgtttttctttcgtcattttggatagtttccattggtacatgcttattgatcttttcttctgtggtgtttaatatgctgttaatctcacccagtttattttacaattcaaatattgtaattttcatttctggagatttcacttgagtcttttcttccatttctgtttataattttcctgttttcctctactttcttgaacatgtggagcatatttataataactattttgatatcctcatctgctaattctattacttctgttcatattgattctgattgtattctgattatatggattttacttctagttgtcaattatattctcctgcttctttgcatgactggtaattttttactgaatgccaaaccttgtgaattttacctttgggatactagatttttttcccctaagatgtactttatgatggctgtagttaagttgccaggaattacttggatccttttgaggctggattttaagttttgttagggctgtccagagaagccttcagtctagggttaatttatgcctgctggtaaggcagtacacttctgagaactttacccaatgccccaagtattaatgaggctttctgctttgcctggtgggaacatgaatgtcccagccatgtatgagctttgagaattgtctgaccttcaacattgcagtgcttctctccctggcctttgttagtttcatctcattcaggcacagatgagttctcagccgaagacggaaagatacccttccgtaagacgtccacaacttatgctcctctctctgtgcagctctgtcctctcaggcactctgcctcacaaatcctaattgccttgaccttcctgaactttgtgtttctcttaaacacagcatgattgctggactctgttctggtcatgggacctgcactgtggcctggaaactgactctgggaagttagctggagcagtcgcagggctcatctcatttgtttcccttctgtgagggatcacaagcctgcactgcctgtaatgtttgaaaactgttttttgttttttgtttttttaaaaatatattttattgcctttctagttatataaggtgggagagcaaatctagtccctgatactccattgtgaatggaagcagaggttggcagttggcccctaaggtcttttttcacagcaaaaatttaactgagtaatttcaaatctgtggcataatgcatagtattatattaaaagagccatggatgtaagaatcaagatcaggatcctaatccttactcagttgtttaactttgtgtttcttacattgtggacttctgtgaccctctacctagatgacttaaagcagttaatttgatttctcaatttaattcgcatctgtagaatgagggttagaaatgttctttataacacacggggtgctacaaagtgtgaagccttaggttgagctattttcagaaagcttattatcacttaacaatctttattttatttacattttttataggcaccatactggacataccttttatgtgcactgggactttttatttaccagtcactggatgctattgatgggaaacaagccagaagaacaaactcttgttcccctttaggggagctctttgaccatggctgtgactctctttccacaggtaaattagtggagttttttatttttttatgataccttaaaaataaaatgaactgagctgtttggtcagttttttggatggatatacatttgggagcaaatgtatggagttgtttaaaaagtatgtcaagaattcattttgataagtgtactttattttaatgccatgattatttccttagagctctgtatttctaaacagcatagggcaattatttcataaattatttttaattcttaatgattcttaaactttgtttctttcagtatttatggcagtgggagcttcaattgccgctcgcttaggaacttatcctgactggttttttttctgctcttttattgggatgtttgtgttttattgcgctcattggcagacttatgtttcaggcatgttgagatttggaaagtaagtatgctttttaagttgtacattaaaaaatataattgaattcatttgcacaatctgttatgtcattcatcgataataaggagaacaaatcttcaatcagtaacttaaattaattcgtcggagtactcataaatgctacaccttaagtcttttaggtactctgcatgttataaatagttacattatttgataataattttatttttcttctcctcttctccaacttaatcattagcccaagtttacaatagagaggattaaaagaaaattaagggacctgaataatatagaaaagggatatgcagtacttaaataagcatttgattcatataataaaataatgcagtgtggagtctaaggtccttttttggtcgaatcttcatgtgcacagaaaggggacccgccttgacaacagtcaccagcatcaggtaattgtgagactctcaactgtggtaggcaattggtgagataatgtaaaagcaccttgtaaatgctagtgctaaacattagatagtattatctgcctctgttgcctctttcttagagaccaggaaatagtgcacaaagcaggaatactattctctgttcctctttttcatatagttccctctcggtctgatccttttaagaactttgtcatttgctcattttggctttggcttcccatgcctactgattctttttagccccactttattgctgaaaaggagaaacagtagctctgaaaaaactctctaatgataaatgataggagaagcttaaaactatggatcatttagcagagggcaggcttcaggcagttgattctcaattatggaataattgtatttaccacctatcgagcacttacatgtttcaggcattgtactaagagcttcacaggcattatcttatttattccttacatttatcccgtaaggtgggtattacctccatctaaagacattggggcatccaggcagagatgtaaagtatgtagacagatataaaaatctacagctcaggaaaaaatgtagattggagataaggatttagaagtcattagcatatagatggtagttttaagtatagataaaattgttcatagactataagaattccagatggaattctgaaagcatcatttaagatatgaatgaagaggcagtctaggaaggagcgtgagaagagctccagcaaggtaggaaaatcaggagagaacatggaatagataaaaacacagcagagcttttcaagaaagagggtatgatcagcatcttaaatattgtaaagaagttatgcaagataattaatgaaatgtatcccttagatttgtatcctttaattggaattgaaaattgaaggtcaatttaccttaaacaattttagtagaataatggggccaaaagccagactagagtgtgttaagcaacaaacgtgaagagaggagaaaattacaaatgttgactaattttcagtgagcctattcgtggagcataggagagagagtgacagcttcaggggaatgcagactagagggactgatgctgattggttagtggttttttgagaaatttaagcatatttactaggggaaaaatgtctatggaaactaaaaaaactacagtgactattagtacctcaataaagaagactattggaattttccctgctttttaagtgaaattgacctgggagtatttaaatttgccttaaatcatatggttgtttttattataatttttccttatgtacacaagtagtgggtaattattgtgaaaaaacttcagactttacaggagttcataaattagaaaataaaagtctttataacatcagtgataactattagcaatttgatatatggtatatatttttttccctctgcatataccgttacctatgtgtgagcacatgttgttctgtaacttttttaacttaacagtgtagtcaactgataattcaataatggaagtaaaggtaaaaataaactaagcctacagagatttttacatctttgctatttaatatgtgatgaacctccatattcaggaattttatttacaaacaccttatctattctttgtccttcctctttagagtggatgtaactgaaattcagatagctttagtgattgtctttgtgttgtctgcatttggaggagcaacaatgtgggactatacggtaaatctgaatatttaaatttatatttaagtacttttcaaatatttaggaaaaagtattgcattgttaattttcttcaaaaatccttggcattgtatttaattttttttttttaattggtgtatttaatatttgttccatttcttaacatttttttcttcattttataatgtgtattatcctatataccttatggcatttcctcctatgcttgagtatattgccacatagaagaagacaacctcatttccctaatactaaataaaacaaaaacaacaacaaaaaacacacattggaataactttttccagggtgaaataaaataaatattttaaaaataaatccagtaaaatgttttacatttaaaacttgtcactcaatattaggaaagtagttaatttgcatttttataatctactttgaggtgaagattcccatattaaggaatgtttttattttctgcctgcttggtgacctcagtagtttcataaaagttggctcttaggaggccactgtcataaattcaagcttttttgcaaaagaagaacatttctgaagaaacagttgtcctgttaccacaacgtaagtccaccatactggctaactgactcacactttctgctcatagtgttaagaataataataataaggatatcaatagtcaacaactaacagtcattcaatacttatgttcctaaacattcaccatctgcccctcagttttatctgcccctcagaacaatcctataaaatagatattattagtattatgctttataaataagtcttagggtgattaagtaatttgtccaaggacacatgagaagtgctggagctaggaattaaacagactgattccagactgtatgtaatcactaagctatatatctagtaaaaatagtaagtgatacaaaactaaacatagttttgtggtaaacatgatcagcagtcacactccttgttatttacctaaatgatttgaaaacttatgtccacacaaaaacctgtacacaaatgtttacagcagctttattcataattgccaaaatttgaaagcaactaagatgtccttcatcttagctggataaactaatgctaaaaagaaatgagctatcaagccatgaaaagaagttatgcgaggaacttatggagttccaagaagttatggaggaaccttaaatgtttgttactaagagaaagaagccaatctgaaaagtctgcatattgtgtgattccaactatatgacattctttaaaaaggcaaaattatggagacagtaaaaggatcagaagttaccatgggttggaggaagaagggatgaataggtgaagcacagagaatttttagggcagtaaaactattttgtatgatactaaatggtggctacatgtcattatacattcgtcatagcacacagaatgtgtaacaccaagattgaactctaatgtaaactatgaactttgggtgataatgacgtgtcaatgtaggttcaccagttgtaacaaacgtaccacgctggtgtaggatgttgttggcagagggaggggtggctatatacttttccactcaaattttgttgcaaacctaaaaccactctaaaaaattaagtccattaaaaacacagtatgaggccaggagttcaagaccagcctgggtaacttagcaagaccttgcctctacaaaaattctgtaaaactttagccaggcatggtggcatgcacctgtagtcccagctactcaggaggctgaggcaggagggtcaactgaacccaggagttcaaggctgcaatgagccattatcatgccactgactacactcctgcctgagtgacacagcaagaccccatctttaaaaaaaaaaaaaaaaaagatttccctgtagcatttagtatcagaattgccaattatcatttgtcagtaggctccgaaatagactttgggcatgtttttaagtagtagtgatagattcttcaatacattcatattccctctcatcatgtaagagtaaatagaatcaaggatatgctactataggcccatacaagataacagagggatgctatgcgttttttgtagtaactgttcaggttgtgcccgtaagaaggtaaatgtacgggcagatcacctgaggtcaagagttaaagaccagcctggccaacatggcaaaaccctgtctctgctaaaaatacacaaattagccgggtgtggtgatgggcacctgtaatcccagctactcgggaggctgaggcaggagaatcacttgaacctgggaggcagaggttgcagtgagccaagattgggccactgcactccagccctgggcgacaagagactcgtctcaagaaaaaaaaaaaaaaaaaaaaagaaggtaaatgtagacctagaagcagttagacaactctagttattaagtcaggtgtggttgtcttaaatttggaattgaatcttaaaattgtttcactcaatgttttggcaatatcgtaggaagaaaacatacctgcttattcttaccaacaagaatgcttacttttgattcaggttttctaaatttaattattaacctgtagtttccacaaattttggtacattatttcagtctattttctaaacatagtagcctctagcttctggcaattcattgttactgttttttaaatcctttgctgcctttggaagttttcttgaacagcagttgaccaacaggtaaatatattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgttcttctcttttcccccctcactactgtacttggctagtctacaaaaaataataaaaatttaaaaactaaaaaaaaaagttaaaaaaaagtttttaagttatcactttggattatattccagaagttaaggtttgatcacaagaaaaaggatagcttattgtacagggcttatcattatgtttctttattatttaataaaaaaccaaaattctgttgtcttaattgtttctttcttctacccctaaagattcctattctagaaataaaattgaagatccttccagttcttggatttctaggtggagtaatattttcctgttcaaattatttccatgttatcctccatggtggtgttggcaagaatggatccactatagcagtaaggcaataatttcatcattcagtgtcaattttatgatacattttcttatcaccagttataaaaagattaaaatatgccaaagttcaagaatggggaaggaaactaagtatcttaaagaattcattttaggcacatagtacaaaagcattttaaaaacagtttaaactgatattttcctctttctacaagcttgctctgcatagacttttctgacatctagtttcattactgcacataattaagagttgccatttgttttcctgcattttgtgccttgaactaatagcagagaggagaaagggtagggaatgtatgagttcctgattgaaagcaggaaagtggccagaggtcaatggtttcacatatggggggatttattactcatcaagtaaattttattgaaatttcactgaaatatatttaaaagaactattctaatatttcaaaaggtaaaattttaactttaattcttaagtgggtatactttgtgcttgtgttctttacaccttgctcatgcaagtattaaatataatgcttttgtattttttcacatttgttttttaaaacttcagtacttttaagtgggcaagagttgggattcctgcaaactttttaaacaaatataacacctatgtttttaaaaagcctattgtcattttcaaggtagttgaacagaagaagacaagtacttattccagtgataccatcttataccaaaccattgttataatgcctttttcagggccgggcacagtggctcatgcttgtaatcctagcaattttggaggccgaggcaggtggatcacttgaggtcaagagttcgagaccagcctggccaacatggtgaaaccctgtcgctaccaaaaatacaaaaaaattagctgggcatggtggccatgcttttgtaaatccagctagctacttgggaggctgaggcaggacaattgcttgaaccaggaggcggcggttgcagtaagctgagacggtgccactgcactccagcctgggtgacagagcgagactctgtttcaaaaaaaaaaagaatgcctttttaggattgctttaaactatagcatattcactttaatttcttttgttgtatagttcaaaatttctatcctttaaagtcatttggagcaaggtctaataagatattaaacattagatatagcatttttagtaaaaaaaagtctcattcttttaaaagacgtgtaagtagactttcgagacaatttcaaagggatcctcataattgacaaattgtcaatatttatgaatacactttatatacataattcaaaagcaaagtatacaattcatctagaaatataagttctgatatatttggaaaagttgtcattttttgaggtgttttgtcagttgatctcagtatagtactgtgcttaggaatacatgttgcttgactgtggatgataacatagaacaatagttggaacgttaagttccattgaagaaaacaagatgtagtaatgatcattgtctactctaaagaatatttttgaccagatgcggtggctcacgcttgtaatcccagcactttgggaggccgaggcgggcagatcattaggtcaggagttcaagaccagtctggccaacacaatgaaaccctgtctctactaaaaatacaaaaattagctgggcttagtggcgggcacctgtaatcccagctactcaggaggctgaggcaggaaaatcgattgaacctgggaggcggaggttgcagtaaggcaagatcatgccactgcacttaagcctgggtgacagagctagattccatctcaaaaaaaaaaaagaatattttcattaaaaaaactgttagatgtttgaaggatgacttaaacacaagttaggaagtggttggtttcaaactcttaaactggtatttttccaacttttttaggagcagattttttttcttgaatgagatttaagaatcataatataaagcactattagatttttataatttattactatacagtgtcatgtatataattttataatatggtattactgtaattttatagtaagttctaacttaaaacatgtaaacttaataaacaagagtaaagctgttcttgtgaacccatttaaattggttatagatttaataacctcaataccaaatttatttcaatattttatttaggataagcagtgccgagaggatactaattcacatagataaaaatgtaatggtctggattttacaattttacataaaagaacatttgcagtctgaatgcaaaaagaaaggaggtggggatgttggtgtagaaagaaactaggataagctgggtgtggtggctctcgcctgtaatcccagcactttgagaagctgaggctgggaggatcgcttgagcccgggagtttgagactggcctgggcaacatggggaaaccctgtctctactaaaaacacaaaaaattaaaaaaaaaaaaaaaaaaagaaaataggaaaaaagaaggaaacctgaatagaactaaactattcttactcttcttcatcagtgatattttgtagaattggcagaataagctctatttcagtatctccacaaaattatgttaatttggcaatccacatgtggactgccttcgatgtagtaaaagttgatatagaataaactgcattaatttttagccagtttaaaacgtgtgtgaatatcaaactggaatcagacatctgtggcactgtattatgtctctgtcaccctcaggttctatgaaaccttggaaagcacaactcaggtttgtatactcctgtaggccatacactacatcacactgttctttaggcctcttgcacaaaatagatggtcagaaaatgtctacattgtaataaatgcagtgttaaaatgtgatactgattttctgctttatcccttagggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtaagaaatttttattattcatgatataaataatatacttagtcgtcaaacacaaagctggaaattatttcataaaatgtataggttttcttttgtagtgtaaaatcataataattagctatttgtgctccaagcaaaactgtgataagagttatattcagttaaattgtttagctgtagttatcatttacaactttctgatatcaagaaatttaaacactggaaactttaataagctacccagttgtgaatttgagaaggtgtagaaaagtattcttaaatgtgagattaaatggtctgttttaatactgaattaaagttataattaattctgtcgtaaaagctaacacatttaaaacttaatagtaaaattattttgtttaatttttttataggtagctcacatgaccaaaagtgaactatatcttcaagacactgtctttttggggccaggtcttttgtttttagaccagtactttaataactttatagacgaatatgttgttctatggatggcaatggtaagtatttttctccattttatttattttttaacaatgcttaagagctatttcagtgagctatcagtagcctcaagatctagtctaggccaggcgtggtgactcacgcctgtaatcccagcactttgggaggccaaggtggacggatcatttgaggtcaagagtttgagaccaacctggccaacatggtaaaactctgtctgtaccaaaaaatacaaaaaattagccaggcgtggtggtgcatccctgtaatcccagctactcaggaggctgaggcaggcaaatcacttgaacctgggaggcagaggttgcggtgagccgagatcatgccactgcactccagcctgggtgacacagcgagactgtgtctcaaaaaaaaaaaaaaaagatctagtctatacaatatatacaataaatgtttctgagtatttaaaattacttcttctaagctgtgaataatattatattgtgtgtagaaatggccacatatctataggccaggtttccaacaacctggattcttggaaacacaactgtgtacctaaaaatagctatatttttctcccccaaaataccagtacaaagatgccaaaaaccactttactctgcccaaagactttattcccagtttacagcaagtaacaggaaaattagatggggttagtactagcaaaggtgggcactttattgcatcgagaattgtcagctaatattgaggaaacaaaacagaatagacagtgctactaaatacaggattctcagaccattttatgctagatgtaaggaaccctttttatgtgtatggcccttgaggatagtgtataatttgtattaatgatgactcagtcatcaattaaattaaattcgctttgattatatcctgcttaaggaaacgacgtggatgacataatttctattcaaaatgattataaaatacagaatatagtgcttgagagagacacgttagccatctaaggaaaagaaaatcaatattggtaacacttcaattacaaagttggataaatggagcattattacattttttttctattgagacatatctttatggttggtctccaattaatggtggctttgaatagttttcttgtatttctatctctggacccactggttgtcaccaaattcatagtgatatataaatataccgaagtacaccaaaacaaaaccccccaaaaccctgcagtgaatcttttgataattcaaataatctcaccgtatttgttagagttggatatttaaaaaaatctgtatctattctgtgcatggattacaggagtacatctaatggtcccttactaggttgtgtagtatgctttttctggagtaacttaataacgtaatattcattcatagtccattcagaagtcttcattcttcctatggtggcagtgagatatacttaattctttgaggtggacaatgaacgttttcaggcaaaattaaaaaaaaaaatgtttaaaaatcagaataatgtcctttaatttggtatccactataaatatttttagggctcccaaacaatccagtttaaaaaataggggataattaatcaaaatatctaaaaactcaatgtaagttttcttttagtgaacttaggtatgtattaccaagtggaattgctgaattaaaataccaggtgttaaaaaaatcaatcatctgtcgtaacgagtaattggcctggtttacacctgtgatggagactggtaaactgaggaagtcaaattcaatttttatttaaaacactatgtggatgacaaaaaaaaaaaaaaaaagccacacacacaatgtggtacttttcaagtaagcttttaacataaatgatagagattttcccctcatgggtgagaattccctctccaagggcagagctatgagtctcctttttctcctgggtttcattttctgaagagaagcatttgactgtagactctgggcaaagtttctaaatagaggccatctttaaatttgtaaacacaattctgtatatgcttcaagtatggtatcttttctagaccttttaccttcttacaactaacctcaaagaaacagaaatgtatatgatggaattaattcattataagatgactgataacttcttctagaaggaaatttgcagcttcgtggcacagcaggaagttgaaacaatgtggagtcaggagagttgggttctgttactttctagtttctgtattttagtcgtcttttttacctctgagcctcagtgtctataactgtgaaataacctgcattttccagaggactacagtgaggtccaaatttgaaatgtattaaagtgctttaaaatgtagtatttttggtgaagaattttaggttaaggtttgatatttgggggagaaacagaatagtgctacttgagaaaagatagatcataatcgattttatattttcttttttgcttctaaaggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatcaaaaaaaaaaaaaaggagtaatttgtgtactacatctgttttaggcaagaaaaaggtatattgaagaaaacagtgaaagatgatattccttaaaagcaaaaaaacatacttatgggaattaagtacacagaaaacactggagtacttattttgcctctaactaactattggtaaaacttcccaaataaggactttcttacaaggatgaatagtacttatgatttatattctaataatatatactttggcttaaaaggaaaatcctttacaaagttcaaaaatttaggaaataatgtcaaatattcgttaatggtggaagactaatttcttcctgtacaagtaggttgtcacaattagaaaaagtttatctgtaggcacctgtttttttaaaacttggaaaaccttattataactaagataagggtgagttatacaggcaaaaattagaatttaaaacatagaaaagcaggaggccaggcatggtggctcacacctgtaatcccagcactttgggaggccgaggcgggcagatcatttgaagtcaggagttcgagaccagcctggccaacatggcgaaaccccgtctctactaaaaatacaaaaataagctgggcgtggtggcaagtgcctgtagtcccagctacttgggaagctgaggcaggaaaatcgcttgaacctgggaggcggaggttgcagtgagctgagattactccactgcactccagctggggtgacagagtgagactccatctcaaaaaataaataaacgcagatgtgatatatataaaccataagaaattaggtatgttaatgatgtgctcttaatttaattgcagaccaagcccaatgaagtgacattatgtctttgtggcaatgacatattcacaaatccatgtcttaaaactgttatttatatattgttctattgctagtgatttaatgttcagaggttaatgattttagcaatttattccagaacacaaatttaaatgcatcttattgtcattagaatcggttgtacaacttaagtatatagaaaaggatgtacatgtaaaatagattttgtattccgttttttccttaaagaacataaccttctatacttggttttctaccttttgggattgatagagatacaatgaagccaaacctaaaattaaatcgtctttatttaattgacagtgttagagagaaaaattcactatcattactaaagagctgaaagcttaatacatattctttaggaatagttgctaactaactcataactatttagatttgacttaacagaaagggaggtcttacaatgaaacaggtttatgattaaagatgttacaattaaactattctaaagacttacaatatgcttcttagctaacgttataattgtatcatattacttaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaatccttattttttcaatttcaatatgatcacttacagtttccatcataatttttttttgcaacatagccatttcttttttaaattcattttgtgcaccagtaagtagattatcatgattcttctccaactcttccatactctaaaaacacaaaagacaagttaagttacaaaggaccacttttcatctcaggttctaaacttgtacaattaattttcaaaagtagtaatttttgaatattcaaatgctcatctatttgaaataaaaatattctaagtaatacatgaataccaaaatacctactaaaaaagaaaaaatataagacatgaataaaatgttataggaagtacaatgtagtatactttgcccacaatgggtttcctgaactgttaaggtcaagataaaaaagactggaagtcccacatcagtaaaaaccatttctattaagctttccaaatatcaagcaataatctacttatgactaatagtgtgccatgaattcactagagggaataaaataatctatagtacaacctctttcacattatgaaaaataaaaattatgtcttacgtctttattattcattcaacaaacagttaatctggtgcctactatgtaaaaggtgtgtattaagtgctgtagagaaattaaaaaacaataatacatgattgcttcctgatggcaatgagaaaaaaacataggaacaaaacaaaaattttataataggaatggaagcacaacttgctgtggtgatatagtggaaaatggggattaattccaatttagtgggcaaaatactaagatttcaatagataaagaaaaaggagttaaatatattctaggggaagggcataagcagaagcatggaagtacatagtgagctgagagaaagcagttatgtggaggggtggggtaatgaacaaatgtagtaaatgaagcttaaaaagagggtcatgtcatagggggatcttcaatacctaagaatttagaacaggaggctactgacagtttttcaagagggaagagatatatttttaaaagataatatggcagatctaggagggatagattggagaacagagacatcagttaagaattttaatggtacaagcaaataataatgaggtcctaaactagggtagtagcagtgggcattaaaagaaagaaccactgcagaagtaaaaattacagggcctagtaataactggatgtgacagagaaaggagatggaagagtcaaaggttatactatagttcctatcctaaatagtaacatttagtgataacatttagaagaaatctttatctagtactttatcaaaacttcacaccaactaccaaatggttctcagagcattggaacaagacaacaagttttccacttggaaatactttttaaaataacatgtgtgtgtataattttttttttttttttttttttgaggcagggtctcgctgtcgcccaggctggagtacagtagtacgatttcagctcactgcaacctttgcctccagggctcaagtgatcctcccacctcagccttcccagtagctgggactacaggtgagtgccaccatgcccagctatttttgtttgtttgtttgttcttaatagagatggggttttgtcatgttgctcaggctggtcttgaaaccctgggctcgagtgatctcgccttggcatcccaaagtgtcagccactgtgctcggccatatatattaaagttattctgaaatatttattttaaaacaattttgctagtttacttagagcatcccaattcctttaatgttattttaacatgtatttgcacaagactatctaaaggaaccaccactgaaaaaaagtatatgcaagattccattgagcttctatgaatagttactaaaaagtatatttctgcctgaacaagaggggtacagactacaatttgctaatatgtatgtgtcagtagataattatcaatccacagacttttaatcctcagatgtctattatatctgttattttatgttggatataaattcatttttggtcactgtaataattctaaaagcaaatgtgccataaaatacttctataatacatttgaaaacaagagaattcaataatttgggtactttctatttaacaaacactggggataaaaaaacaagtaaaatacaacctaaaaatgattattatagagtctattttcacttaaacagagaactatgactgaagtgttattaaagtatggattttatgcatgataagtatatttctaagtaaaattcccaatttaccatttcctgtcttgaataatcccaacaaaaccatttgaatcctcaagtaaaaatatatttatcacttaaatcagaaacaatgaattcaaaatggaaaagtagttaaagtctaaaatgttttttcccataaacttagaaagaattatcttctacttccataaatatattatgttttataacgatgtattgtgttaccacatacaacaaacctttatgaactgctcatataactgtttaattgttttcaatctctggctctgaacaattctagattgttgaagaatcttttgttgctgtcgaaacatattctacaaatataaaagaaaaaaaactgtgtaataacaatttgggtaaaattttaaatttagaaaaaataattctacattaaacttaaaagaaagtgttaaaaatcaatgcttttaaaattttaacaactattatgaccacatttagataatttatgttcaccactaatatgtaacaatatattaattctaccagttgctgaatgggaaattttaacaataatcaagtcatgtcttaattcttggtgatttcaatgtccacacagatgatccttccaataataatggttttccgtttcgtgacctgtttctcaatgattttggcctctaccctactttagccattgacttacatactcccaccctagattttgtcattactaataattctaaccactacacagtattagtaatggtaaactttctaagagatagatactcagcattcccctttcatagatgagtaaactgaggcataatctgtccatggtttcacagctacaattgctcaaacaagaatttgatccaaaacagtattgttgctggcatccaggctctaaccattatacatactgtttctctgtctatcctagtatttaaccactacttctttaccattctaacttactctttttagtactacagctcaataatctatcagtgccacaaatccatcctatctattttacactgtcatccctacccccaatatcctcacttgcaggtaacacaagtctggccattaaaagtcaacaatgttctgactacagacatccttaggtatcctggggggaccagttccaggacacccaacccctcaggagaccaaaatgtgcagatgctcgagttcctgttacaaaatggcatcatatttgcatataaccaatgcacatccttccacatactttaaatcatttctagatctcttataatacctaacacaatgtaaatgctgtatagttgtaacactggattatttttccaatttgcattttttcttttttctttttttttttttttcaagaaagggtctccctctgtcacccaggctggagtgcagtggcacaatctcggctcactgcagcctccgcctcccaggttcaagtgattctcccgcctcagcctcctgagtaacttggattataggcacacgccatcacagcccggctaatttttgtatttctagtagagatgggttttcaccatattggtcaggctggtctcaaactcccaacctcaggtgatccacccgcctcggcctcccaaagtgctgggattacaggcatgaaccaccaccacgcccagccttttccaaatatttttcatccacgattggttgaatacacagatgcggaacccttatatacagagggctaactatacaatgattggttcaagaatgggcaaatgatccaaactcccatcagtcatattttcccagaggaattttttgccagagctattgagaaagattttctcagtccactggggttactaaacttgtaataagcctaggactgtaaaaactatcttgcttactacatcaagacaccttactaagtactgatgacagaacccagatgacactacatgagcaaccccctccctgttcccatctggctatgcctgaagctaaactgccccgacttcttttacataaaccaatgatccttcttttgtactttgacaaatttctgtcacttggaaatgcaggaaccccaaacaatataaatgccttttatgagtatggtatgtgcctatacgtctgtggtttacagttcagtaggtttaaaacacatggccagcaatggttaatgaaacctggctcagttccactggtcacaataaaaggctaggttgtccattcctacttgagacttggttgattataaacctaatcatgataccaacaagtattttttcttcttgttcctcagctttctgcatatctaaatcccactgctgaaacaaagtcagaaactgctgagaatattcttggttaagcttctgcctgtaaaacataatgatgaattattgtcatatttcataccaatataaaaagaatttaaaacaaaactgagttgacacagttatactatataagaaaaggaaatacctgcagcttaagtcttctgatgggaaaccaaaaagtaaaattatgatttacactgattccagaagtattttttttctaacaaactaatagaagaaaagccctgtcacaagctttagctcttgaaaactaaggaagttttattgtatatataaattttcaaaaagaaattcatctgatctctaagcagtttatttttcatttttttcctattgaatatagattctgatataacaaatacattaaataaggtgattgtatttatcctataagatttctaaatagaaatagttcgcttaatttttttccctattttggcttaacaaaagattttatacaaaagaagagttaagtcagctaaaacatacaaattatatacgatacaagattggtgttcttctacattgttgaacataattcaccatcataagactaacggtttttatgacatttaccttttattcaactagtgtatttctagaatgaacataaattacttttaggctgggcatggtggttcatgcctataatcccagcacttgggaggctgaggtgagaggatcgcttgagcctaggagttcaagaccagcctgggcaacataatgagacccccatctcataaaacaacaacaaaaaacgaaattacttttataacctcacttgttacctaaaaggaaaaaagtgatctttattgattttttaggaaataatgtcaattctatgaaggagtgaggttatagggctacaggactatcatacttagagaaaaatcaagccaaatacattttcactagaaaccccagtaactagaatagtatttttcttttcttgttttttttgacagagtctcactctgttgcccaggctagagtgcagtgtcacgaccttggctcactgtaacctctgcctcctaggttcaagcgagcacgcctggttaatttttgtatttttagtagagatggagtttcaccatgttggccaggctggtctctaactcctgacctcaagtgatctgcctgccttggcctcccaaagtgctgggattactggcatgagccaccgtgccgatcctagaatagtatttttcataagtaatttataccagtaaatactaagaaatgtggctctaaaaaaaaagcaaccaccttacctttgatcttgttgtgttttccaaacatgttcaattttctggttactagttttgagagaagccttggtatacatttctagtctctttctcttggcaagaagagccttgttaatgtcaactagattgaaaataaaaattcattaaaatttaatgttgaaaaaagtattttgttcccacatattcaagtaaatatgggtaaggttggttcaacaatattggaaagacatttaaacttaaatttagaaataggcataatttcaaaatgcagaattgtttgcttactttttttttctgagaaaactctcagctactagcacccaaattctgattttcctaactggagataattttttaacttaggaacaataaaaaagagctaataaacaaaacaatgtgtcaaggacagactttaaatttccccatgagaaaacactgttaataaaggctaaatgtaggccagacgcggtggctcacacctgtaatcccagcactttgggagtctgaggcaggcagatcacaaggtcaaaagatcgagaccatcctgaccaacgtggtgaaagcctgtctctactaaaaatacaaaaattagctgggcgtggtggcgcacacctgtagtcacaactacttggcagactgaggcaggagaatcgcttgaacccgggaggcagaggttgcagtgagctgagattgcaccactgcactccagcctggggacagagtgagactccgtctcaaaaataaaaaaaaatttttaaaaaggctaaatttatctaaatttataaaatacaccccaattaaaaggacacatttcaatgaattattgttagaactcattatagaaaatatgtaaaagtactctattagaaagaatccaaaaaggataaaaatagttaaagaagaaaactatttttaatataatcaattttatatatatatatatatatatttttttttttttaaagacacgggggtctcactatgttgaccaagctggtcttgaactcctggcctcaagcaatcctcctgccttggccttccaaagtgctggaattacaggtgtgagcccctgtgcctggccatcaatgatacttttaaatacattttttactaagagacaaagaccaaggacagaaaaaaatcttagtttaagtaaatttctagataaattaagatcactttatttttcaatgagaaataggtgaataagatcagttttaaatgcttttgtggagctctttattgggcatttttacccataagaactgcatttcataaaatgtttactacttcaaataatgctttgctaaacataagcctttatcttatggatctaccataaataggtatctttcagtaatcatgctgtagctgcactattacataaatattttatactttcagtattatctataataaatttataaaacaagcactgtttcaccaccggacagagcaaaggtttcaaaaaagagttgactgtatgaacaatccatttagaggagctaaatattaactcttttttaagataactaatctctaacaaagctcatattattgatacttaatatattatttaaaacttgagaatttttgaacctaattataaaactctatctagcaaaattgtctttagtatcaactacatagtttattaatgtaaaaagagttattttagaggcttaatttacactgtcctccctaaagaaaatagcataggaagtcagaaaataactaaactgaaaaaatgaaaaacttatatacaaatatatgtatgtatgtatatgtgtgtgtgtgtgtgtgtgtgtgtgtgtgtgtatcacttagtctgtgaatacaaagaagggtaaagacttttcctgtgcatttttcttctaaaattccatagtccattaaattcacatatgtataaaataccattcactcttaacatcatggaaaagattaactatgaaaatctgtgatgctaaatcacaaatacttatgcagaatcttctatgtgagaacaaggcattaaataacagtcttatagtccattattaacatttgttattatacaaattatatggcttaaaacaattttctttaaatacaagtatctcctaaaacctacctccaactccttccagcatattctgcacttcacccctggaaagaaattacattttaaacactttagaagatccacaacataccatgcttgttttggaagaaataccagatgccaagtattttacatatattatttgttagcaacttttcttgaagtgctttatctaagaaacaaaaattattttgaacacgttaccccatatcttcaactactcctgcagaagaccttttcttcctacgtttctcaatgactgcagtcttccctgtattgacaattaaaaaaaaaaaaaaaaagcttttgaaactgaataggttattttggtaaattttaatgaaacatcttcatttggggatttttaggctttttgccaacatacagtttcaaagcagacataaaaatgcaatattctctgcaggttaggtgaaattaaatcaggattcaggaccattttataggaataatttttcaagtctccctgggttaatgtcacagtaagccacatactatatatcagatattttggaaataactgcaaaagcaagagttgccgaataagcttctgtaactccgatactgcaatataaggatcaaatgagaaacacaagtacagctggccatccgtgtcagcaggttctgtaaccacaaataccgggggagggaagaccatacctgaaaatgctttacaaactaagttgtacgatagtctcaatgggttcaaaacaaatgaactgaaggacatcactgcccaacatgagatgtactgcaccttcaataacatcttcctctgatccactcagatctttcttatcttcagtctcaaagtcataggctctcgtaaactgatcttccacagacggcttcccagatttcctggaatacttttttccggaggacaccatatttagatgcttcctgactttaaaaaacaaatttctttaaccttctgaatgcaaagacatcattttaatacactggtaaaagtttaaatatcaaaggagatatcgaacaaggattgttgaatacaattttaacagtttcctcatttatttggggggccaaaagttaagaagataatgacatttgttaaaaaataataaaataaataggccaagcacggtagctcacgcctgaaatcccagcactttggaaggttgaggcaggcagatcacctgaggtcaggagttcaagaccagcctggccaacatgatgaaaccccgtctctactgaaaaaaaaaaacaaaattaaccgggcgtggtggcacgtgcctgtagtcccagctgctcaggaggctgaggcaggagaatcgcttgaacccgggagacagaggtcacagtgagccaagatcgcagccactgcactccagcctgggtgacaagagtgaaacttcgtctcaaaaaaaaaaaacaacaacagaaatggccgggcgctgtggctcatgcctgtaatcccatcactttgggaggccgaggtgggtggatcacctgaggtcaggagtttgagaccagcctggccaacatggtgaaaccccgtctctactaaaaatacaaaattagccgggcgcggtggcgggtgcctatgatctcagttactcaggaggctgaggcagaagaatcgcttcaacccgggaggcggaggttgcagtgagctgagatggccccactgcactccagcctgggcgacagagtgagacttcgtctcaatcaatcaatcgatgagagagaatgacagtgtccaccccgactccaagcgcgcagtgctggagaggtggcccctgaggcctgggagttccaaattttggggccgcctctgccagattctggctaaatctgggcaactctagcagggcgctcagtcacgcggggaaattatagttgctggcgggacacgacatgaggatgccagaaataagctcataataatcaagacaaataataaaaacgtcccgcaatttaggtctcggaaaatgaacacaggcagaagatttcgacaacaaatacatcgaggaaccacgaaaggcgccctcggcgtgga

SEQ ID NO: 272 - DNA, 378684 bp, Homo sapiens
gatggtatctcattgtggttttgatttgcatttctctgatggccagtgatggtgagcattttttcatgtgttttttggatgcataaatgtcttcttttgagaagtgtctgttcatgtccttcgcccactttttgatggggatgtttttttcttgtaaatttgtttgagttcattgtagattctggatattagccctttgtcagatgagtaggttgtgaaaattttctcccattttgtaggttgcctgttcactctgatggtagtttcttttgctgtgcagaaaatctttagtttaattagatcccatttgtcaattttggcttttgttgccattgtttttggtgttttagacatgaagtccttgcccatgcctatgtcctgaatggtaatgcctaggatttcttctgggggttttatggttttaggtctaatgtttaagtctttaatccatcttgaattaatttttgtataaggtgtaaggaagggatccagtttcagctttctacatatggctagccagttttcccagcactttttattaaatagagaatcctttccccattgcttttctcaggtttgtcaaagatcagatagttgtagatatgcaatgctatttctgagggctctgttctgttccattgatctatatctctgttttggtaccagtaccatgctgttttggttactgtggccttgtagtatagtttgaagtcaggtagcatgatgcctccagctttgttcttttggcttaggattgacttggcgatgtgggctctttttggttccatatgaactttaaagtagttttttccaattctgtgaagaaagtcattggtagcttgatggggatggcattgaatctatcaattaccttgggcagtatggccattttcaagatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttattggtgtattagaatgcttgtgatttttgtacattgattttgtatcccgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttgcagtttttgcccattcagtatgatactggctgtgggtttgtcatagatagctcttattattttgagatacgtcccatgaatacctaatttattgagagtttttagcatgaaggttgttgaattttgtcaaaggccttttctgcatctattgagataatcatgtggtttttgtctttggttctgtttacatgctggattacatttattgatttgcatatattgaaccagccttgcatcccagggatgaagtccacttgatcatggtggataagctttttgatgtgctgctggattcggtttgccagtattttattgaggatttttgcatcactgttcatcaaggatattggtctaaaattgtcttttttggttgtgtctctgccaggctttggtatcaggatgatgctggcctcataaaatgagttagagaagaatccctctttttctattgattggaatagtttcagaaggaatggtaccagttcctccttgtacctctcgtagaattcggctgtgaatccatgtggtcctggactctttttggttggtaagctattgattattgccacaatttcagaacctgttattggtctattcagagagtcaacttcttcctggtttagtcttgggagggtgtatgtgtcgaggaatttatccatttcttctagattttctagtttatttgcgtagaggtgtttgtagtcttctctgatggtagtttgtatttctgtgagatcggtggtgatatcccctttatcattttttattgcgtctatttgattcttctctctttacttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttgatttcaaagaacatcataaagaaaataattatattttcaaacacccccaagaattttgaagacttgcagaaaaataatctgctctcccggtgccaatattctgttgaaagtcataaatccttactttaaataactattgaaatatttgtgtcattattagttcactacagacttaaataaaaatccactgctgtatgcagcaccttaagatgaattataaattattcctgtctcattcactcaagatacaaaatcttagatagaatacccaacttgctaagcctaagccatatccccttgacacggggttgagagatatggtatctaacttctcctacatcctagtaaggtatcctaaaatttaaataagagtaatcattacggaaaaggaaagacccctaatctctcctcttatgtttaacttgtcatgatatgtggttataaagaaatgtatatatgtgtgtttctatatgtacatacacacacacacatatatatagtgtttctgtatgtaaacacatacatacatacatatttatgtgtataaatatgcaatgtattcatatgttgatatctcggaatgcagcacaatgaatcctgtaaacatcctgaaatccaattgtctctgtcatttaaaatgtttttaggcttaatagtcagaaatggtatttttttaatttaaaaaatgttttagcttcccccatccgtttagttttagttgacatgtaataattgtatatatttatgggatacagagtgatattttaatacatgtacataatatataatgatcaaatcagggtaattagcatatgatacctatcacctgaaacattttacctttctttgtgctgtgaacattcaaaaatcttctcttctagctttttggaaatatacaaaaatgataatgaaccatattcaccctgtgatgcttcagaacacccaaactcattcctcctatctagctgtaattttgaatcctttatgcaagttctcctcctcctcccccttatgcttcccagcctcgaatacccacaactctactctctactggaactggatacattaaggaaaataaaataaagtatattagtaagattaatttcacatgtccttgctttgtaaaatgtggctactaaaaaattttaaattacatatgtggataatattatatctctactgaacagcacagatctatgggacaggaaaggaaaccaataattaacagggttgacaattaaagcaacagaaagaaggtggcacatgcattttattttaagttttccgagataggaaatattgaattggagattattcatattttaggaaagtagtgaacggaggcaattaaaaataaaaatcttttttttttagcataaattcagtttagtgattaggaacttgagattttgcagcccattacctaatcagagactattactacttacgaaaaaattctcatgtgtaaatagtccctttttctttgtaaaagcttgaccgagtattttgcttatgtctcagactgtcatggggccaagaagggctggaagaagtggatgtttttatttcaattgattgctttttgaccctttcctaagtgacaggaggagtttcattctttcctcctcaattgatcttctcactgattgtttaaacaagtggaccatatcttggttaggtaaatctacagaaaataaatgaagagtatgttctgaccttaaacaaatgaagtattttttaaaaatctttttattatagagatccaaatttatctgaagataattacctaccctaatagtaatcaatacctggccaatcagaccctattcacatctacatccatttagcacctccctccatcccatatatttaaatcccagatatcataccattttatctataaacatttcagtatgtatttcagaaaataaggactctttgtataaaaaaacaaggctacaatagcattatcatacctaaaaagtaattcttgattaataaacctttggtagcatcaaatctgctcagtgtaaaaaaatttactggaatattttcatggtgattaaatgcagattaataccaggctctgaaacttacatagttttatgatatgccataaataatttaccttttcatgtttcaatatatgaattttgatcatcttctcatgctgatttctgagaaaataaaaatagaatcaaattgttatcttattatgtccctctgattataatactccttggcaatataaaaatattttgtaacacaatttatcccttaggaacaaactgaattaccattatgattattaaccactagatgccacagttgcttcacacaaatgaaattaactcagccttgatctgtcaagaaaaaatgataacattcaaaatagcttagtaaaatcctgattcaaagtgtcagtacaagcctaatcttgattataccttgtaacagaagcataaactgaacattcatgtatatattgaccttttactttcataaatgatcaaagaatgattccaccctttaaagtcacttgcgccttttctgtgattttaaagttattagtaaccttttccaattagttttaatatctaatgtagtcccattagagcagtttgctcaaagactctctgctaagtatagcagactttgtcttggggtggttgacattaaagtctttccaaagccacaggaacacaatctctacaagaagaaatctgtcttcactgtgaatccagatgataccttatgttccagtagctacagctcagagaaggtggcaaataattcatatgttactgtagtctaatatggacatatttgaaatagttaaagggtttaggaaagacagaaaatcagttttgtaattttctttgtaaactattataattttagaaggattttattattgcttttttctcaaaatccactatagaggtgcttcacagagattttatgagatggttcacaagtatacttattggcacattcttgcttagataagaacagcaactatatgagacattttttccagagttattattatagaattacctatatttgtgtattctttcctctaacacagtatatagatttttattatattttggtatgcaattatgtttatttttcttcaatgttagttccatgaaaatttcctcctcaacaacccttacatccaattgacatttttaaaaattattcctataacttattacttaatgttttgaaaataaaaaagtgagttcttgatagagatttcccagaaaattacctcctctaaaagtcatgtatcttcagaactaaagtgagatgagaaaattacttcactgactttgggaaacgcccacaaataacacccacaaataacaggaatctgaatacatataaaattaaatttacataaaaatcttttcccaaagcttctacttattacaaataaggaaaggggcagacactgtgcaggaagaaaaaaaaaagaggcttgttttttcccttctattctcaagtgatgaggtcacttcaataaagatttaaatgttttctctaattctacccttgtcccactgcagtttattttctccccataggagctagaatgatctttgtaaacaataaataaaaaccagatcactactctacacaacagcttcattgtcactcggaataaaagccaaagtctttatgaatgtctgcaaggatctatatatgcactgtccaatatggtagtccctagccacttgtgtctattgaacattggaaatgtggctagtttgaattcaggtgtgctgtaagtgatgagcacacaatggttttgaaaaattagtactaataaaaaggatgtaaaatatctcccgatattttgggtatattaagttgaataaaaagtatgaaaatcaatttcacctgtttttaaatgaggcttctagaaaaaaattaaattatatatcttgcagttgtggctcacattataattctattcagcactgacctaaattatcaacaagtcatccgcttcctcctttttccaatctactttggcctctgctgcgtctcaatatgccatgtctgtgtcaaagacttgtgttagctactccttctccttgaaaagtattatttcagatatcttcaggattagtttcctcacttttttctgttttctgctaaaagtatcagaaagaactttcctgacgtatcagttttaagtggcctcacccaacacataatacactcactatccttctcttttttttaaataaacacttacaccgacatattacagatatttctttatatgtaaaaatacttcatatacacacatgcatgcgtgtgtgtgtgtgtgtgtgtgtgtgtgtgtgtgtgtaatctcctcttagaatacaagtcccatgaagtcaggactttgttttgtctacgttttttttctcagtgatagtgtctgcctcacagtacatactaaataagtatctgttaaataaatgaaaagatgaaatgtaataaaaataagatgatagataccatgagagagacgttttagcataagggaagggattagaaaatgagaacatttcccaagtgtttacaatgaactaaacattatgttaagcacttcatatagtatattaataaagcctcacagaaatgaatttacagatgagaaatcaaaaacttagaattttcacaacttgcccaaggtcacttgtctcatatgtaatatcacttcaatgatttcattttatctgaatcttttctagtgccttccctgactcccatactaaattagatgctcttataaatattctcagagtactctgtatttctattcatatcatttatcaccattgtaattcatttcctagtgtgatgtttaatgtgtcttcttcaatgcactataagcttcatgatgggaagcactgaatagtttgttgacatctccatgtccagagccttccaccttgtctaatgtttaatctctaatatacacttgttgaataagtgaatgaaattaacttcctctccaaatattccaaacagttgatgaattgggttatttatgcccaatgagaattaatgattttgtagatcaacaatatgaatggcatccattaccataaagcccagttgaatactgcaggggagagggtactggtgtgtaggtggacttatttgtcctttactgttgaccatatgcaataggaaatcctctgtaaatgtgctgtcctacatggtaacccctagccacatggggctatttaaataaaaagtaattaaaattaaataaaatgaaaattcatttcttcaatcacactagtcacctttcaatgctccataattttatgtggctactgtcttatcagcacaaataaaaaaaaatttccattatagcgaaagttctattgaatagtactattctagaaattttaaaatgcctttgacgatttaaaaatcagaaggggcctgtttgactagctttgtattctaactaaaatttaactttgagagagcccagtaatctgtattcccaagtgtctctgggaaaaacctagacatggaaaaggagcttcattgtccagcagatgaaacatttagtcagacgtgctcatgcacagccagggaccggtgtggaaagaaccattcctccaaaggctccaggcaggcctagtgttccagggacgctgccagcacctcgctggatcgagccattatgtctaatgccattcaataccatccctttgcgtttgatgtctaaaacagaagactgaaatttgaagagaaggaagtacttgggatgccaaatgcaccccagactatagctttatgcacaacctttagagagaaatttgttaatgctcccttcttcaaaaatcatataccttcaggtaatttcttcctaacgtaactaaggcacaatgattttggccaatacagcttaactttttttgagattctgttgctggacaattttcctccctcattggagaggtaaaattttcctgtctttgccttagaaaataaaacggttcataggcaagaataaaaatcatatcctccattttattttttgattaagttcacttattttgtgggggtaagaatttctttcgtttggatcttcagggtattggccctgtgaatgtgtgcccatttctccactatttgccagtcccactgagccaatcttctaccaagactgaaaatagaccatagttctcatttcttgaacagatatcatcaggagagccgagggggagaccattaggcagccccacattttccaactcaacaggtggaggacatgggatttttacgttctttggggattgaacccccacacaccaccaactcccttagcctttcaggataagtatttccaatccctcagagattttcttaggagagaccctaacgacaatggtgcttctgtgaaggactgaggagagctggtggacgatgcaggtaggagggaagttaggctgggaggagaggtgctgggatgggacgtttggtttcctgacaagtgaccgactagagagagaaggcgcggagtggcagcggtaagaacaacgtggaaaggacggaaaacgcgaagagtggcgccctggcggacctggggcggggcagagtggtaagggtcacgccaggacgtacccggctgtgggccgggggaggagagcacggtgggacagcaacgaacttgctgggggctcccggacccgagctccgccgatgaggtcagcggagcctaggcgccgggaggaggccagtagagcccccagacacgagtgtcgggaggccagcggaggggcgggacgggacgggaaatgggacgaagagcaagagctgggggaggagggaagagggggcgtcggcgctgcaagccggaggcggcccgacagggatcgtttccttccggagaggaggccggctctggactgaggcgcggacggggggcgtccaagggcgggtgacggggaaataccgcggcccgcgcttctctccggctggcagcggtgccgcctgcggctcctcctccgggccagctcggagcccggcggcggggggagcgggaggcgggagtgagggcgggggctcgggaaggagggaggagggagggcccaggcgcgccactgacagggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtgctccagcggccgagggggagcccgaggaggaggacgggggcgcggctgggcagcggagagacggccggccggggagtagccacaacggcagcggggacgggggcgctgccgccccgagcgcccgaccccgggacttcctgtacgtgggggtgatgaccgcgcagaagtacctgggcagccgcgcgctggccgcgcagcggacctgggcgcgtttcatcccgggccgcgtggagttcttttccagccagcagccccccaacgccggccagcccccgccacccctgcctgtcatcgcgctaccgggtgtggacgactcctatcctccccagaaaaagtccttcatgatgatcaagtacatgcacgaccactacctggacaagtatgagtggttcatgcgcgccgacgacgatgtctacatcaaaggtgacctccctgcgccggctttccagcctgccagtctccccgactcctttctctgtaaccggtcctagcccctgcccagcccctccgctgcttctctgccagcacgtgcttcgggctcccacaggccctggcccgccctccccaccccttgcatccgcccacaattcgtagcccgttcctcgtcttctgcaatctggaccctcctcacacctgcctggctttattcgccttcctcacttgctgttttcggtgccgcctcgcgcttgtcccttagtctttacctcgtcggagaggttagaaaaggaaccttagagctaaaccaaaggccattcccactctgccctcctctgaaagcccctgctgatggtagtttccccaatcggtccagaggggcgtggtcttcaggaagggaagacggaggatgctagctacaactagtctggagatccagtgttctggctttggatcttgctcttttgtttaaactggatctagcgcacttttggaactgctcagattgaggaatcgtcttcgctgtcccggaccctttcctatgtgttcccttccctttggctcaactctccacatactgggagtccttggccatccccaccgtgccagcgcgctgctccttccagccgctacagttcagcaccaagccgtcccccatccccccgccacacctcaataaaaccctgagaggatgggcatgttgtaaggaattggtggtgggggaaaagaggaaagcacccgctaataagccagacccctgggaacagcagactgtactagcacacactagtattggttcctttccagtgcattttgttggccgcggtgataagcagaggctggaagtccttcccagaaccacaggcagccacagcaagaaaaaactttttttgtcagtttaaaagaggcgcggtctttttcccggaatgtgggcggctctggacagagaatttctaaactcagcggatcaaagttctttaggtcagagaagtgaatctttccagtccagccagttgctgagatggggagcaacgcaagggaagcagcagggttgtaccgaatgaggtttctctgtgttttccacatttccttgcttcccggtcaaaggggggcagcccttccttattttatgcctttctactcgtagcctcattgcttcctcctgattcggatagtacttttcacataatgcaagaaaaacgaacaaaaagccaaacaataaacccaaactgttgcattttggcacaaggaattagtgtaatcataataactagagatttcttggctttggattggaaggagggaagtcactctagagcaggttggaatagaaaatactgataattggatataaaaataaagaatggtctcattacatttttaacagtggtatttaggattgactcaaagaagaaagcttcctctactttaagttccttgccttggatatctcaaaattacaaaggtttcctggcagaagtttgccacattttgcagggaatttataaaatgcattaacagcacctacttctttcatttgttttaatactttgaaagattgtccttcagaacattaaaatgacatattatttcaatttctattaagaatgaaatgtgttttgaattaagaatccaataatagctgaaactcattgagatacacggggcaaggcatgggatcaagataatgactgcagatgctgtgctcatcaaaaatggtagtaaagatgctgactgggaatatgaagaaggtgactctctacttattccaatgtatcacttggaataccaagtgcttctcaactgttttagctgcaaaattttatttttaaacgttttttctgaacttaacaaactgcaagtgaaaccaattacactaatttttgacaaacttttttctaaaaaggtgccttcccaaattaaatttcaagacaggtttgattcaaacatcctccaaaactgtgcgggttgtatatgactgaagtttagttaatggcaaaacactgaactaaaccaattatgagtaaaaaataattattaggtattaagagtcagccaaaacaatgctaaataccagtatttaatattattttatattcctgggaacttcttgttacttcaaatgtactaagaaacctgtctttactttccttgtcattatttcactttttacagaaaattgatgattgtcagagctgttaaggtttttcagtgaccttaaccagaagctggtacaattttaatatgtttaaattaataactatgaattagtcttttaaaaataatagagtattggaagaggctttttcttcttttcagttgtgtaagactgaggattttaagcacaatgttgaaagttctgtcccttaccttgtacatgataagtgattatgaaataaggagacatagtaattgttgcctttctttttgtaggtgataaattagaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgaggtaagcatggagctgtgatgaaaatgttcacatagtacatatacatgccattttataatctagggcagcgattctattcattctctctgtatctttgtatttacttgaaagtgatagtagcagcccttaagggatacaagagtgggagataactttctcattaggtgtcaggcctgtctgagactttgttattagcatgccccttaactttaagcagtggcctatacttatggccacatctctggaagatgcttatatcctcccctgcttgatttattggtgcttatatacatgtgaatctatttcccttttctaacaagaggtttaattttactcttctctttagctgtagcctttagcatttggtactgtgcctttttattttattttattttattttggttaggtgtgtaatggcatctctttgtttttaaatggttaaaatctgaagtttctttggatattttccagtggaaatttaacatatttttaaaagtatcagaaaagtaaactaatagtgtatcatttatggtagatgtattcacaaaattccaatcactgtatttccttaggcatacaaaaggaatgagttgtctggaaaaaagcagaagtttaaatggtgtgcagtagctgcttagtatttttgacaggttccctaaaatttgtttatgtctattcttatgctattttctgaaaaggaaccattatttaaataatcttagctatttatttattgccgtgatcatttttatgaaatacttagagattttttcttcagaaattgattttgaaatgtaataacattttatttaaaatagatttcctaaaagataattttagtaaaaatttatttaacattaaaataatgtattgtttttagtatagtttggttttcaagtagttggaatttagtattattttagctacggagtgcacagctttgtaaattatatcttaactcctttgcttatgttttcaaacttttcatgtcacttagtatagaagaaacattttatgaaaatatgttccctgtgaagtcaccaaacacacagtttcatttgttttttttgtattgtaagtgtagtctcactatagttaattttgctttctctttcatactttgtggtatttatactttggggacatattttatacattacagaaagtaaaatttattagtcatttgaaataggcatgaaaatttgaaatgattatgttgctgatttcttttgataataaaatggtaatttgtaaaaactatcctacaactaccctttaggataaaaatttatgtaaaaacattacagtttagagacaggtaatctagaataaactcaataaaatatttcttcctttgttataaaacaaagtaaaagacaaaaatattcaatacagagaacatattcagttgattttgtttacatgctgttattgttttgcaggtatttactttgcatggataagtaaaaaaatatttgtgtggataagtaaaaaaatctcacctgtagttaacaatatagatgggaaattattgtgttttataggatactttattaccttaacataatatataaaattttaaccaagatagtgtttaggtgttcttcttttcaagttctcattgattctgctgtgaaggcctagtcttcacctagcattccattcattcatgttcaagacagtaagatatgcacaaaaattgggagctcaaaaattgatttaatattttatttataatataggcctttgttctggttaaagtgaagagaagttatattatagatgtgcaccctgtctattagaataagtgcaatcttagatccttttattaactgatgtaagagcaaacaaaagagattccaagtcttacaggctgtaacctggtgaatataacattttccataacttttcgtaatacatttgaatttagactgacacttgaccatcactgacttatgaatccgtataaaactaaactaattgtctcaacatgttttcctagcattataaaatattttctagataagtactgttgactttatgttttgctaagttattatatagaatttactttgtattgggatttcagtcattaaaggagctatttaaacagtatttatttaagggaggcattgatttaattctaataaaaaatctcaaaagtcttatatagagaaatgatggtaaattttattaccaagagatatgtgaaaaagcattgttagcaaaactagtaaagatacatatacaaagagattatatctaaattttaatactagattgtgttctatgtttcatgagacacctaagtacgtaacttggggcacagctaaactggttataacattcacagatcccatacttcactttctaatttggattttatgttagtggaaatggtgtccatatatgatactgttcatattatatagaaagattggtctattctactccaggttggcattctcagtaaaggtgagattttacatctgctcattaaaaaagctatgaaattgatcattactttttttcccatagttcttttaaaagcactatctgtgatagaattttggtaaatttttaaatttcttttatctatgcctttcacaaattttaggatttttttttttttttttggtttatcctcctaacaaaagttctttcagagttgagagtcctgttaaggtggcatgttcatgatttttaagtttgaatagatgaagtgttcatgatagaatgtcatcttttaaaaatggtgaacgtgcttacagatcttataaaaagagaattgaaataattattaaataaaatatataattgtatagtttccttgaatataagttatattttttaaaaatccaggattgaagcttctagtattcttcttaactgctaaactgaaattactttctctgtgtttgtatatactattaaaaatatgttgtaaaagagaaagagagagaaaggtaatagcgggatatgaactggggtttgagccaccatcctaacacttactagtttaattgtcttttgcaagttacttctttaagtcgtgtgtaattcaactgaaagtggagattttaagagtgtttatctcatacatttcaggaaagattaggtgaaataatccatgtaaagcccttaatgtagtgtctgtcacatagtaaattttcagtagatgttagtttttattgttctaatgttatagatatcacgtactatattatacaacatggattcatatatttcacttaataatcattagtaatggatgggtgattcatttacatcaaaagggtcaaaataaaaaataaattctcagagagttaagctttttttggcaaagaataagaaaccagtatgttgcagtattttagaaatatgaggaattcagtattagtaaaacttactatgggctgggcgcagtggctcatgcctgtaatcccagcactttgggaggctgacgcgggcggatcactaggtcaggagatcgagaccatcctggctaacatggtgaaaccccgtctctactaaaaatacaaaaaattagccaggcgtggtggcgggcgcctgtagtcccagctacttgggaggctgaggcaggagaatggcgtgaacccgggaggcggagcttgcagtgagccgagatagcccactgcactccagtctgggagacagcaagactccgtctcaaagaaacaaacaaacaacaacaacaaaaaaacttactatgaaatatggacacctgttttaaaaatgcattacaaatatctgtttcagtctttgcacctaatatgtataagatatatataactgaatttgaggatgttgtgtggaaaatattacttaacaagttattatttaatatacatatataaagaatcccaaacagatctacataaggaaaaaaattacagtatagatttctaaattaattgccagaacaatggcccccttttttgaatttctctggcatcttcagtagggaaggaagtgagtagtatctcattctccagtcaactcatgaacacccaggggcttgtctctcaaggcagtgggaacctcctcctggtgtacctcaggtctttgaggtaatgatctgcagcttctggcctttctctcaataaggcccaggtggtctggggaaatatgtcttgcttgttggtctcttgctctttttctctgtcttctctgctcactttttctatttccttccgcttggtgatagataaaataaatttcaaatgtattttgatatgtactgcttttcaccaggttcctagtaaattaatgtgctcatataggccaatccagatatcttaaaagatcactggatgtgcacccagaccacagtagatcacagttaggcctccagcatggtctgacctgttcagaataaagaggcctttggttgagggtgagccttatacagactggttctttgtgtgcctgtgatcattggagagtctaaattgagattctccctttcccacttaggattgaggcatcttgttttaaggccatatggcagatgttaataaccaacagacttcatgggttatacctcaaactttataagcaaagattactaactgaatgaagcatgcattctattctattcactctgcaagtgttagaatttattggcctctcctgttggcaaagatcacacttttggttgagctctatcttggctactgcttttctagagctgcaatctggcagtttgggaggctgcatatggctcttaaacactgtttggcacatagagtattttaaggttttttgcttttgtttttgttttttgacacctttagcagaggcaggcaatctacagttcccttcatgtcctcttattatttgtaagactcttctttcacgtttattttccctgcctggcttacataggcataaaagttttgatcttttgaactagataatgcacatattgcaagtttcatgataatattctgtagaaaatgaagtgattttccagtgagactgagaggcatatttaaaatactttaatttatggaagagttaatatgttacaaatttggccattaaaattgtatatcatataacatagttacattttattatagatatgtttttagtaaataacaaaaatattctcactgttaaaaattatttatacattcatgttcattttgtgtattagcagaactgaaagttttgttttttgattttgtttttaacaagatcacttatattcaattcataaaataattttaattctgattattgttcttctccctttgaaggagttttgcatttcttctaagagtcagtttaagaatagtttgtatttatcattttaatgtttgcagtaaaatagagccaaagaagatatctatttcattcaattaaatgttatttcaaagacagcagggttctatgttggtaaaaatatttatctgtagttttaaaaattatttcataagactaactagattttcattagactccttaaagtgataattttacactagaatgttttatgttcaatcttagtttcttaaagtctgtaaacaccctaggaaattacattatttcacaaaaggatatgttctggaagtgttttcctgagcttgtaagtaatatcagaaagctgtaccatatgaaactgaactatcaataagttcttaataacatatttttaaggttaaaatatctgtgttattcttatagggctgctgcacatccttcttagcttcctattccatataaatttccctttttttttgacacagagtttcactcttgtcgtccaggctggagtgcaatgctgcaatcttggctcactgcaacctccccctcccaggttcaagtgattctcctgcctcaacctcccgagtagctgggattacagacatgcaccaccacacccagctaactttgtattttttttagtagagatggggtttctccatgttggtcaggatggcctcgaactcccaacctcaggtgatctgcctgccttggcctcccaaagtgctgggattacaggcgtaagccaccgcgcccagccaaatttccctcttttctaatgttgattttactcaatcatgaacatgtttatgcccccaaagtatattcatatatatgaaaaagtataagacagggattttgatttaaaattcagtctttcaaaatcttttcttggtctgattcagtcacaatttagtttttaactttactaaaagcagtaagcttctcacacctactcttcccactctcatcccacttgtcagatgaaatcatcatgcatcgattttgtaaaacttcttttcttccacactgttttcttcattatacaaaataaaattgcattctgagttgatggagaagcatgatatggtaagcgttgtaggcttagatagttcatttttatcactaactgatgtcttatcacctaaattgtgacaatttatgctttctaagaagatgatttactacaattatgaaaaatgttaagtttggaagatgcctacaggcaattcgaaataagctctgtgataacaaaaatactcatattaatttaaaaactttgaatattctttctctttaattgatcacaaacattctaatttcctgaaataattccaggtcagtttcctactttccccttctttgtcttagtctccaaaaagctatgttttgggaaacatttattttagtctcttttctatttagtgaattatgctgaaattacagagaaatatattctactatataactatattgcatttaatttttattatagcatgttatttttgcaccaggtatagctgttaatcaggcatttcagttaaaaaaattcattgaaattagaaacaaaatcagctgagttacatgagtcattatctgatattattgaaccacaaaaaagcctaagtaaactgaaaaattgaggagttgcagttcttcacaattctaatgttctcttaaatactgtcctaaccattaaacaacattctagttgaggcttaactacatataaatcggtttgagtcgtgatctgtgtttaaagatactctgtcttagaaagtgtataacacgtttctaaattaactgaatcaaaataatgtgtttaaaaaataagcaggcacaatttttgaagtaacagatgaacgaaatgcatttattaattttttgagatttaaaaagttttactcaacctttgtaattttgaaagctatgctaatcattcttcacagtcagtggtatctgaacatgtcattatctctttcagtttcattattttttattgcaaagctatttgtttatttgtagagtttctgtgtctcaaaaagtggtggtttaaagaaattaatatgtgtaatattaatatagatactttatagtaaaatacaattaaaatgtgaagaaataagagaaaagtatgcagaaaatatgataaaaccataaaaatacatgttgggttcctgttttcctggcatgaaagagaactctaacttctttcgatactgagacctgagaaatctcccctagagaacagaaggaagttgtgagggatgtagcagatcacatccttagcaccacttttataaatagagtagcgtggtttaatttggatgttccttaataattctctcaatagaagccagggctacaactgaaaagggcaattctacaaaagaaattcaacttagagataatacagttatggtcatagtgtactattatttggttccttgcttgattttgttttaaaatataacatactcttcaaagagcccttcaaggatgttatgtctcactcaaatgtttgatatgaggttgcccaacaggaagtttgagatatgcatattctctggtgagaacccagagtgtggctattgtattgttgattaacggcagatctatagttatgctttgctaatcaagaggagggtagacattaaatataccaaccacaaatggaggaaaccaactaggtaaggacaggatggccccccaaaccgcggagcacagaagaggttcagagaattctaaacagcttgggttagaaatgtggtcacctagctactgagatgattatttaaaaggtctgcttttataataataatttaattttaaggtaaaactttcatgtaaaaattaaaaaatggaaaaatcggcatttttattaaaactgtattttaataatctgataacccattgtacagaaataatgttatatgaagtaaggatatttaatatacgtgagtatctcataaaatatgaaaaaatatggtgttaaaataaattgaaaatgttctgccttagaattcagtcatttcacatcttatgtagctaaatgattttatttgctcaaatgtatttattgagcagtttttatcagcagtaaacaacacacatgccttccttgtcttcatggagtgcataagaaggaggagtcaggcttcctactgatctcttggtttcaaatctaatatagagttgggtttctcatctctgacatccttctaaattgtttttttttcattgtaggtcatgaaatatctctagttgggtccaactttggtacctctctcagaactaggacgaaattattcttatttgagttttcttaagtaagcctcttcttttgtttatatatctatcccttgaagaggagaaaaataaagacatttttagtaattttcttgtatattaatatattttatgcctgttgaatcacacaaataactaggactttgtattttaagtttagcactagattacctggcttcttactctagttttgccattcactagctgtgtggccttacacaagttatttgacctctctgtgcctttgtttcctcatctgtctacaatgggtcagccctcatatctgaggtgcattgtttctaagacccccatggatactaaaatctatggatgctaaagttccttatataaaatggtgtagaacaataggccttccatatcttttgatgtggatgttattacaacagagagcctgttgtaataacagtgcttactcactagagctgttatgaagattaaacgagtcaatgcaaatagcagcattcagagtaatgtctcacagtgttaagcattctacaactactagctatttttgcagaagaaaggcatgaaatagtgccaacttcacagagctgttgtgaggcataaaaaggtcagtgtattagaagcccttagaataatgcttgccacacaataaactctgcataaaggttaactattattactattttccagcttataatgtttatattatttgttcccctcgtgggagtgggataatgttgattggataggttttcattgctatttatttttgtatggtgggctttgctgtaatagggaaggtgttcattcagagtggttcctgacagcgcaatagaattttcaatggactttgaaaaaattctgatgctggaccccacccttcatccgttatgtcaaaatctcttacaggtgaggcctgcagcatggatagtgtttaaaacttctcaggtgaccctaatttggcttcagggtttcgaccactgtgtaaatttgtttttatcaattttccatattcaaatatcaagtctattttaatcaaactaactatttgttaaaagttagttttgctttgttttccttttggggaatcacaggagagtaatgaacacttctgcatttctgttcttgtctggcctgttactcgtctattccaaagaactaatcattggactttaagccatcactgacaactctatgttttctcacgatctgattttcatggttcatatattaattacccttttcttaaaaaatatccaaggtggattttaaaacattctcataaagatatgttttcactgtacaaggcttaaggtttatagttgtgtttatttattatatctcagtaatacgtaataagagagttcttatgagtggaatgtctacattggctcgattgctttaacattgacttaaataatttgatctctgatggacgaaggtatcagaactacatgtgtgattaaataataactttttagattttttaaaagcttaaatgggtaattttgattctatgccatcactctcaacaaatagttttgagcccactgctataggtgactgctatgatggcggaaagtacaggatacacaggagtttaagggaagaaatgcccgaggagagcaggaaaatgcctcctccaaactggaagtaacacataggggcaatgccaggtgagtggggatgcatgggcaggcaaagatggaagaatagtacactggataatgtgtttggttccagcatatgtacaggtgggagatgtgaggcccaaaagctgtagttagaatccaattgtgaaaggctttttatgtaatattcaaaggtttagatcatacattgtagatcagtgattctcttttaaaaaaaaaaaaaaattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgccgtgagccgagattgcgccactgcagtccgcagtccggcctgggcgacagagcgagactccgtctcaaaaaaaaaaaaaaaaaaaaaaaatttattctgctaatatatttttttagaaggtaaaatcatgattcttgcaaaaatatacacattgaaggtcttatttatttcatcaattaataaagaaataatgctaccaactgttcagagaagaacccaaagacagttacacatatcagtattacagaatgctgggataaatgtgcaaatagatgcaaaggtaggaaaactgttaatatctataagatgttgtcaactaatcagttgcactcagtggacatagttggtgtattagtcttttctcacactgctgatagagagatacatgagactgggtaaattataaagaaaaagaggtttaatggactcacagttccacgtggctggggaggcctcacaatcatggcagaaggcgaaaggcacatcttacatagcagcaggcaagagagagaatgagaaccaagtgaaaggggtttccccatgtaaaaccatcagatcttgtgagacttattcactaccatgagaacagtatgagggaaacggccccatgattcagttatctcccccgggtcccttccacaacacgtgggaattataggagctacaattcaatatgagatttgggtggggacacagccaaaccatatcagttggcattctgtcaatgacactgatttgtataactataataaaacatttttattcttattatatattaacaagttatagttgtatatgtatgtataaggtaaaaagtggtataatgattttttatacagtgtggagtgattaaatcaagctaattaacctattcatcacctcaaatatttgacaattttttctgaagagaacattcaagatttactcttagttatgttgaaatgtacagtattcaattattaaccatgtttaccatgctgtgcaacagattcaattaaaaaaacaaactttttctatctaattgaggctttttaatctttgattgtcatccccctatttaccccacctgaagtccctggtaaccaccattctactctccatctatgagttcatttgctttagattccatgtagaagtgaggacatgtggtacagtggtcctccactaatccacaaggaataggtttctttttttgtttgtttgctttttgttttgagacagagtcttactctgtcaccgaggctgtagtgcactggtgcacgatcttggcttactgcaacctccgcctcccaagttcaagctattctcctgcctcagcctcctgagtagctaagattacagacatgcgccactacatctgactaatttttgtatttttggtagagatgggattttgccatgttggccagactggtcttgagctcctgatctcgtgatccacccaccttggcctctcaaagtgctgggattacaggtgtgagctaccatgcccagccaaggaattggtttcaagacccctggtggatgcctgaaaccctctgtagtacagaacccagttaccatcagttggaacacatttctcattgtcttctatccataaatttaacgcccttctgttataactaagcacttatcacacactgtggttgtaacttttacagtttgaagtgtatcagtaaagctagcactaatttctttctctttctttgtaatttcatggatagaagtgtcattcttacattagaccttagcaaccccaccataagatttttttttttcttttttatttaagactgtgtttcactctgtcacccaggctggaatgcagtggtacaatcacgaccctctgcagcctcgacttcctgggctcaggtgatcctccaacttcagcctcctgagcagctgagactgcaggcatgcaccgccatgcccatctaacttttttatttttttgtagtgacgtggttttgccacgttatccaggctgatctccaactcctgagctcaagtgatctgcctgcattggcttcccaaagtgttaagattataggcgtgaaccatcgtgcatagccgattttttttcttaagtccagaactttcaccttttcactcctaggagacattatatggcttctctttggcataccaaaattgccagcatcgctactcttgcactttggggccgttattaagtaaaacatgtactatgcacaagcactatgataccttgacacaagcattatgataccttgagcacaagcactatgataccttgacagtcagtctgagaatcgaggtggctactgagtgaccaccaggcaggtagcatctatagcagggatccactagataaagagacgactcatgtcctgggcaggatggaacaagatgactcaagattttatcactctatcagaacagtgtgcaatttaaaacatataatttgtgtatttctagaatttttcatttaatatttttggaccagagatgagtacaggtaactgaaaccctccacagaaagtgaaatggtggattagggaggactactgtatttgtctttttgtgcttgcttattacattagcataacgttctccaattccatccatgttgtcacagatgagagaatttcttctatttttactttaaaacatttttatttttaatttgtatggtatgtgttgtatatatttatacagtgcatgtgattttttgatacaggcatacaatgcctatatcaattcagggtaattgggatatctgtcatctcaggccttttatcatttctttgtgttaggaacatcccaatgtcactgtttcggttattttaaaatatacgatgaactattttcatctatagtcaccctattgtgctaccaaatactagatcttactcattctatctaactgtatttttgtacccattaaccattcccactttaacacactctacccacccccagcctctggcaaccatcattctactccccgtcttcatgagttgttgttttaattcccacatgagtgagaacatgtgaagtttgtctttctgtatctggctcatttcacttaacataatgccctcttgttctatccgtgttgttgcaaatgacgggatttcattcttgtttatggctgaacagtactccattgcatacatgtagcacattttctttatctgttcatccactgatggatacttaggttgatcccatatcttggctattgtgggtaattccgtaataaacatgggtgtgcaaatatctcttcaatgtactgataacattctcctttggatatataccccaaagtgaaaatgctggaacatgtggtagttctatttttattttggggggagcccccatattgtttttcataatggctattctaatttacattcccaccaaaagtgtacaagggttcccttttctccacattctcaccaacacttgttatttttgatcttttcataatagtcactctaacaggcatgaggtgatagctcattgttgttttaatttacatttccctgatgattagtgatgtctaacttttttttttcatgtatctgttagccatttatatgtcttttcaaaaatgtcaattcaggtcttttgcccatttcttaatcatattatttgttttctttctgtagaattgtttgaattccttatatattttggttatcaatctcttactagatatgtggtttacaatcattttctcccattgtataggttgtttctttacactgttagctgtttcctttgttgtgcagtgatcagttgttcttagaattacctggagtgatataatttgtctagagccgtgcccatgcatagtattgttgaaaatctttctggatgattctaatgagcagtcatgttggaaaatcagttctgtagataatggggagctttgaagagttctgagtaggtgagcaccgtgatcagattacctcttgatggctggagcatagaaggatgtattggaggtttttgttcttagagattgtgacaattgacagctatttccccagacccagtgagagatgaattttaagtcatagtggaaatggaagtgaggagatggacttaagagctaaggaggagagagaatttgcagaactagtgattgattagagatgtaggagtgggatgtgggaatttttaagatgatgcctaggtttggatttggatgataataatattcctagagatagggtataagagaagaaaaagaaaaaaaataatattcctagagatagggtataagataggtggttgttgtgtttgagccattgggagagggtgaagaggagtgagttttgctttgtgaacatcgagtttcattcattattcatttactcaacaaatacttatcgagcatctaatatgccaggcactgttccaagtgctggagttgtagcagtcaaaaaaaatagacaaacttccctaacttattttataatgggaaagacaaaatataagcaggggaaatgaatgcagggtggtaggtgtgcagttatgaatagggtggttagatggacctcactgagaagatgatatttaagctatgcagatgtctgagggagaagcttttctgcaggaaagagtaggtggacaagtccccttggaaacacaattggcagatcaagaactaggcagaaggcaagggaaactagaattgaagaaggcactttgggacagtagtaaaacgggatgagagaggaaaaaacatgggatatgagggcagatatcatgtatggctttgcagccctttgtgaaaactttttagtagaaaagtaaggatcatctagctgaataactttcccagattaggcaggcaggggtacaaatccattgtgagtattatcagactgcataaatgtatttgttttaagtaaattatattcatgggtaaagtagttaatatttaaaattaaaaaataaattgtatcacagccatagaattaaaaagtttaatttaagatttgatttattaaacttagtaatttgtttgaaaattatataaaatttaagttctatttagtgatttgaactaaatcactaatataaaatggttcaaacactaaaaagcataaaaatacatataatgaaaaatcaatttctgttctctatcttcctagagagcttcccccaaccccctactaaccactcttttttatatttccatagtttctctcaaacattagacaacttgatacatatgttacctcctctgccctcaatttttgtttatctcaagaggtgacatattactcaacattgttctgaatgcttttaaaattagaattaacggccgagcgcagtggctcatgcctgtaatcccagcactttgggaggccgaggcaggcggatcacgagatcaagagaccaagaccatcctggccaacatgatgaaaccctgtctctactaaaaatacaagcattagccaggcatggtggcatgtgcctgtagtcccagctgctcgggaggctgaagcacaagaattgcttgaacctgggaggcagaggttgcagtgagccgagatcatgccactgcactccatcctggtgacagagtgagactccctctaaaaaaaaaaaaaaaaaatagaattaactttctgtagttattcttatgccagtacctagatatcatctttattctttttttttactttaatgctgcctagcatttcaaaccaattgaattattgttttaagagaagtgcatgcacttctatgagagcaagaggaaaatgcactgcatagcatcctccaattaacacacaaattcccagcctttttagactactaaaaaaatttttaaaagaggagcaaattcctcaaataatgattatccctctttaatatgtctcatttgtttattctacatttactgagtatgtcttggaaaacacatactttgctgagtggtgggataggtgagttctctgtccttgtggaatttatattttcatggagggagataaaaaataagtaaacaaatagatgatcacaaactctgagaagaaatgagctatattatgcaggaaagattaaatgcggaggccacttcagagtatttcaccagggaaggcttctgggaataggtgacatttgagcccagaagtaaagcataagaatgaacctgggaagagttgaatatctagactaaggccttactgagatgtgtgtagaattggttatgggctaatgtggttgatatataaacattcagggagaaatgacatgagagtaaggttccagagaggcaggagccagatgatggaagagaagtttagtaagagaaatgggaaggcttgaaagattttaaacagctgaatgatctgccttatttataacttcatgttctttttaaaattttatttttcagttgacaaataaaaattgcaaatttctgtggtgtacaacgtggttttgatatatgtatacattatggaatggctgaatcaagctaattagcatgcgttaccttgcatactcatcatatttttgtggtgagaacacttaaaatctactattttagttgttttcaagtatacagtatattattattaactataataatcacaacgtacaatagctgtcttgaacttatttctcctatctaactgaaattttctatcctttgatcaaaatctcccaattttccattccccaacctctggtaaacaccattctactctctgcttctatgagttcaccatttatatttttttaaagaaatgcttagtgtgatctgaaagggagaaattgtaatattaaaacacgttttaggtattcttgaatatttcttatactaatgtgtgtgtatatatgtgtgtgtgcatgtatatatatatgcatttatataaagcatttatcactgcatgagattgtgagggcagttatggatattctttattattaaatggccagtaagaggataatggacatataggataataaatctccagttgtaaatttgagtttctgtgtattttatgtgatttaccagcccttgaatgcaatatattctgtcattgagagtttctgaattaggattacaaaacaaatttggggccattaaagcatatagcatggaacttgatcacacattattatttggtcacgaaccaaagttctttttatttcccttgaaaattcagtttagatggccaacttattgattatttacatgatattatttgtcaagcccacaggttatttttgtaatacagaatcatttaataaagtttccatctgaaatgtctttattttggtgtgccaaatctcttaagatatgtgtcttattttgtgtaactggagtttagatttatgaacatatagttttattttgtgtcttaattgagttgtaggtacttctactgtaaacagactgagagcagcataaccttggattaatttaaaatataaatccatgatcattgattttccacccatataattggttatgttaagattcatgtgattcccctacggttgtttaaaattctgcatttctcatatttgaccttcatcttgttttggtttccctttttttttaaataatcttaatgatttatgcagttgtggtaaatcaaattttagcaagaatgtcttctgactttagaaagtctatagaaacatttaccataatcaaataacttttgttattgagcgtttgctcttctgatgacatattttatagttttgtttgtgttttttccattggttataagcatatagttgataaatactcttgttggtatacatatttgttacataatatttatatattcaattcactaacttctgcatgtcgattgtctaacacctggtcaagtgtataaataattttaaatttattgaaattgatctgttgttttatttaaagagcatttaacagtataccacaaattggttttgttgaaacctaggcgacctaatgaatcatagtgtattaataataaaacaaacttacttgaaacaaacaataaatgtagatattttcatgaggtcctataaggccctgatttacgtaaattttagtattctgtttttttcttaactaagttctaatttttttaaatttcaactgaattttcattttatgttctttatgcctctaatatttctttgttttctggtcttcatattgttcagtgctatcagcaggttttattttgcctcaattcattttagaaatggttcattttctgttaaatactaccacattgctctggaattcttggacacattatgaatttcaattacatttttcttaaaaaaaacttttgacatttgtaacaaatggtcacaagaactaagttttgtgtttgggacattgtgtttgtagattaaaaaatcaacctacccaaaacccttaaaatatccaagcttgtaaaacttgaattgcatttgaattacaccaaatatccatttcatcaagtatgtcgtttgcagaattgattgaaacagttgatatcgagtgaaattgagttcatcaaatttggcagacaactgtaataattgaaggaaaatgtctgtgaatgattgaaggaaaatgcatttcgttgtatttcaggttttattgtatagtggcacatatcagtttcgtgtgtaaataagtaataatactgacaattcctggttatgtaaaacatttacacttgtattttttttaaagaaactgtattttcattttatttttttcccaaaagatttgtggttgaacacattacaggaacatttttttaaaggattggagtggttaatccctttcttgttttccatttctccatattagtgttaaattccagtttttgtgtgtgtgtgtgagtttataggatatgtagttgacctgaagcccccacaattcctaggaaaaatgaatcaagaatgataattttatgtgattcttattggccaattcatgtggttattaatcataaattttagaatagtagaaaattatgaaaatacatttttaaaacttttaagttcgggagtacatgtgcaagatgtgcatgtttgttgcataggtaaatgtgtgtcatgggggtttgttatacagattatttcatcacccaggtattaaacttggtattcatttgttatctttcctgatcctccctctccccaccccccaccctgtgaaaggctccagtactcaacttcactgatcattagagggagaaaataaattttttgttagttcatatttgtcattttttcagtagaatagaatttacatggcttggccaaattaatctagaactgtatctaatagtttttatttttaaataaaacaagtttttttatttaacagtttggtagataatgctggcatcattttgtacagctgctttgattagctttgtttcttttggatgctatatttacagttgaagtaaatttaggtgagtctctgcatcattttaacacttaaggtatcatgtaacttgtggaggaaatggcagttggaacaaagacttattgtagcataaaaaccagtatagatacctaactaaatgctgatctgtagctcggtgtggttctattaatttctaccttctttcattatagaattaaaactatgctaaacaagtctcaaatatctggtattttattatgctgctgatgaacaataatctaaatgaacatttctgagtgtataaaataatgatagtaataagcataaaattgatttatattgatatgtagctaaaacaatattgaccacatttatgtaccaagctgtgtactgggtgctttaacacagttttctgagctataaaggggattaagtgagttctttgccctatgccacaaatgagggaacaggctcagagaaatttaataacttgcccaagatcacactgctagagagttgttagggtcttgctttgagctctggcttattttatctcaaagactatatattcttctcacaatgttacactgaaattctgcttatgagttcaaagaatggcatttcatttttattttaaaactgcaatgtcagattggaatagacaagttcaagtatatataatataaggaaatgggaaagaaaagaggtaggtgacaaaggtcagacagtaaaggcccagaatgaactactgtcatccattttagcattctctctactagacagttggagctagagtcactttgttgttctaggagagatctgtgaggagtgaaagagatcaaaattgctacatttcttctagtccttagcatgtttacaggaaaaatatgtaagaataaagttttcattttcggtagaaacagaaaattgtatcttttactgtgcctcagggcaagaataaaaatataggctgtcagttttatttaatgtaattgtttttctttcagctatactatttaggaacaaagtgcacatgggacatgggcacacacatcacactagaatttcacttgatgggctgtattctgaaaactcatcattgtagtggaacatgttccttgttctggtgattagtgtaggttagaatgaagatttctcatttactgctcaaaaatatatacacatagtggaaatttctcaggaatagttaaatagcaaaaataaaaaaaaaccacaaactagctacaactttgttgaaatccttattgctccaggaatttttaacattagtgtttaataatttttaatttctaggagtgtcttttacatttctttatattgttagtaaatccttgtgaaaatctctatggataaatggggttattaccacctttattaaaattaccatagtaagcaagtttgtgttgaatttagccatatgcttagctgttgatagaatatgaaaatgatgatgctccagataatctctttagaaaggtacaactatttctcgagtttaaacaaaatgttaactcgtacagtaaaaatatcaggacatcagagtatacctgaatgaatgtattggaagtacttaccaggtataaaattctatgccttcgggcatggtggcttaagcaagcatggatggaatcttagcactttggaaggccgaggcaggcagatcacctgagatcaggagttgagaccatcctggccaacatagtgaaaccccatctctactaaaaatacaaaaattagccagacatggtggctcatgcctgtaatcccagctactcaggaggttgaggcaagagaatcatttgcacccaggatgcagaggttgcagtgagacaaggtctcgccaccgcactacagcctgagcagcagaaccagactctatctcaaaaaaaaaaaaaaaaagctatcccttattctaagcacataaccatttttcttgaagagtgtagctatggaaacaagatagccaagtaagaatatgagtcacatagaagctaacatggcattgataagttatacatagataagcaccatagatgtttaaaaggaggcatcactggcggggggggggtatgaagttttgcctggaggacttcatgataaactttccaagcatagagaaggaatgaaacaaggtgagctgcatatgatgccctgaggggaggacggtcaggctagtttcacctacatcaaagctgtagatgaggcagtcacagaaccaaaagaggaaacccgagacccttacccccataaggctgactgcatcagtgactacctaagagtcccagctgttgtcaaaaagccatgggaagactacagatgagatgacagccacagagggaccacgaaaagtatgaaggagaatactctcctactgctggggattgagcatctcttctaccctaccaattaaagtaacatcttagaattctgggaacacgtaggtaactaggttaatttcattttattttggaaacagctttatgcaaatttgtgtctggtgcacatcagtctttccatttcagtcggttttaaattgcctttgtctcagcctcctgattttattacagtctgcctatagtaacagttgtaaggtcatatatcatgctaactgaattttttttttgtcattttgaataatgcaccgaaaataactcctgtttagtgtggctttgaaaataatttaaaacatgtatatttgtgaaaaatatatccggcctacacatgtgtctccattcttatttgttagtgttgtcctacaaccatttgtgccatggacagactgacatcctcatcttgtttcatggatctcagctgattggaagggctgatttcttccagcgtagctctaaatgcgagcctattaaacacagccattatttaattattataattaaggaaatcattaagtgcttgataagttatacgtgggctttgaatagttctattttcttaaaattatattttactaaccttttaataaggaaagagatatttaccagctgaatgctatagatatttgatctatagatatttgaatagatgtgtataaagacattatacaagttattgtggcagttaataatgtattttactaaagagaacagaaaacttggccacagtggcttttgcttttcaattttccagatgtgtaggtgatgtataggtgatgtatagatatataggccgttactaaatgatgctgttagggtctcatacttttttgtctttttactctgccttttcttcaagtgttggcttttgttctcatgcatatagatttcagacactttttaagtatctaattctagttttaggtagggagggggaaaactgtttcctggcatggattttgtcttttctgcatggatgaaagtcctccccatggacttctccctaaattgtgtcatataaccaagtgtagctgcaaggcagataaattgagtatttacattctagctttcttagcagaagaagggaaaggagaaggatcttgggaagtggtgttgataaagctaatctactctgctagttagggttctctacagaaaaagaaataataggatgtatgaaaaaacatgtatttgtatgtaaacagtaaaaccatatatttgtatataaacaataaaaccatatgtaatgtaaaccataaaaccatatatatatatatatatatatatatatatatatatatatgtatatgagagttagctatctatcagagtctctgatagttttttttttaaggaattgattcacactgccatgggggctggcaagtttaaaatctgcaggacaggctgaaagatgggaaattctagcaggagttgatgttggggctcaagtataacggcagtctggaggtagaccatcttcttcttcttcaggaacctatctttccccttaagactttcaattgattggatgaggcctacatacaatatgatggagaatgagatttattcagagtccactgatttaaatgttaattatgtctttgaaaatacatttacagccacatctagacttgtgtttggcccaaaaattggacaccataactagccaaactgacacataaatttacccatcacacctatattatctacaaaggattaataataatcaatggtttataacttttggatactaaagtccagcatcaacttcttagggttgacatcttcttgatccatgtattagtttatgtatattaaatgcaataatgtttccgtgtttcccagaaagttcttatgctaattctgaattagagttaaaatattgactaatacccattttaaaaagagaaagtcttttttttttaaaggcatattgagaatttctaaggctcttactttgttttcaggcagtaaatgacttatataacaacattttaaccaataagattactcttgctcaaatggcctggagaacgttagaagaaataaaggaatgttgactggcctggaatgaggagacataggtttttatattaactccgacattagctagtttatcaccttgcttttctgaactgaagactgataatagatcccctacctttcctcccagattgtggcagttacatgagataacagatctaaaaaatgctttatgtagcatagagtgatacaaatatataaagcagcactggaatattgagataaatgtctcatgataacctcctccatgattggaggatggcatggctgatgagccatcaaacaaaggttagaactgaatgcagactcagaagtgacccggtgcaaactctgttagcctggatggccacaaagaaacatccattatccatccattaaaagtaaaattctgtggaaaggagggccatttctgtcagcttgaggaatattttgaaattagcatcaggttgtcaggcttagtcagcatgacagctctttcaattcatgtttgtccaacccctttccttggaaatacacaagcagttactctgctaatgttgggaaaaatccaatgtaaaaaatatttcattttaataacaaatttctaaatctgaatattatatttaaaatactaaataaagaagggtgtaacagaagtgtttacttgatgtatttatttttaagaagatcttttagtcaaagtaatgttagctaagttaattttacttgtgtacagaatcattaggtaccactaaaagtcattgacagttttttaattcagtgagacttactcaatcagcaaaacttccaaaaatagttgataataagtatacccctggaatgggatttatataaccctacactcatttaacattatctctaaattcttttgtataattctattctttcatgtaattttttcatataattctaaattatttcatataattctaattctaattggatgaattttttagaagttgtacctagcatttaatttctttaaagatagtaattttgaaactcttgaacaccagctgttaacactttttcttgatgttcatgtgaaatggacacttaaaatttcagtgttggtttcaagttttcagtgttgcttatgcataacctatcctttgacctaacaatgccacttttagttatttatcctaaggaaactagagatgattttagatttgtgtgaaatgatatttattatgtgaggcaacctagacaatagatggaaatggttaataaactactgtgcatttgtattgtaaaatttcagacaaaattataaaaaatgatctcaatatttattatatgaaatagaaaaatgcttatgacataatatgtgaaaagaatgagataaaatataattcaaatcattatctttatttaagatatacattacaatataattagggctgtgggggcactaccttgaactctcctatatttgatcagattatgttaatatgtataatggtgtggttgccctgtttactgcaatttaaagtgctttttttttaatgtgagaaaatgaaaaataaacaaacatagtggttttattgccagttgataggcatagagtaaatatagaagaaatcatttgaatttaatgcagtttatcctatgttgttcagtagtgtagttctgtgattatgatagcctattaggaaggtaactggagcagcagtctgtagcaggttctggaggagtaagtctggatttgaaaaggttaggaggaagcttttgtttgtctgtcaggatagtctcttcatttgcactggcatgtgaaaataaggctgagtactggtcctggatagtgctggtaattaaacatagataccccatattttgttttccaaaaataatgctgacatatttttatttccaatagcggtctgttgtgaataagatttgggaaaagagaagggaagcaatgagaaaacaggttgctttattaaaaggcgtaggtctcactgagagggactttgcagagtaaaatcctacaaacttaggaacacttagtctaaatttggcactccgaaatgcagaaagaaattcttgctcaaatagaaactctacactcacattaaatgaatcaaaacgagagctaggttatcaaagaaagacaaactacttaaaagagctattttaattgccatacaagaaggacatttctcgtaaagataaacaaaatttccttagttacatcatgttttctcttggtagttatctctcattattgtgagaaaattttaagaattcaaattcacatttctgaggtaaacattctgaaattttattttgttttgagcagtccctttagtgtttaaataacctctctttctgatcacaaacatggaagaggtttctttgttacgtatcatcttttgtcctagtagtcacatatacgtgaaatatgaaataagaagatcaaagacgttttttgtttaattttggcagtctatatttttactctgtgtccctaaattagagtcgctacagggccttacctcagaacactcatgttcttctgccaaataaataaggacagacatcactcttgaggcctttattagtcatcccttagaaaggttggttcttgacaatgtatcatttagacaaaatattcatctagcacagtttgtattttcagggcgtattcatccacaacagggataacaaatagttgcataaggggagttattcacaaattgaagtgcttgaacaaaaaggaagaatagatggaacagaaaccccaaaattgttccacttagaaatgagatgtggctactctttgattcatcttgtaccaaattctgagtcaatcacatggaaatattgcattttaaaataagtgttacagcacaacatttacagctctcaagctctaaactgaagctgccacatgtcaagtgttgacttgtatggctcataaatcaccagctgttgtttagacagtatccatcttcaaagtttgtacagcaaaggggtctattcaatgcatttttaaatcaaatttctgcagaggagttttggacgagacagatctgggaactacactgagaacaacctcttagttgttgattcaaacacacttttggcaaaatttaactcgggctgaaaaaaaatctgaatttcaaagctgtagtaaagtactgattaaatggtaatctatatttatagtgttttaaacctttaattaatacacatgtccttatgtaaaagtttggggaacttgaaagactttatgaaattcattggaggataaaaagaaataacacttctaaatcaaagtcagatttggagaaaactaatttgcctctaattcacttttgtttcaatgtatcctataaaataaaggccaagcaattttgcgtggcatgttaggattcttggttgaaagcaaaaggaacacctctggttaatttatatagaagggaattttttttaaaaaggatcttgtgcaattcacagaatcctcacatagcctaagaaacagattgagttctaggctgacagcgacagggcctagagttttgggtcagcccctatctagtgtgatgtcaagtgccactgcaagggcactcaccagaccttagtcaccaggcactgaccctggaaacattttccctccttgctgcttcagtggtcaccacttttgcagggaaggagcctgcactatatttgtttctccatgtcaccagcttgctgggcagctgggtctgatgtggagatcccaggctagatttctgcaccatagctgtaaggaaggttgtgaacatgactatgtttcatttttattgtttctttgagagacataagatagggatcttgtatagggcattccccatgtaagaatggggtatagacgatgacagtacagaaaaatattaaaacatatatggtatacaaggtcttaaactaccattcccattcatgttgccctgcattctggccataggctcctcatcatccctttggcattccttatacttttctgacactgtggtgctgctcatgttattcccttgatctggaatgctctcctgctccatttatatagactttccttcaaggggtatcttaaagctccaccaagtcttcctcttttccctaggtagaagaattagcttccttcatttggagttctctctctttctcactctcgttctctttttggtttctgtctcatccacttgaaggtaaactcttccaaatgagacactatatttgtccattctcatactgctgtaaagacatacctgaagctgggtaatttataaagagaagaggtttaattggttcatggttatgtgggctgtacaggcttctgcttctgcagagccctcaggaaactttatggtggaaggtgaaggggaagcaggcacatcttcacatggctggcaagagagacagggagctaaggaacaagtgctacacactttgaaacaaccagatcccatgagaactatatcaggagacagcaagggggaagtccactcccatcattcaatcacctcccaccaagcccctcctccaacactggaaattacaattcaacatgagatatgggtagagacacagagccaaaccatattattctgtccctggaccctcccaagtctcatgtccttctcacattttaaaacacaataatgcctcctcaacagtccctgaaagtcttaactcactccagcattaactcaaaagtccaagtccaatgtctcatctgagacaaggcaagtcccttctacctatgagcctgaaaaaaaaaaatagtcacttctaagatatattgggggtacaggcattaggtaaatgctcctattccaaatgagagtaattggccaaaacaaaggggctacaggccccatgcaagtctacaacccagcagggcagttattaaatctcaaagctccataataatctcctttaactccatgtctcacatccaggctacactgatgcaagggttgggctcccaaggccttgggaagctctacccttgtggctatgcagggtacagcctccacaactgctttcacaggctggtgtatgggggctccaacctcacatttcccctcttcacttccctagtcgaggttttccatgaaggctccacccctgcagcaaacctctgcctgaacatccaggcatctccataatcctctgaaatctaggtggaggctcccaagcctcaactcttgccctctgtgcacccagaggcttaacaccatgtggaagccaccaaacgtggggcttgtaccctccaaagcaacagcccaagctgtacgttggtcccttttagccatggctagagctggagcagccacaatgccaggagccctgtcccaaggctgcatagagtaagggggcctatgaaaccattcttccgccctgggcctccaggcctgtgatgggaggggctgctgggaaggtctctgaaatgcctttgaggcattttcccaattatcctggctactaacattcagttcatgtttacttatgcaaatttctacatccaacttgaatttctccccagaaaatgagtttttcttttgtgctacatgcctgggctgtagatttttcaaacttttatgctttgcttcccttttaaatatagttccagtttcagataatctctttgttcatgcatatgagcatatgcggttagaagcagccaggccacatcgtgaacactctgctgtgtagaaatttcttctgccagatatcctaaattttctctctcaagttcaaagttccacagctatctagagtaggggcacaatgtcaccagtctctttgctaaagcataacaagtgtgacctttgctctagttcccaatgagtttctcatctccatctgagacctccgcagactgggcttcgttgtccatatcactatcagcatttgatcacaataatttaacacgtctctaggaagttccaaactttctctcattttctcatcttcttctgagccctgcagcctgttccagcctctgcccatggctcagttccaaagttgcttccaattttcaggtatctttatagcaatgctccaatactctggtaccaattttctgtattagtccattctcacactgctataaacacataactgagactgggtaatttatgaagaaaagaggttttattggctcacagttctgctggctgtacaggcttctgctcttggggagccctcaggaaacttacaatcatgccagaagcttacagggaagtaggcataccttctcatgctgtcaggaaagagagagagtgaacagggaagtgctacacactttgaaataatcagattttatgagaactctatctggagacagcaagggagaagtctgtctccccaacccccgattcagtcacctcctaccaggcccctcctccaacactggggattgcagttcaacatgagatttggatggggacacagagccaaaccatatcagatgccatactttaatcattctgtggagctttaagtcataatgaagattaggctgtattcactcttgtcaaaagaatttttaatatgaccctttaaaacttgaattttgtaatatttgtataggattttaccttttcatttatttccttcaagtgccatttcacatagagcctcaggtactatgttttatgtataatttgaaaaataaaataaacttagaaattacatactttggatttttctctccaaataagaaatgaaaacctagaatatggaaagtcttgtctatctgaatgatgctttgaattaatgtgatatagtgaactttatttcagtgagtctgaatttacatttggaatatgaataatcttcacttatgttgaaaatgataggctgaaaataaacgtgctcatagctttttcatgcagatcctttactatcaattaacataggaaatctttataagtgctgcttaaagtttagatgataacttaaagtctgaggatataaagacataatgatcagacatatctcaaaattctgattattcaatctcatattgtattgggagatattcccattcactagggaacattgtatgttatctgagttataggactgtttaaacagtatgatttccatatattatattagattttaagagtgattatgctgatcaaattataacaccgttgaaaaaattctttagaggcttgtcattaaatagaaatgttctaaattcctttttccagtttggattatcttcacccctgaaaatatgaggacacatattctcattgcctacatacaccatgcagtgtctctacacagagtataagaaatttaaacctattatctagatctaaggggatatgagcaggcatctacctagattttcttaaaaaaaaacaactgaattctttgtttactacctatatgagttgaaattctgattattgagttaagatgtgatgaatcttttgattcttgttaactgaactcattctcaggatttgtagtgatgacttacatgtgaatcagaaattaaagtttttcaaaagagtaattaccaaaattatatcattatattgttgtacaagtattgtttttaggaatataacctgtagatgctatgttaacctttaaaagataggctgagaacaaatctacacattagtaatttaatgtagattcctaaatatgtaaaaatatgctttttacattttggaaaattacataaaattgaccttttccctctttttataaactctgattttaaaatttcactattataaaaaatactgcagagcctatctttatgcatgtgtgtgtgtgagtgtgtgtgtgtatgccgatgtatgtatatatagtatatacaggtgtatagatctgtgtgagagtatattcatgtgtgtagactttatatatacatatatatatgttttttcactttcaggataatattcaataaattacatgagatattcaacacttcattataaaataagcattgtgttagatgattttgcccaactgcaggctaatgtaagtgttctggacgcattgaaggtagactatgctaagctatgatgttcagtaggcacggtggctcatgcctattatcccagcactttgggaggctgagatggaaggattacttgaagccaggagtttgaaacctatctggacaacataggtagagcctgtctctacaaaaaaaatacaaaaattagccgagcatggtagcacagagctgtgatcccatgtggtcccagctattccggaggctgaagtgagaggattgcatgagcccagaggtcactgcagcccaggctgggtgacagagaaagatcctgtcttaataaattaataaataaataaatgcagttttagcttataatgttttcaatttatggtggatttattgggatgtaaccccatcataagtcaaggaacatccatatctttgtataaacacatgcacaacaaatgtattatttacgtaaatcaatatcaaaatcatagactctttattcattatattaaattatatgagacagggccatattatcattttttcaattagtaagtagctttaatggtagacagatttatgccagtgtcttaattatgatttttatatgatgtttcttggtataagtggaaatttcccaaagtggcgtatgcttttgataaagcaaagcccatttaaattttcatactatgaatactagcctatagaatccatctaacaagtgaagattaccagagagtgtctgtcaggggaaaaactttctcaaaccatgtttttcctctaatctcatactaccgcaacagtcaacacagaatactatgacaaaagcagcagacaccagctgggtgtcctctaattcagttctcatgctctctacttggaggtagtgtaagattgcatgggttggaagctcaatccccaagattaaccacacaccccagaaaccagtcaaaagtccagacctctggaacttctgaccaactggcttcaagctggggtccccacaaccccctctttggatttgattaatttgctagaatcgctcacagaactcagggaaatgtatttagtggtttattataaaggacactgcaaaggatacagataaagagatgcgtaggacaaggcataagaaacttctggaacccagtcctcttgggtttttatgggagcttcacagtgtcatcattccttcccccagggtatagggcaggactctggggaggatcataaaatctacaatcagaaaggtggggaaagattagagtcttgccttgggataggtgaaaggagggcaggagagagattctgcttcctgaagcctgtgacacccaacattgtatcaaaaaactataactagagcttttggagttatgagccaggaagcatggacaaaaaacagtatatagtaccacagtaacacttgtcaacactgtaagaacactaaatttgttttatttaaatgagttcattattttcttataaatgttgatccctaaaatttctattatatatttggagaattacattagtcaacttacataaaattaattttctttatatttttgaatatggattttatttagatgtaataacatcaaataattatctctaaattttcttcccaaaggaaatagtacagattagctagaatgaaagaagagatttatatttattgtaccagacaccctgcctaacatgatctatgttagcttgtttcatttttacaatagcctgagtgtatattttatctccgttttatagataatgaaactgcctcttaggggaggttacctaatatttctaaaagttttctgatttcaaagcctattatctttgcattctacctaaccagatcaaggagagagtgtacgctttggtttgaatgtttaaaactatgttttatttggtcatggatttggcagatagaatttacatttaatgttttcttcacttatgacatgttgcaagttgagtagttaatggatatatatgagaatagcttttattgactcatgtgtttatcctgccttcaaccaaaattcttctttagagtgttttcttggatgtaaaagagtgacatttgcattcgtatgggtctgaaagttttccacaaaagttatatatttttttatcttgatgataatgaaataatatatattggcacattgaacagattctgcatcgtttttatgatgccattataacagttttggcattcagtagtagtatgcatatttgtgtccattttttctttcatttgaactaaataggtctcttttcattatcatgagctaaggttaacagaagagagtcagactaatatggagctaatgcattagcaccaaatgaatattaaaatatcatcaatgcatactgtgagaaaggttttgcagtaattcagttactgaaaactgctggaggaattgatttatcaaatgttgatcaaaaaatcatgccgaactccaaagagcctgtgccattgtatgcaatactctaaataaattgcaaaacagcgattgtcatattaaattaatgctaaaattttcgtcagttcaaattttattggtttgccatgctggcatttaatttgtaaattaaatatgtgtagataaaactatattattattgtcagatataagctgacagattttgtaattagtgatatgtttgtagatatttaggtaatgtattaataatagccatttaaatcaacaatcatgatccttgagaattttttccctttaaacgtatttcgtacataaaatttcatgaagggtagattaggatattctaactactttgcagacaggtaccagatctaattcggagctgtagagaatagatgttttcaataaatttgtgaataattaagttttatcatccacatatagatagtattaaagagacagcttatacacatagattataatgatgagcatttacagcttttttggattaaatattaaatattgccataaaatttgaaaggcattaactggaaatctcaccaaattagataaatgctaggtgagttgcacaagctggggaacacacaagtgtgagtgttgtagtaaagttgaatggatgcccttctactattccatgctgcttctcttctgtaatggcagctcttttatggtttgtatcaaatttagagcttccacttggaaagtgatagttacagaactatcattttctcctgggcttcaatgctaagttgacaacatcccctcctgtggcgcttggccaagggccagctgaaattaatctgtaaaagagacagtgcctctgacataaaggtctccttacttcaacagagataagtgacccatctgaacatccatgagtttactggtaggtggaagaaggagggagaagactagttgttctagactggtaatgcaaggtatccagaaagagatcagttttcatttgcctaaacaggattacaagctgtgtgtagatggtcttataaattgcctgtgataaagtcactcatttgggacaattaacgaattttttttttttgagttggagtttcgctctgtcagttcaagtgattctcctgcctcagcctcctgagtagctcggattacaggcgaacaccaccacactcagctaatttttgtatttttggtagagacggggtttcagcatgttggtcaggctggtcttgaactcctggcctcatgatctgcccacctcggccttccaaagtgctgggattacaggtgtgagccaccgcgcccagcccagtgaacaaatttattattttgaactgttgaccacagatatattttaactatttaatttttagattaatatatttgaaaatgttacatgaaaacaaatttatagtgagtatagatgaaaattccaagtgctgtagttttacttccttttttattacaaaagtaatgcatgcttcttataaataacaaaacaatgcaaacaagtaaaagggataaagtaaatgtctcttttctctgtatatttcacaacgtatgtgttagtagcttagacaaacaaaaaataagtgagttttttgtttaaaaaaggaatgaaacagaaaggattgtcacttccttaacaaatgctgatatcatatgataattttagaacacttatattccaggctaagacatccattattttcttttcatttctttgaatttatctatgcaaattaactggattgggaattaaaatgagcctgtttgttgggccatttgtgctttagtaaaaacagatgtgtttaaacacctggttactgcaatattcaaagtttgtgaatcattctgaaggcttttgtaatctactgccctggatattgtagtgaagatggacattaggaaactctgtgggcaggaggaatgtggaacatggcacttgtgcctgttgggagaaaacaaaaattgctagtctgttcttttcagagtggccaaacatcccaagaaaagccacagaataaacatggcataacttcttgaagtatcagctttgcttaaagttgtgagagaaaaacattgtaatgaaataaataaggctatgttaagaaacaaaatcaaatacttaatttataaaatttttaaagttttaatataaaacaaaagaaattactcataaacattgactttatatatcaagtccctgagggtatgtgtctcatttccccttctgttaagggtactactttttgggcaaagttgagaaactgctatatgaggacttggggaaagaagagagaggggaaacttttggatttttccttcggacagtatggaaggagacagacgggtaggtaaaaattgaggatttctcacttattttttattccccacagtatttaggataataccttgcagatggtagggtggtagggcatataaaaatgtttgtgggatttttgattctgtttcttttcttatgaaggaaaaaaacatgcgttattgaacactagcttccaagttttgccaataaggtttataaaaagttttttaactggctgatacattcttttttctcttttttttattctgtagatgtgagctctgactcagagaaaaaagagagattttgagtaaagtgaacctataaaaatattattccaaccacaaaacttatttttaacaatcttcccacacttagctgtgacttgaatagcagcacagaagcacaactgcactaggtgaagtacagtgagggtgctgggcagaatttttcacctttctgaatattcttactttgttcaccagttatttcttttgtccttaggtatgtggcttgatgttaaatagtgcagttgaagaattttcttttttggaaaaaaataggcatttctagaaatttttatttctcatttcctagatgttttctaaagaatacttttaaggtcagattaggggatcttggaagtaagcacatttccaaaaaggatttctacatataaggaaattattagccaaaattaggccagggcaaaatttcagattatagtattagaaagtttaaaaagtataggttttaaacttaacaatccaaacacaatcataaatttaagcgactgttttgtttggattgaaattgtataagtattcatagataattttgttttaatctataatttccatacactaaaaaaactatagttactatgctatacattaggtctccaaaatttatttataactgaaggtttataccctttgaccagcatctcccccatttgccctgacacttgaaccctgataaccacgtttctgccatttctatgagtttgactcttttagattccacatataagtgcctttctgtgcctggcttatttctcttagcataatgtcctccaggttcatccatgttgttgcaaatggcaagatatcccccttttttaaggctaaataacatttcattgtatatacttgacacattttattcattcatttatccactaacagacacccaagccgtttatatatcttgcctattgtgaataatactacaatgaacatgcagatatctctagacatagtgatttaatttcccttggatacatacccagatgtgggattgctggatcatatggtagttgtatttttaattttatgaggaacctcctatattagtccgttctcacactgctaataaagacataactgagactgggtaatttataaacaaaagaggtttaattgactcacatttcagcatggctggggaggcctcaggaaacttacaatcatggtggaagggaagtaaacacgtttttcttcacttggcagcaggaaggagaagtgcccagtgatagggggaaaagcccattataaagccatcagatctcataagaactcactatcatgagaacaacataaggataactgccctcatgattaaattacctcccaccctttccctcccacgacatatggggattatgggaactacaattcaagacgagatttgagcttggtgcagtggcccacaccagtaatcccagcactttgggaggctggggtgggtgattcacttgggcccaggagttcaagactagcctggccaacatggtgaaacccatctctactaaaaatacaaaaattagccgggtttggtggcgcatacctctaatcccagctacttgggaggctgagacataagaatcacttgaacctgagaggtggaggctgcagtgagccgagagtgcaccactgcactccagcctgagcacatagcgagactccatctcaaaaaaaaaaaacaaaacgaaacaaaaaaaatgagatttgggtgggggcacagccaaactatatcaagtccatgctgttttctatattggctgtaccaatttacattctttctatcagtataaatgttcctttttcttcatgtctttaccaacatgtatcttttgactttttgataatagccatcttaacaagtgcgaggtgaaatcttgtggttttgatttgcatttccctgaggattagtgatgttgaacaccttttaatatacctgttggctatttgtatgtcttctttgggaaaatatctatgttctttgcccatttcaaaaatcagattatttgtttttgggctattcagctatgtatgtttctcatatattgtgatactagccatttatcatataaattgtttgcaaatattttctccaattctataggttgccttttaattttcttgatggtgtcttctgctgtgctgctaaacaaaattgacaaaactgaactagactaagaaaacagagaagactcaaataaataaaattggaaaagatggaagatatttttatttatttttttatttccataggtttttggggaacaggtggtgtttagttacatgaataatttatttagtcgtgatttctgagattttggtccactcatcacccaagtagtatatgttatacccactttacggtctttatccctcacccctccttccacctattttcctgggtcccaaaaatccattgtattgttcttatgcctttgcatcctcatagcttacctcccacttacaaatgaggacatatgattttagttttccattcctgaattacttcacttagaataatggtctccaattccatccaggtcactgttactgtgaatgccattgtattgttctttttaaggcagagttataaatatatgttcacacacaccaaaatttctttatccactcattgattgatgggcattttggctggttccatatttttaattgcgaattgtgctgctataaacatgtatgtccaagtatcttttccatataatgacttccttttctcccggtggatacccagtagtgggattgctggatcaaatggtagttctacttttagttctttaaggaatctccatatggttttccataggggtgcactagtttacatccccaccagcagtgtaaaagtgttccctttgcaccacattcatgccaacatctattatttttttattatggccattcttgcagtagtgggattgttgaatcaactggtaaatctacttgtggttctttaagggttctctatgctgttttctatagtggttgggctagtttacattcccacccggagattgcaaaggttttctcccactctatgggttgtctgttaactctgctgattatttcttttgctgtgcagaagctttttaatgataaaaggactagtccaacaggaaactatcacagtcacatgtatatatgcagctaacactggtgctcccaaatttataaaacaattagtactagacttaataaattagatagacagcagcaacaaaataatagtgggggacttcaatactccattgacagcactagacaggtcatcgagagagaaagtcaacaaagaagttggaaggtattacagctaatactgcaaaaatacaaaaaatcataagaaactatgaacaattatacaccaatgacctggaaacctagaaataatgaataaatttctaaagacatacaacttacaatgaccaaatcaataataaatagaaaatctgaaaagactaataaggagtaaggagacagaattaataataaaaaagtctcctaaccaagaaaagaaaaacaaaagttcagtgacctggtgacttcactggtgcattctaccaaacatttaatggagagctaatatcaatccttgtcaaactcttcccaaaaattgaagaagagggaatacttccaaactaattttgtgaggccatcattatcctgacaccaaagccaagatgaggacactacaagaaaagaaaactataggccaatatccctgatgaacatacatacaaaaatccccaacaaaaccagagtaaaccaaatttaatagcactttacaaacatcattcaccatgatcaagtagaattatccctgagataacaagggtggttcaacatacacaaattagtaaagttgatacaccatattaacagagtgaaggatgaaggataaaaatcatatgatggataggctgggcgcggtggctcatgcctgtaatcccagcactttgggaggctgaggggggtggatcacctgaggtcaggagatcgagaccatcctggccaacatggtgaaacctcatctctactaaaaatacaaaaattagccaggcatggtggcaggcgcctgtagtctcagctactcaggaggctgagtgaggcaggagaatctcttgaacccaggaggcagaggttgcagtgagctgagattgcgccactgcactccagcctggtgacagaacaagactccatctcaaaaaaaaaaaaaaaaatcatatgatgaatagatgcaggaaaatatttgacaaaattcaacatcctttcatgacaaaaattttaaacatattaggtgtaaagaaatgtacctcactacagtaaaaaccacatatgataagcctgcaccatcatacataatagtgaaaaacttagtttttcctgtaaaaccaggaacaaagaaacgatccctactctcatcacttctattcaccatatccctggaagccctagccagagcaattaggtaaataaagaaagaaaaggcatctaaataggaaaggaactagtaaaattgtgtctgtttgcagatgatatgctcttatatattacagtttctaaagactccaccaaaatactgttagagctaataaatatattcagtaaagtttcaggacacaaaatgaatatacaaaaatcagttgttttcctgtacactaacagtgaaatatctgaaaaagaaattaagaaaataattccatttatgatagtatgagaaaaatagcaataaatttaacaaggtggtgaaagagctgtacactgaaaactgtaaaatattgatgaaagaaattaagacacaaagaaatggaaaggcatcctgtgtttgtagaataaataacacagtcaatatgtctatactacccaaagcgatctgcagattcagtgaaatccttatcaaaattccaatagcatttttcacataaatagaaaaagtaatcctaaaattcacatggaaatacaaaaaatcctgaatagctaaaacacaagaacaaagctggtggcacaacatttcctgatttcaaattatattacacagctatagtactcaaaacagtgtagtactggcataaaagcatacacaaagaccaatagggcagaatagaaagccaagaaatgaacccaagcatttatggtcaactagtctttgacaaagacacaaaaaatacacgatggggaaagcagagcctctttaataaatagtgttaggaaaactgcttattcacaggcaaaataaaagtgaaattgaatccttatcttacatcactccccaaagtcaactcaaaatgaattatagttttaaacttaaatcctaagccataaaactcctaaaagaaaacagagaagaaaagccccatgacgttggtcttggtgattattttttacatatgaaactaaatctcaggcaacaaaagcaaaaaataaacacatgaggctacatcaagtgaaactgattttgtacttttaattttaaaaggcacatttacacaaaatatgacattttctatttgaaattaaatatgagttaaataccaaagcatcttctctgtaaattgctttttttaaattaataatgtatatcaatatgagtaataacatttaagcaacacatgtcatctttctccctggtgattctgcctgtaaaatcacatggctgtggtgggaagcttgggaagacagagccccacctgatagggatctccacccattgtctctccatgtggaccctgaagagattctgagaattcatgtacatagaagcggtctaaaccattggccatctatgtagatacttggctttgtaatttacattttcttaaaatatgatatccagatatgaattgaaaggcagacttctccaggtatgtaatatttttttaaattatctgttttggcaaacaatgtaattaccatttgttcttaactgtttttcagctttacattactagcacagacatttattgagcatctgctaaatcctggttatactagaaggaatgacacaatcagcctggataggaagagggagcatctatgtagaaaaatcattatcacataattagcttttaacttactaccacattggtataggcgataagaacccataaatattcaaggcaggaggtaaaggaaaaagagctgaaccaggttgagaggttttaaggcagtcaagagactgatgttggaggaagagtggagcctctaatactcgtttcaagtaaaagtggaaagaatgcctgtagctcttagagcaataagcagagcccttgtcctgctgggttggagggtttggataagagtggtaagcagtatcaagttggaagagcaattgaaaccagatgtaacaaacactgatttcttttgaagacccctggaaagtgtttaacatctattaaaatctgaaggtcaaatatgctttttattaatataattgaaataagtattaatatatttacataagcagtgccattaaaacagaattgtattcattttgctttcagaaatgagcgtataacttaagatgctaatttgcctaataatctatgttttcaccttatgttttaaaatctttctttgaacacatttgaggagtcatattttctaccaaatgcctttaatgaaaatgtccatttgattctttaaattctgcaatttcttctttatagaatttgcctagcctgtttccagagagtgcgttttatttctactttagttcaaattattagatgtcttttgcatccactaggaaagcactttggcatgctgtggtagttgcctaggaaacactaataaagataggatgagtgctgagacaggaagagaggaaaagtaacttttaatgtctactatatgccaggcagtgggatggatatttggattatattgttttctttaatcatcaaacactgtaaggtgaatattattgtccccatttttaaaattgtatggcaaacttttatttgagacttcagtacacgaacaaataagaatgactgaaaattgtgtagtatcctatatcttctttttttaaattatacttcaagttctggaatacatgtgcagaacgtgcaggtttgttacataggtatacacatgccatggtggtttgctgcacccatcaacccgtcatctacagtaggtatttctcctaatgctatccctcccctatccccctacccccaacaggtcccaatgtgtgatgttccccttcctgtgtccatgtgttcttattgttcaactcccactaatgagtgagaacatgtggtgtttggttttctgtttctgtattagtttgctgagaatgatgctttccagcttcatccatgtctctgcaaacgacatgaactcatccttttttatgtctgcatagtattctgtggtgtatatgagccacattttctttatccagtctaacattgataggcatttgggttggttccaagtctttgctattgtgaatagcgctgcaataaacatgtgtgtgcatgtgtctttatagtagcatgatttataatcctttgggtatatacccaaaaatgggattgctaggtcaaatggtattgctggttctaggtccttgaggagtcgccacactgtcttccacaatggttgaactaatttacactcccaccaacagtgtaaaaatgttcttatttctccacatcctctttagcatctgttgtttcctgactttttaatgatcgccatcctaactggtatgagatggtacctcattgtggttttgatttgcatttctctaatgaccagtgatgatgagctttttttgtatgtttgttggccgcataagtgtcttcttttgagaagtgtctgttcatatccttctcccactttttgatggggttgtttgtttttttcttgttaatttgtttgagttccttgtagattctggatattagccctttgtcagatgaatagattgcaaaaatgttctcccattctgtaggttgcctgttcactctgatgatactttcttttgctgtgcaaaagctctttagtttaattagatctgagttgtcaattttggcttttgttaccactgcttttggtgttttattcctgaagtctttgcccatgcctatgtcctgaatggtattgcctaggttttcttttggggtctttatggttttaggtcttacatttaagtctttaatccatcttgagttaatttctgtataaggtgtaaggaaagggtgcagtttcagttttctgcatatggctaaccagttttcccaacaccagtgattaaattgggaatcctttccccatttcttgtttttgtcaggtttgtcaaagatcagatggttgtaaatgtgtggcattatttctgaggcctctgttctgttccattggtctatatatctgttttggtaccagtaccatgctgttttgattactgtggccttatagtatagtttgaagtcaggtagagtgatacctctagctgtgctctttttgcttaggattgtcttggctatacggttttttttttttggttccatatgaaatttaaagtagttttttctaattctgtgaagaaagtcaatggtaacttgatggggatagcattgaatctataaattactttggtccgtatggccattttcacaatattgattcttcctatccatgagcatggagtgtttttccatttgtttgtgtcctctcttatttccttgagcagtggtttctggttctccttgaagaggtccttcacattccttgtaagttgtattcctaggtaatttattctcttggtagcaattgtgaatgggagttcactcatgatttggctctctgtctgttattgatgtataggaatgcttgtgatttttgcacattgattttgtatcatgagactttgctgaagttgcctgtatcttcttaaatatatatatatttttttgagatggagtctcgctctgccacccaggctgcagtgccgtggcgcgatcttggctcactgcaacctctgtcttctgggttcaagtgattctcctgcctcagcctcccgagtaggtgtgtctataggcgcatgccacaatactctgctaatttttgtattttcaatatagacgggttttcaccatgttgcccaggatggtctcagtctcctgaccttgtgatctgcccaccttggcctcccaaagtgttgggattacaggcgtgagccactgcgcctggcccattttttttaaatgactcttttggagctataatttttacataatgacttttatttacacagattttgaccaaattatatgaaaattaagtatccccctcttttccttggagacatcttctggtgccttctaccgtcttgcccaagtttgggtctgttgttccagagccagctgcagaactctcaccaagtgatctgcatttattctttcctggttatcattgatttttacttggtttttgtttttgtttttaatattttttcccgtctcctttcctttttccttttctccctcctttcttcttcccttccttcctcctttctttccttccttacatatatcttaagatatatgtatttattattatatatatacatataatcttcaaagtttatttaacttttaagttcaggggtacatgtgtaggtttgttacataagtaaactcatgtcatgagggtttgttgtgcagattatttcatcacccaggtattagttatttttcctgttcctctccctcctcccactcttcactctccaggaggctcgagtgtgtgttgttcccctctatgtgtccatgagctttcatcatttagcttccacttatagataagaatatgtggtatttgcttttctgttcttgcattagtttgctaaggatgatggcttccagctccatccatgttcctgcaaaggacatgatcttgttcttttgttatggctgcatagtattccatggtgtacaagtaccacattctctttatccagtctatcattgatgaacatttaggttgattccatatctttgctatcataagcagtgaacctacacatgtatgtgtctttaccatagaacaatttatattcctttgggtatatgatcagtaatgggattgctgggttgaaggttctctaaaaagttctctttttagctctttgaggaatcgccacacatctttccacaatggttgaactaatttacactcccgccaacagtgtataagcattttttttctccaaaaccttgcggcgtgttattttttgacattttaataataaccattctgactggtagtatttaataatagccattttgatggtatctcattgtgggtttgattttcatttctctaacaatccgtgatgttgagctttttttcatatgcttgttggtcgtatgtaggtctttttttggaatgtgtctgttgatgtcctttgtccactttttaatggagctgttggtttttctcttataaatttgtttaggttccttatagatgctgaatattagtcttttgtcaaatgcggtttgcaaaatttatatctcatcctgtgggttgtgtatttactcagttgatagtttcttttgctgtgcagaagctcttgtgtttaataatatcccatttgtcaatttttgcttttgttgcaattgcttttggcatattcatcgtgaaatcttgaattgatttttgtgtatggtataaagaaggggtccagttttagtcttctgcatatggctagccagttatcccagcaccatttattgaatagggagtatgtcctcgttgcttggtttttttttcattttgtgaaagctcagatggttgtaggtttgcagcattatttctgggctctctattctgtttcattggtctatgtgtttgtttttgtaccagtaccatgctgttttcgttactgtagctctttagtatagcttgaagacaggtagtgtgatgcctccagttttgtttttgttgcttaggatttctttggctattcgggctatttttggtttcatattaattgtaaaattggtttttttctagttatgtgaggaatgtcattggtagtttaataggaatagcattgaacctataaattgttttgtgcagtatgactattttaacaatattgattcatcctatcaatgagcatggaatgtttttccatttgttcgtgccatctctgatttctttgaacagtgttttgcaactctcattgtagttacctttcacctccgtcgttatctatgtttctatgtattttattctttttatagcaattgtgaatgggattgtgttcctgatttggctctcagcttgattttttttggtgaataggattgctagtgatttttgtatgttgattttgtattctgagactttgctgaaattgtttttcagcttaaggaccttttgagccgagactggggttttctagatatggaattatgttgtctgcaaacagggatagtttgacttctctcctcctatttgaatgctttttattcctttcttttgcctgattgatcttcatatatttgacatataaatgtatgtgggagataaactgaatgaatgcctgcaagtatgaaagtatctgtagtttttcctcacatgtaattaatattttgctttagcatagaattttaggttcaaaatatttttttcctcatactttgaagatatggatcaactgtgttctatttttcactgtgatattgaaatatttgatgacaatctcatcatttggaaatcattacttccttgcctctcatgccttcaggagctattaggttcttcctttatccccagtgctgtaaaatttcatgatttatgtctaggcgttgtaggttcatattaatttcaatataaacacttgtgtccttcaaatctgggtttcttttttttctattgtttccttgattttttcttcctctccaacttcattcttattctttcttttccaaaataaatcccaattggccatatctgtaacttactatgttgatcctctgtctgttttatctttactttcatgtttttcttcttctgaggtttatatcctggctgattccgctttatgttctaaactttctattaatttttaaaatgtgaatttttaaaacttctaaatatttgtaatgttctctgattgcttcttttcagagcatccagttatttttatgaatgtgatactcttcttgaatattagagtgttattagtttgtgtgtttgacttttctttgctatcttgaattatcaatttgtcctcttctttccttgggaatctgttgattcttggttttcatctcatatttgagtgaaaggcttggttgattattctaattatgcagtgtggatttcttctactggtatataactagacctgattccagctgggcctttcttgggagtagggcatctgacagggaactatgtgtaggaaggatatgagcgtatttaaaattattccttgcattgggtgcgcagggaagctgctgtccaatgattgacccccaagcctgcattagaaagccctccaggtcactttaacatttttgtaacttttgtacaaaagattttgtaacttttgtacagagcaagatggggttttgctctgttacccagcctggagtgcagcagtgtgatcacagatcactgaagtctcaaactcctgagttcaagcaatcttcctacctcatcctcctgagtagctgagactacaggcacatgccaccatgtctggctatttatttatttacttattttttccaggtggggtctcacttgcccaggcttgtctgaaactcctggcctcaagtgatcctcttgtttcagctacccaaagtgctgggattataggaattagccagtgtgcctggcagatgcagatgtcttctttgtaagaagacagagaagcaattttttttagagagagattatttttgaatgccataaattggtaaatattaatccctaaaagaataaaatataggactcagtatttccttgttagcctaaataaatgacatattaatctagtttgttagctaaacatagcaaactctactattcattcaaatttcagcttgaatcttgcccttctgaatcccaagtgaatatgctctctttagtgaatttgcatattcatatatttatttttccttctcatgataattaacgtatttcgcatttactagttactgctagacattaatcttgtcctgaataagatttgaattttcatttatctttcttcatttttagatacttttgcctagtatatatgtaaataatattggttagatgactagagagatgatctcatcatcatattccagtagtaatttattacttgctttctaagcaaaaatctttgcccatatatccagaatgttgttttttgatgctttcacatttcctatagctacctatgggattgtagtttgtattttgatttatgatttgcatcttgaaatttggatgttatgaataaaaaatttgaaaacaaggactctcttctctattttcttcactttcatatttattcagtagagcagagattcttaatttgcatgtaaaactataagacgttaatttcaatatcgttaaatagggaggaataacaataaacatatatttatgatctggaatagttgagtttattgttattcagtttgaatatgcagctaaagaagcaagattataaataagtggtttccatagatagcatgtttagacttatttgcattaagatttctatgtcatcagcataggaaagatgctgagagctataataaatttgaaatttttttccgattacagtttttactttgcatgttcattttgttacagtttaaggtactgttttctttttccttttattgcaagtgatgcgtatctttttttacttgataacaacactttaaaatttctctgatatcatacttgattattgcattgccatgaagttaagtggtgttgagtgtttaagcatatttgatactgaatatattttcagacaaaccttagaaaattcctaacccaaaggactctgaatggactaagttagttttatgacaagagatgatgatttaatgaagttagaaggcttttctgggaccccaccagtagaattttccctcccttaagaaagcttctttccattcccggcacacttagcacatcttcctatcatggtcctgatgctctttgtgggctttacaggattctttctctccctgtttgacgttgtccacagaagggctggtagagtttggcatgaagcagacattcacttaatgtggttgaatgaataaagattgagcttataaagtttggaagatctttgaaggtttttggccaaaaatgacatggtgaatacaatgtctccaaaatatttatttcctgatactctttaaaatggtcattgaggttgggattttgtcactgggtatactttttaataaataacttcaaggattaatgtgttttcttgtgaaatgacttgggaaatttaaatttttatcatttaaaaaagacaactgtagtatgatgagccagtcatcatgctacattttggtcattttacttaaatacgtgagaaaacggaaattacaaaaaagattattaaactccaactttgattttaattagatttatttgttttaaagttttaagactctcaatgtaataatctctgataatttggtaaatatgaagctttgtatcaacatctttttaggaaatcatttgttttatgtatgaaatattttttaaaaaaataatgcatgccattgtttaaaaagtaaactagtttttatttttcctgcaaaattaacagatttttgtgaaacattttatatgtaccctactccaaataataacataaataagaaagggcattataaaagactgcccttgtaattattttactttgtgcctagtgttcgtagttatcaaattataatttattttccaagttactctgaaagccgtgtccaccagtggatatgatcaaaccagtagacaatttccgcagtatgttctgagttgaaattcttcccagagtgacttgaattggaatgtttggttgattgcggcaagtctgacttgcttttcaccataaatggtacagacatgagttttcagaaaacgggcaatggaaattacagctaatgcatggaacacaccaaaaggggtaattgcttccttccttccctctttaaattcagtatttctgacattgctaacgttgctcaaaatgcttacttttctaattgcaacatataaagtcagtaaaagcagggaaggtatgtaacagtgatgaaaagggtttgaattgagacagaataaaatgtgtgttcatattggcctattatttcttaaaatagttttatgtgaaatagcaatatacagagaattattccttgaattgtgtgaacttttcaaattgaactctcatttgagaaaaatagtttagaccacttactgcccccttttaagaaatgataatcagtgatgatcatccatttctttttatatctgagcatactgtacacagtatgcacttagccctagaagtttttctctgatacccaaaagttctaaactgctccaggctttccacaccttttgtttctgattttaaacactacctcagataaccccttctctgatcacacatttttttttctttgagcataattattcaacgattccctccttttctctccattagcctctttcttcctttctgatccaggatggtccacaatttgagtaacctttaagcattaatttgtttatgaaattacaacctgacataaacttgtgcaacagctgtacttttttccctctagtcaataaacttttttaaaaaaactttcaataactatttcagatcttctctattctcatgctttttattactcacctcattttctacaggtgactctactccttccatccagaagaaaataaaagtcatttgggaactctcatattctctcagcccaaaccaggaaactatccatacctgcagccaatctttcaactttgtccctaagttacatacataacaggggtcctactcatctcataccaatccctgcttctgggttttgtttcctgtatccccaaccctctcagaaaattttcattatgaattattttctcctctcttcggtaccaactattgcatctcaaaagaatcattccaatcaagactcagactcaacactactatggctgaacgcataaccttcagcatcaagccttgccttttcttctctaatctcagcaaatggtaccaccaccaagccaattgaacagaaacctaagtcattcatgagatctcctcctctctccctgaattcaatctgtccccaagtcttgttgctattgcctcctaaatatctcctttaaatccacttgttttcctctctcctcttaacaccctcatctaggctggcatcatctgtttccagagacactgcacaaacttcctaatgcatcaagattgttctctgatttgcagctgtatttatcttttctgattgtaaatatgacctgtcactgccctgcttaaaactatttagttgtttcccataaaacacaatataaagaccacactcctttctgtagcccatgagatcctgcatggtctgacacctgtgtgcttttgcagctctgtctcatgctctctgctctctgctctccaaccaccacagccttctctagtcaagcaaagaaatcctgcttcctcctctttgatggtgacatcaagtctctggactctggctttttttgtacatattaacttgatggctgaattccggcttcaaggattgcattcaaatgataactccagcagaaagagcagaattatcatccagaagagccagttgactctatgagaggttagaacacatgggttgtgatgtaggctgcacctaactttggtattgatagcccattctggaacagccaacttgggggtctttgcgggttatgttttatattctgctcctggtgttctagtaacttcagggtggttgctgggagcctcaaaggtagatgccagggtttcagctccagtggtaaagccggaataatgagaattgactataacttgtaatcggtctagcaaaactatggtggaatggggagagagggcctctatactgagcctagatctagaatgctattgattattgaagagagatgtgtacactgttttatttcccaggcttggaaagtggataatagctattacagatatgttacatctctatagtcttttgatgtttaggaaactattttcatctactaccttggttgatagcttacttgattgttagggtaggcatgagaaacatttttcaatttctttttgtataaatgaaaaagctaagagaagggttatgacttgcccacgacacttgagtgtcagagtccagcatgagcagctccttgttctgatttctgtgcttcccctcatgggactggtataacatttaacactattctggtcacggtgtgtactattaacatatgagtgaagtgtgatgcagtgggaaaatgactagcagatgacactatggagtcagttttcagctgcttttcacagtgcagccctctattcagcagttaaatcgacctatttttagttgtgtttgggacaaagcccagagctgcactttacagagtctacaacctcctgttgggtgttattgcccttagtcatcatttgaatgtttcttatgtcatctgactcagaaagtccacattttcattttcttccacagaattggtttggctaatcttgggtcctatataatgtcagttttttttttcctttaagagtttgaaaaaaccccagggatgtgtgtgggcatgtgtgtgcatatatgtatctgtgtatatatgtgtatgtgtatatgtgtaggtgtgtacatgtatctatatgtatgtatatctgtatgtgtgtgcacatgtcctgtaattcacttgggataataaatttctgaatcatggtagtgctcactttctccatcctcactgtttaggatggtatattgccagtcagaaacagatacagtgggcaacctttccctcaagcccatctgatgggcatcaaggaagtctgtgctggatgagagtggaataatggtttgcctccttactctagggccaggattttatgtggctggaagttgtttttagagaagaaactctgatgtactttctggctgtgtgatcctagactaactgactgaaggtctgatttgaccctgaatacccaaggatacacctgctcttatatacaaatatgtgaggaagagaaggtgtatccttgggtaaggtggaattcccactcctactgccctagcatcttctgtttcatcagttgggctctacctagcttgggagggagaggataggagaagatgaagagaagagggtaattataaataccctccagtaaagagaagaaggtaattataatttttcccgaagctaggggctaacacagcccaagtgtgcattcagatataggactccagtagctctcaatccatccctgtcaatgttatgtgcctctcttctatttgggattcccagctggaaaacaatgcgcagtcctatctcgtcttattttaacagccactctttaacagtctgggattgaattattcagggcaattttccccctgtgtatatagcaaatagtatgtagagaatcttaatcactttagaaataatcttaattactgtcataagactggttattagtaattctggtgtgtttaaaattcaaattagtataaagagtttttattcctcactgtacaaactctggagcaatgaagctgctcacagtgtaaatcttctcttttcccccacttttagagctatgactgaaaacacaaaaggttcttgattttttcattccccatctgttttctgtcattcaaataccagtacattatttgaaatatagttagtctgcagccacagtacataggttgaatcatgtgtaacttttcatgttgaccaatttaaactttacttttaattgaaaaacattttcaagtgcctcatgacatcagttggaattttcttggtttgtgtgtcagtgaggatttggattcacgagttttccttccagggggaagaggcaaagaggttagatggtgtgggtgcacgttattttgtggaaagagctctgaaatgggtggtagaaatctggttttcaggtcaacttctgggaaacactgccatttgacattggggaagtgatgttacctctttagaactgagatttgtcatctggaaaattggcagaagttgcctagatatattctaccttaccagctttgaaatctgtgacaccatcacgtattactttgattttattgcagaatttccaaattacatttccgtataatacagtatgatgtggagctgatcaaaagtttgctttaactgtcagtcctggtggttaaataaatattgtacatagttcactttgtggactcttcaattctagttatcatatgctattttggtgctgcagtgcaccttgaggttactccatttagatacactgtttaatccagtgcttctgtgagtcattaaagaaaggttttcatcgtaccttttgttgaaacgagataattgacaggtttcagaaaggaacctggaatcgtggggaggttactaatttctaacatataattgataaagggtaattgtcttttcacatttgtcaaactttttttcagtaattattctttgcagcaataggaaagaaattgtagagatgtctcatttaaggtcaccagagattttattttatattacagaatactggttgatcagctatttgcctgttgataaacttgttggtataaaaacatttcagttagtgagatcagagccttaaattcttgttttaaaagttgttacatgaggagtagttgactaactcgtctcatactccacagattctgggttctgtccatcagacacatattttggtgaggggagctctgtacacacatgcaaagatgtaaagctccatcctaacttttctgacaacatgctttattccaggtgatagtctgtatttgtattataggctgttagagaaaaagcacctttaaagtattagaaataccaaatgatttgagaagaacaggtgttgaaatgtcaaggaatgtttgtgtagtggaagcaaaagtgtggagtatttttcttctgtttaatctgttgatccaaatacattcatctttggcaactatccagtgtcttgtgcataacaggaactcagtaagtgattggcaagtgaaaataaggccgcattttcagtgcacagctcagcaggtaggtagtgcattgtgtaaaatttgctgcactgcacaagtgtgaacctgggctctctaactacttgccagataaccgttatctctctgagcatttgagcactcatctgaaaatgggggcaatgtaagatccatgtcataaggctgttatgagcattaaattagataatatgatgttaataaaatgataaaatttttaatgaaaaataagtaaataacaaatacctttatttgtgtctcataacatctcggaggtatgaaaattgaaagattcccaagacatactcatcaaatcacagtttggagtttatagacctctacaaatttggcagatattctttacatggaacttttgcagctccatgaaaagttctgcttttatccagtgtctgctcgaaggaaagactctcacctactgtttgtgtatcagttttcctaaagtgggtttagttcttgccttgaaaagggaatgaaaaaagtcactaagaagtaacaataagaagggaaccaatgcctgactttattttctttcttgatgatcaagttgtccctcctacagtacagatactgtaagtaactttatacttaaggtcaaagtactccttgtgtagggtctcaacgtgtctagtgttacctgtgtctaaagcaatttaagaaggccatcataagtgatttgaccatcttctatttatataaccaatttagagtggcagagttgtaacagaaaaagatactcaaaatccaaagcccttgtttaacatcagaattcactccttaactggcttcagtatcttcataaaataaaaatcatgtacctatctcatagactctgtagtttaatatgcccatgccacatttatatagggtgagaaagactttgaagcagggaagatggaattagttaatggagagcctttttacatgtcttaagagtcaacatttgatacaagaggaatcaagtcatgtaaataaggactattttcaaatgattatacttgatgaaaagtcttatgtggaataccattttagatatgtgtatatatatgcttatcttgtttacttttaaatatcattttaagagaattaaacacacttatttctgtaaaattgaaaagtcatttctaacagttccttttcctgctaaatatggcatttatttaaaagatctaatatttaccagtcgctgctatttggttctctgaaaaccctcctaattatctgtgaaagccaaatgtgatctgagctttcttggcaaaaggatattgactttcattaagactgaattgcagtacagacctttaagcctttatctgcatctcattaattggcatgtgatttgggagagtggctattaattatacagaagacggtgagtgaatagaaaggatcattcaaaggcaaactatgcttaaacctgaccatgtccacagacagtatatacttcatctggcagtcattaattttcctaagtgtttgaaatcagccatagtaagggtttttaaatggcacatctagaaataacattaatgtctagatttttacaatttaatttcctggaaagtcatttttttaaacttgcatgaatttttggttgaagtggcaataagagagtatacataatatgataagctacagatccatttttaataataaaatctctcttcccctgacaataaactatggtagtgtagtcttcaaaaaatccactaagttaaaataaagttttcaagttaaaataaagatacaagaagagacaatcctcatacctatctttaagatgtcagcaagtagattgtgccttgttaaatatatactgttggggaatctaaattattctttcaattccattagagtgatatctcataatatacatcgataaatccacacataagaatagaccaaaatgaacttgcaattaactttatgtgaattccctgttttccattttatctgtgtagctaacattttttaaatttgaacatatattttcaagttgtctctttttacagatgaacacttaaatccatctaattgttgcattgaaaaatcttgatcactttcaatattaaatttatttttattaatgcaattcagcaaacatatattgaatattgagtacaaaatgtattgttctacactaaaccatttagatggggaagttgaaacttggtactctaacatttaacttgggagaaacagagtagaggatattgattccacttttgatgtgaacagtgtttagtcatctcatctgactggtttctcactagttccttatgaattttgctgtaactgtaaaggacaggtgtttctcacactttgatgggtcagaagcaaatgggaaccaacagttttgaatgaaggtttttattaaatggtaagcatactgttacaagatctcccagcaaacaggccaatgtgtgtttaaaacacttttcttcttaagattatccaggctcaaggcagtgtttcccaaagtgcaggtcaccagtagtctacctgcatctgaaatatgtgggggtatttgttaatgcagatttcttggctccactccacagttaactgagtcagaatctatagaagtggagcctgggaatctgtatgtaacacattccttgggggaattcttaatcactgacttatttttctgaccttttagctagaatggttaatttatgtgaaaaatgcttatgattaatggatatcacattatagttaagtcagtgttgttatgtactggtatatattttacagcattactgtatctttcaaaagaaatatctgtgggtcaatggaagtaaattgatgctggtatgacagatcctttcctattttcctataaaatgatacttcaaaaaatttactttacacctagacacacacacatgaagttaagaggtgacatagctagggttaaataagttggtataagattgagaccacatttctggaagcaatgcatattccaatatgtttaaagtagttgataccacttccattatcaatgtaatgatttactcattaatgtttaatattaagcattacttaatgtaattaaatagatcatgttttatgatgcatattttcttcaactaaacattagctaattgtagttaaggcatttatatactgattgcatgctaaacacattttcttgctttttacagacaattaatttgaaatactgcatgaatatcagttatttgcttgtgactgatctcaagcctaaaaagaaactcttttcatgaagaatttaattcagttctttttacactctttacaaaggatatgtgtgtaatttcaaagcatatgtaaatgattttgctagattgtttgaagaaatgggtagaaaaaatacttttctccccgatcttaaataggtttatctttaattcagtggcggaataattttggtaaggttgtcttaagtgccatttctacaataattgaagggtatccagaaatagaagcttgagaaaaatagtttactttaattaatgcaattaggcagtttctttctgttgtatcaaaaagaaaataaggaacttttcaaccaaaatactagtgaagcattatgaacatatttatttgttgaataaataaaatgaactctgtacttctttcaatttctccaaaattccaggctatttcctgaactgtgttcttgccacatgctgtccctgcttatagaaggccccccaaatctgcaaagctgcctctttctcattctttagttccccacttgaaggagctcctctcagatcagccttgccttactactacatttaatgtagatctccacgtcagccttttgtttgcttctttcgtaagacttactgaaattattttatttgtctgtttactcatttcttttttgtttcccactgggctgtaagcaacttgagatcagagaaaatgtttgtcttgtaaacatttgcatcaccagagcctagcagaatgcctggcacatagtaggtactcaacatctttatttgttcgactttagggatgggtagatggatggatggatgcatgggtaaatggggtggacagaggaacagattagatagatagatagatagatagatagatagatagatagatagatagatagacagacagaaagtgcttttgagttgaaaatgtttacacagagatcttaaatgaagggctagcatggaataatgcttacatttgatcagtggtaaggaatagataaaagtgtaatcttatatttatctaaagcatttgaatggaataatcaggctaaagaattttgtggattgggttgtttttctgaaatgctgtatttcacttacactgttgtgtttaatttgatattgtagatgcaattttctttgtataactgcataatttttctcatacttataaagaagatatgacttgtgggtaaatttgattaataatgctaccagctactctaggctataaaactatgctaccagaagccatgctgcaatttgaatttggtaaatgtccaaacctgatgatatgtgtgataacattggggaaacatgagttactgtttataactctaaattattatagttaaatatcaatgtaaatgtctctactatgccagataaacataaggttatagcaggtctttttcataaagctatgatattaaggcttattatagtatgtgcctataaatgtatgctcagcacattccttggtgttctatttaaaaatatgtgaaactatttagaagaaaatagtatatttggaattcaaaggacatgtactgaacaggatgaggaggttgaaagtgacaggttttcaggattattctgttatcccatttgtaataagatggaagtaactctgcatgtattttaattttaataataatgtagggagtgtacattttacatttggtataattttatagtaaaagataatagatattcaattaattagtcaaaatatagtaaattattttaagacagatgctgttttaaagatatgaaataataataataaatatgaggttggtttctaattttatttccatgcactaattttattaaaattaataaaataatttaatctttagctatgtaattcttcaatcattggctaataaaagacttacatcagaatgctatgtactgttaatttaattgcttagtacattttattagcaggtgctgaagtaggcaagtttttaaaatttctgtcttcacagcaactctgtaagttagtatcatgacctctattttacaaatgagaaaattgtgacttaggaaaattacttgtctaatgctatattgttaaaaagtttcagggtcaagtttacctactttcaaacccctaatgtgttatatggtatatcacattgcttataaaaaaatagctttagccttgtaaaataatattcagagacattattaatgagggctatatttttcatttagccaatcagcaagcatttatagggagtgaccaggcactgaactgagaactagagatagtctaaaattagacatgagacttgtctccaaggcccttactgttgtaaagtgagattgttgctggtggctgtaaatttctacacatgcttggattctactgggaattcagctatgctattttaaacatctcttcatctgcagctaattcaaaagtgttgaagggctgcttcccctagagcacttctaactgtgccttgtttaaccaacaatgcactaaatcattctatcaagagatagactttcccttaagaatcagattagagttttgactgaattcagataggtaacttgaacaaaaagaacttcagtgttaactgttatttacagattaagtcaaaattatttagaatgacttaaaaattatgacataaccagtccccaagtttaagaacattacaaattatctccagattttccactctgtctaaatggaccttagggttgcagaaagataaaagatgaaaaatcatgagtgagaaggggatgacttgaagacccctaacagttattcctggtatgtttcccttcctgctttctatttgtagtattctgggatgcagttatgcaagcccagtttagtcctctcagtcacatatagatatatgtatgtatatgctatatatgtctatacatcctattatttttgtacaatctaaaatttttgatgttaatagccttttttttcccctaagtaaaagtcttaatgtctgttttagggactctccaagaaatctgcatcatgaaaacagctactggcctgatctctgcagtgtgtgtgtgtgtgtatgtgtgtgtggtctgtgtgtgtcttcatgaatatggaaaaatgctctgcaactgaacccttaaggttaactcccccacacccactctcctactcacaaagctttcaaaaccagacctataataggcaagaaatgagtggggaaaccatctttatttcttttcaaatatctaattctgacatattgccatcttgagtgctgtctgttgttgcctgtgtcttagttttgtgccttgcatcttctcatggctgtcttctctgtttcataggcctatcttgcctcctctgctcttttctcccatgcactgccctgtcccttcttacttgatctttagcccacagatagagtcttgtgatgagtcaatcatgctttttcatggtgagttttatgccttgtgttgctctcatattgtgattgtaactctctcacatgatgctcctgctcctctatcccctcaataactctttcattaaattgcttttttgtgagttatcttttagctatggtgtttatgaaacctttgtgtcatagattctacactgataatgtgttatcaggaatgtagtcctatcagccatgattgttgattcacattatattattcaatccaagatcataagctttccaaaaagaacatattatccttgtatttcttctaatttaattacactttttatgaagaatttcagagaatctagaattctatccatagtcttaacttacccacctctaactacatattcaaatgaactgagaaaattttgcctgtttttatgtgtctgaattatattcttgtatgactagctattttatgcatatgaagttctttattcatattctaatggatataaaatgtttctttttgaattgttgccttttttaaagataattaagtgcaattcagtttcttcagaatttcaaaatgattatatacatattttctctccctaatacgccccactgttaagtatgatttgttacaaatttgcagtagtctatattgtcattttgtgaaatctcctttcctcaatttttacaggcattgccttgattaaaggcctcattacctctcctagaggaatgatgagctgcatcctcacagtccatccccttaccaagtgattgtttccacagtaatcttctaaaaaaagtttatcattttggagaagtcacttttagtcttatagttcttcagtgtcttgacaaaacccagactccatagcaacatctgcccctgcttactttctcaatagaaattatcccactgtttataaacctcaaactacttgtgttttctcctagaatgacatgctattacacaacctcatgatttttcataagttggctcctaggtctgcaacgctcttgttctgtttgtcagtctcttgtctcccctgcattcttaatagattgaccacctctgaactctctataattgtaaaaatagcctattatcccaaataactgaatatgaaaagtcataatttcatcaagtctattttggggcaaatgagatttcctagcacatagcttatttctaatagcctgtaattggaagggatgcctttgagctgataaggccctttacactgatctggttacattcctgcttggtcctcctggtgaatcatgtaaaagggatggaatgtgccagtctggctgtgcagattatcaccatagaaaggataactcaactgacccttctgtgggcttaccctgacttggtgatactgcgacctttaatatgagttagaccagtcagaagaacagtaattccaactgtaatatataaaatgtgtttatactcacccctacccccagtgcccttaatatagtttctcttgctaatctttgaaggaagatctaaaacactggaattctttgtctccgctgaaaatcaaaaattaccatggtcgagaaaaaaaagaaaaagcccctatgtacttatagttcctcaaggctgtcaagtgtggttgggttgctggtgctctccacaattctagaggaacttcatggcgcagttgtaagggctggtgcagagaatgagattcgggagcagaaagttgagcacagatttcctttactgaatgtcaaggtgggcagcacagcacattgaaaatgtcacagctgattttacagatttcaggacaccatagaatgtctgttttttatctgtagaaaggatctaaattgatttttacatgaacatatattatttgtgtaagctatagtgtagagaagtaacattaatcataattgaaatctaacactagtgttgtatgaaaggagagaaggttagcactccccttgacaaggatggaagaggcccttgggcctgacaacacgcatacgcaaggacaaaaacccaaacaccgcatgttctcactcataggtgggaattgaacaatgagaacacatggacacaggaaggggaacatcacacaccagggcctgttgtggggtgggggtaggggggaaggatagcattaggagatatacctaatgctaaatgacgagttaatgggtgcagcacaccaacatggcacatgtatacatacgtaacaaaactgcacattgtgcacatgtaccctaaaacttaaagtataataaaaaataaataaataaatacaatctaagactattagttttgttacctcggatacaattatagtagcatctactcagaacttcagttttcaaactatatgtaattattattttaaaatgattactttataatttatgacattacaaaatgacttatcgttgactttcaatttctgaaggaagtagcaagttgaagaacacaaagcattgattgagagatgactgtcctaatttttaatgttaatacaatattttaatacaataatgaattattagttacttcatatgtaacaaaagtatctctggaaatttgactaagatggtcaaatataaaacttaaatagaaagtgctttacctaatgtgattatttgattttttaaattttataaaccatttttgacatatattacaatatgtaattctgtgaatatttgaataatatttgatgtgttccacgtattcaggatagtcaagaaccaaggtaatggaaaaattacttttaagccatctttaccatggaatttctgtttggtgatgatgatggtgacaatgatggcatcatagttatgtatgaaatttgaactcatattatggacaagtcagtcctcttaagtattttgtatagggttgttgcatggataaaatgagatagtttatgtggtaggagtcatcatttttctctttatatgggcaaggagactgatgcatgcagagttgaagtaacttgtacagttcagtaagcagttgtgttcagagtttcatcttagctgttctgaccacattctgtgttcttctgtgtgaaaaataaataaaaataaataaataaaaataaaataaaaccagttttattcaagaagatcagctgttttgctttcactctacttgatacaatagttggttgaaaatgtctatatccttagatccccacagaccctacagatgtgaaaaatgagtagtggagttctctcgaagaagaaatatgtggtcaattaagacctagaatcagtctttgatgaactggaagtttcctggataggcagaaaattcataaggaatcctagaacttggcctcaaagactatctatccatggcagtttaaatagctgaatgaacaaaatctgagtccaaagtgaagagctaagttaaaaagaaaccagttaataaatagggatttgcccccccataaccaatctcaccttggtttcatagataatatcccagtaaatgtgcacagatatttactgtaacagagtgtccacctaaaaatacagtggattgtcttaggacgctagaataaaatgttataaaagggaatgactgaatgaaggatatctgggaacctttccttttcatgaatttgtattcctttaggagtatttaatatagaacttcctgattggaagacttacatatacctgaaaagctcttcacatttaatattatatattttttaaatggtgggatttttggctgtgtaggaactggctactctggcatttttactcatgatgaagaaaactctagtaatccaaaaaacatttgttaaaaagagagttaaataaaacacattgtttttcttatgacaggctctgtctggggggttcacttcagcagttcataaaatatgtctaatactttgctttgttaagacaaagcaaccttcttgtttattacatatagagaagacatatatatatatatatatatgatattactatgtataagatgttcattttttaagttttgctttgtttatttcaatactagcctaaaattttcatttaattgaatggctgctatgtaaggcacttcctgctaggtgttttacattttatacctcgaatctgaaaaataaccttatggtagaaattattaacccttctttacttagaagaaagtcagagctcacatagttttgggtaaagggatgtgttccaaaggtccaaatggcatgaaggcaatccaaacctgaatctctgtgccccaaaggtcacacacttttcattacatcacactggctcccaaggacaaaatgaatccaaagataggtatttcaaggataggtatattttcaattactgattagcagcacaattataaagcataagcaatcctttaagaacaatgctttatttgggaacagattacttgggactatctgtacctttatgaatccttgaaaatcaccactgtggcagctcaaaacaaagcagtcttttgtacacataatatatctgcattacataagttgaatatatatttgtctaatgtcacccaaagttagcttatctgtaagatggtttttaagatgtaggaagataataactaaaatatgcttatgattcattaaagtatactttaaaagaatgagatgagcatagcattgaacgaggtatcccatttcagtggtaattatttcccttgagtaaattaaatagtcttttatttaggggaaaataaaacagtaaaaaatatcaagttttatcatggccaagttttatcatggtcaaaatagtagtggtgagattatctgtactacagttttaatttaaagtaaatcttttaagcaaacatgtatggaaatattaagtcattttccagattttgacttgctcagtatgaccattataaatataagaagtaaaaaaaaaaaaaaactaatagcttacttcagaacaacaacaacaaaaataaatcatagatggatttctgagtggagattttaacaaagcagaactgaaagaaatcaatctgaaactttcaccagatcccttcagcagtttttctttctcagtttctgttgtgcttctttttcacaatcttctgcctttccagaaagtaaatgtgttaattaattacttatacaggaagtttacaatgctgtgaattaaatgttaacataatttatttttaggtattcctttagttctgagcttagagtactaattattttgttggcattttggttatattttgcttttgaaaaaaagatggtcacaattcgcttccagtgacatttataaagtaatatttatggtatgtctttgatttcaaaacagttttaacttaaaatatgattcactttagtcatatctgttatttaatatccagtattttgccaatacaaattatgctaatgagtttttaatagcttcattcatatttgtccttaagttggagatgtacaaatacatattttacatatgtacacatgagcactttaaaatatgtaaatatacagctgttttgaatgctcttacaattaatatgcagtttaacagaactttgaacacctgctacatcttatgttctatattccttactgtgtggatacaaagatgaattacaaacagttcttgagatcaaggactttccaatatatcatatgtatttttatgtacaaatcgtaatgaagataagcctataatgttgatggaatgtgtcactgacaaatgagtattttgccttttctttaataatttatataaattttctacagtgagtatatattatctcagtttatctaaatatataaaagtattttaatctacccgaaaaaggaaatatatttgataatttatttttccagatacttagcttcccaactgaaactgtaattatttatttatactaaataattaagaagccttaattagcattatactgtcattagaaaaattggtactaattggccgggcgtggtggctcacgcctgtaatcccagcactttgggaggccgaggcgggcagatcaggaggtcaggagattgagaccatcctggctaacacggtgaaaccccctgtctactaaaaatacaaaaaaaattagccgggtgtggtggtgggcgcctgtagtcccagctactcaggaggctgaggcaggagaatagcgtgaacctgggaggcagagcttgcagtgagcagagatcgcgcccctgcactccagcctgggtgagacagcgagactccgtctcaaaaaaaaaaaaaaaaaaaaaaaaaagaaagaaaagaaaaagaaaaattagtactaatttatcagtaacagtgtaattcagaagttaatctaatgaagaaaatattacattgaaaaattaaaattgtgaggtttaaaaaactgacaagatttgtggctttttatttactaaatattcactgtatgatatcataaagtatttaaacttttcaactcataacaaatggttcaattagagattctggccttcctttttttttaaagactatttttagaacagttttttcttcacagcagaattgagatttcccatgtatctccgacctctacaggagcatagcctccgcattatcaacatctctcaccataaggtacatttgttacaatcgatgagcctgaatggacacttcataattacctaaagtctataatttaccttagggttcactctcaatgttgtacattctatgggtctgaacaaatgtataatgatgtattcatcattattgtattttacggagtacattataaatatcctctgcacttgaactattcatcctctatcccccagtccctggtaaccatttatctttttactgtttccatagtttagccttttccagaatgttatatagttggaaccaaaaagtacataacctttttcgcttggttttattcacttaataatgtgcatttaagattctcctatgtcttttaatggcttaataactcatttcttttaatgatagataatatttcatttccctgatatatacctcattttatccgttcacctaatgaaagacatctcgattgctttcaagttttggcaattatgaataaagctgctgtaatcatcattgtgcaggttttatatggacatacgtttttaactccatagggtaaatactacaaagtgtgattgctggattgtatggtaaaagtatgtttagctttgtaaaaaatcaccaaactgtcttcttaagtagttataccattttgcactcatcccagcaataaatgggagtttctgtcgcaccacatccttgcagaatttagtgttatcagtgatctggattttggtatatagtagtatctcattcttgttttaatttgtatttcctaatgacatataatgtggagcgtattttcacatttgacatttcattcacattcatttcacatttcagatgcttatttgctatctatctatcttctttggtgaagggtctggtgaggtctttgacccatttttgaatcaggttgtttgtgttcttattgttgtgtctgaagtgttctttgtatattttaggtaacagttctttatcaaatgtgtccttttcaaatattttctcccagtatgtgacttgtcatctcattttcttaacattgcctttcacagagcataagtttttaaatttatcgaagtccagcttatcaatgatctcttttattgattgtgtctctactgttgtatcttaaaaggtcatcaccatacccaaggtcttctaggttttctcctatgttaccatttgggagttttggagttttgtgttttacatggaattctaggattcacgttgagttaactgtgtgaagaggataaggtctgtgtctagatccatgttttcgtatgtggatgtccagttttctagtaccatttgttgaaaaaaccataaaaccatgtttgctatattgtactgcctttgctccttagtcaaagatcggccgggcgcggtggctcacacctgtaatcccagcactttgggaggccgaggcgggcggattacgaggtaaggagatcgagaccatcctggttaacacggtgaaaccccgtctctactgaaaatacaaaaaaaaaaaaaaaaaaaaattagccggacgtggtggcgggcgcctgtagtcccagctactctggaggctgaggcaggagaatggcgtgaacccggggggcggagcttgcagtgagccgagattgcgccactgcactctggcctgggcgaaagagggagactccgtctcaaacaaaaaaaaaagatcaatcgactatatttatgtggatctatttctgagctttattttgtgtttcattgatctgtaatatttgtctgttctgctgccagtaccacactgtcttgattactgtagctttatattaaattattttattatattatattctgcaaccttgctataatcatttattatttccaggattttttcagtatttttggactttctgcagatgatcatgtcatctgcaaataaggacagttttatttctttcttccaaatctacatactttttattttttattattttttatatttaattttggaaacagggtctcacttggacacccaggccggagtgcagaggtgtgatcatagttcactgcaccctcggactcctgggctcaaggaatcctcccacctcagcctcctgagtagctggaattacaggtgcaagcaacatgcctggccaaatctgtatactttttattttcttgtcttcttgtcttagtagagtcccagcatgctactgaaaagcaatggagtgaggggatatccttgccctgagcttagtgggaaagctttgagtttctcatcactatgtataatgctagatgtgggtttttttgtaggtattctttatcaagtacagtaagtcccccccttttcctagtttactgagaatttttatcatgaatgagtgttgaatttcatcaaatgctttttctgaatttaatataagcatgcaattattcttctttaacctgttgatgtgctagattacatgagttgattttttaatgttgaaccagccttgcatgcctgagacagatatgaattggttgtggcatacaattctttttatacattgttcactttgatttgctggcttgtcttttaataggatttgtgtaccatgcatattttttactttggtaacatgtttgacacttgctgttaggttctttataataaatatactattcatttatgtgatagaaattcagtcttcactgattcttgtcctcacatctttctatatataaaactatattattccaatgtaaaaaaaaacacacacacacacaaaaaaaacaacccatcaatgaactctactctaaaatggttgccttggttttccttataattgcaaatttttttaacataggagaaacaaaaaattcatttccgttatccatctattccatgtaaatttgaacacatccttttattcatttttttccctttcatgaaagtggaataatattgtaagggcagttacataatttgatcaaaatttgtatcttgaattgttagttcagcatataattttcttttgtacgattcagaactatatttttttaaagggtaaagaacaggtactatatttaataccatatctttcattcagctttcctaatatattctaatagcctcattaaatacaaatataaattaaacattcaatttcaaagctttaaaatttatgttaatttaattaaagaaagtatcaaaagcagcactcatagaagttatataaacactgagataaaattgagtagaagtatattattttagcttttgatttaaaaattaagtttatttcacttgttaattatgtctttttatctaatagaaagggagagtgatagctacttagcaaagcagctttaagagttacataagcgaatatacataaaaggcttagtagtaccttgcatacagtaattgctcaatacatggtggtgtttatttgtagttaatgttcttgataattttatgtttgggatttaatcttatattttataattaagctaaccagtttgtaactttccatgttgtagtgaagcataatacttgtttcaaacaaaaattgagtttcttagttatactttgaaaaacactatgatatatctactgttaaaaaattatagtataattgacgatgtttgtgtattttaactcgtgtctttgcttcacctctcttctcttcatttatcaacccaataactatttctagaatagggagattaaatctctacactttcagtgtcttgttcaggtctcttttagtgatgtggcagtggtaattctttaatatttacactcacagagacagtgtgattaggtcaacataatttttttcatggtgttctttgtcctcctacatccatatttgtcaacattccttatggtataagcaatcaatgtaatacattacttattatgaaataaaatgtttataatgtattccatttttagaagcatttttttctactgtgtacacttagattaagcttaaatattctttgatctctgaagaaagtgaagaaagagagctcttccttttcattcttctctgatatgggccatgaatgatttagtttaacacatatttatggagcaccaactacatggcaagagagagggtagatactaatgacagaactatgaaaactgcctttaggatgctcaggtacatacaaactcatttcagtgtagtttattaagtattaagatcaatgtatgcataaaatatgaggggaattgagtgtcagagaagcatttaatccagcttccaggaaatgaattcagcccaaagaacccattttaaggtagaatggtaattatatgtagaattatatctgaattatcatgaaattctttggtcatcagtaaagatgcacttgtgatcatagtaattctctgaacattgaacaaaacatcctaatgcattttagcaaaaaattttaattgtaggaaacaaggagtgttatctgatgattaagtggaaatttcaccagaaacctcatatattttcattttccaacttttaggttcaagaggtacatgtacaaatttgttacatgggtaaattgtgtgttgcgggagtttgatgtataaataatttcattacccaggtaataagcatagtacccaataggtagtttttcaatccttactctcctcccaacctgtactctcaagtaggcctcaatgtctgttgttccctttgtatccatgtgtactcaatgtttagctcacacttattagttaaaacatgtggtacttggttttctattcctgtgttaattcagttttgataatggcttccagctccatccatgttgctgcaaaggatatgatctcattcttttttatggctgtgtagtattccgtggtgtatatgtaccatatttctttatccagtccaccattgatggccatataggttgattccacatctttgcaacagtcagcactgctatgacacacacattcatgtgtctttatggtagaacaatttatattcctttgagtatatgccccgcaatgggattgcagggtcaaatgttaattctattttaagttctttgagaaatctctaaactgctttccaaagtgactgagctaatttacattaccccagaactgtacatgttcccttttctttgtaatcttgtcagcatatgttattttttcactttttaatagtagccattctgactggtgtgagatagtatctcattgtggtttttatttgcatatgcctaatgattagaaatattgagcattttttcatatgcttgactgttacgtatatgtcttcttttgagaagtgccttttcatgttctttgcccatcttataaagtggttgtttgttttttgcttgttgatttgtttaagttccttggaagttgtggatattagacctttgaggaatgcataatatccaaataatttctcccattctataggctatttatgctgttgatagttttgttttggctatgcagaagctgtttagtttaattaggtcccacttgtcaatttttggttttgttacaattgctgttatagtcttcatcatgaagtctttgccagggctagtgccccagatagtatttcctaagttttcttctagagtttttatagttttaggttgtacatttaagcatttaattaatcttgagttggttttttaaaatatggtgaaagccaagagtctagttttagtcttctgcatatggctagccagtcatcccagcaacatttattgaatagtgagtcctttccccattgcttgttattgtcagctttgttgaagatcagatggttataggtgcgtagctttatttctgggttctctaacctgttcttttggtctgtgtgtctgtttttatgccagtatcatgttgttttggttactctagcattgtggtatagtttgaagtcaagtagtgtgatgcttcaggctttgttcttttcacttaggattcctttagctatttgggcttttttttttggttccaaatgaatttctgaattattttttcacattctgtgaaaaatgtcattggtagtttgataggaatagcattgaatctgtaaattcctttgtgcagtatggccattttaacgctattgattctttctatccatgggcataaatgtttttccatttctttgtgtcatctctgacttctttgagcagtgttttgtaattagtattgaactgatcttttacctccctggttagctctattcctaggtatcttctctttgtggcttttgtgaatgggattgtggtcttgatttgtctctcagcttggacattattggtatatagaaatgatactgatttttgtacattgattttgtatcttgaaacttggctgaagttgtttatcatatccaagagcctttggggagagactgtgggattttctaggtatagtatcatagtatcatattatctgcgaagagagatggtttgacttcccctcttcctatttggatgccttttatttctttcttttgcctaattgctctagacttccagtactatgttgaataggagtcatgagaatgggcatccttgtcgtgttccagatctcaatgggaatactcccagcttttgcccattcagtatgctgttggctgtggttttgtcatagatcactcttatcattttgaggtatgtacattcagtgcctagtttattgagggttttttaacatgaagggatgttgaattttagctaaagccttttctgtatctattgagatgatcatgtggtttttgtttcagttctgtttgtgtgatgaatcacaactattgatttgcatatgttgaaccaaccttgcattccaggaataaagcctacttgtatgtggtggattagctttttgatgtgctcctggattctatttgcaattacttgttgaggatttttgtatcattgttcatccgggatattggcctaaagttttcctttttcatcatgtttctgccaggttttgctatcagaatgatgctggccacatagaatgatttagggaggaatccctaaatcatttaaaaatactagcctgattagtttattaacattttcaacattatcagaaaaggtttctttcctttattttatttatttatttatttattgagacagggtcacactctgtcacccaggctagagtacagcggcatgttcttggttcactgcagcctccatctcccaggtccaaacaattctcctgccccagccccccaagtagctgggattacaggcatgtgccactgcacccagctaatttttgtattttttgtagagacagggttttgccatctttcccaagctggtcttgaactcctgaggttaagcaatctgcctgccctggcctcccaaagtactgggattataggagtcagccagtgtgtccagccacaagttttcttattaatgacttttctttgactaaaaacaaattgaacaaagttgaaaaagagatatcaaaaaattatagcaatatttttgttaattttataattttttaaattaactcaaaattttgtttcattaaagttcctttttctgtgaagttcagtggccatattagaccttgatatttagaaaaatgaaaatattaaaatagagaacagagaaaacaaagatttcattactaccctagaattcagcttggtggtagaaggaattgtgttcatcagtttgttcataaaattctgtaggccatatggagaagattaaatgttatgttattggtagaactatttggaaaattagagaggacacactatataaaagtaaaacatttctcatttaatttacagtactagagaatgccaaatgctgtccttgtatgaattaggtacaaaatgtttattatgacagatttttaaacagaacttaggacacattctgtgtaattaataacaggagatgtttcttaattcgtgatatcaactcctttataagcatattttggagattatcttttaatgaaaatataccatatttctagcatagatgtaaatcactcatgcttaaaggaatgacttctacagggtgatatgatctcattcagagatactagagctttggtactgttctgtaggttggttttagttcccttcaaaacaagatcacactgttaaattttatttccataacttgctcatatgtgtaacatggcatatttctgtcttgtattagttgactataaatttaataaaataatagctggccagcagaaaaaataagcataaatatcttgagaagaagcatattccatttggactgttttgttttttcatactaaatgtgttggaaaagtttctgatttttctcgctgcagttgtggctcttaagtaatttcttttgatttaccatgaagatcatattatgactgcctatttcaaatcattcttaaaatctttccgtttttcttgcagtgtgccatgatatttataagtattaaaattttttaggtacctgaaataatctacagatatgcttgtgtagtgaaccaagaaatgtgataaaatgaatgcataggacacttatagacataaaaggacatttgcttcaaaatggcatttgtactcagggttaaaaacaggttattttcctggcccagagaaatgtactctctttacaatgacatattgttccctgaatttggatgagtaatggcaccagagccattttacatgtgagtccagatctcttagattcttttaatcctgtttaatcactcaggtgatgagtatgcaggatgaaaatatttttgataaaaggcatagctcattcatctaaaaagttattaatgttttcttctaccttccttacaaaataccttttcagaaacagacctatttataaacactggtaaagaatcagacagtggtaaggactgtcatgaagccccactcactgtcatggtgtcttctagacatatatttttctttgatgatagtaaaggttggcctctgccatttcagagcacacaaacaaatctaatcaggagttcttatcagttgtgttcactgctatatccccatcccctaaaacagagcctagcacatagtaggcactcagtaaatatttctgaatgaatgaatgaatatattgtgcaatagtattctattagagctgtcacttatgtgagtcagtttttattagatcattgggctaatcaagtcaaagatataatcatgtgaagctgctgactttttaagagagaactctctggtcttttgcaatattttattattttaacctaaaattttctaaaatgtgatttttctagaagtataagttcatgctgtagaatttaaagctgagaaggaccttaaaacctgtacttctgtaccaacatcatcagaggggcccatttgtccttctcaaagagcaacttggaatactttctatactgcttcacatctggcatatatcttcagaaagctgtattccagtaagggatgcctctagaatgaaaggaggtacacagtgagaaattttgtaaagtattctttgcttagttcctgtcttagtttgtttatgctgctataacagaataccacagactgggtaatttataacaaacagaaacttactggctgacggttctggtggctggaaagtccaagatcaagaggctgccatttgcacagccttctaacagggtcatcccatagaggaaaggcaaaaaggatgagagaaagcaagagggcaacaaacttgttcttttttttttttttttgagacagagtttcgctcttgttgcccaggctggagtgcaatggtgggatctcggctcagtgcaacctctgcctccggggttcaagtgattctcctgcctcagtctctcaagtacctgggattacaggcatgcaccactgccccgtcaaattttgtgtttttagtagagacttgttcttttattaaggaaaccactcccatggttttgtttttaatccattcttgagggcctcacccaggccttaacacctcccattaagcctcactttccaacactgctgcattgggaatcaagtttccaacatatgaacttcaaaggacactttcagaccatagcagttcctttctgctaaattagcttgacaagtggttgcttaaaaacacatcttgcagcatttgtcccaactctgccatctgctaactttctgatgttgggcaaattatttaacttcttgatgcctcaggttattattcataaaatggtgataattatagtgcatgcttcatagtattaatattactttggtaagttaatgagcagggtttaggaatcttattctgtaaacagatagatagtaaatacttcaggctttgtatgccatgtgttacctctacactacttaattctattgtgtcatacaagcaatataggtaatccatgaatgaattaatatggctctgttccagtaaaactttatttactcaaacagacattccaggagctgaggtttgtggacccctgatctaaaatattgcttaatagataatcaagttaaaaatgattaaatcttttattcccttttgaatttttttttcagttaacatatcatggatatacagaattcttcaatgtattaaaaaacactgtatgtttgcaaatctaattttttaacaaaattacagatttattataatgtaaaagaatgtctaaaaacttctggtagcaaatccttaaattaatcaagggataggattagaaaatgtttttaaaggaaagtaaatggaataggtttaggataggtttcagggcactctgatgtgtttcaagtcaagcagctgggaagcatcaggaatggggctgaagtggtgtgagtgagtgagtgtgtgtgtgtgtgtgtgtgtgtgtgtcctgctgtctagtctgtggcctttttacctgtcaatcatccatactgtaattgaatttagaaagtatatttacctcctggtcatacagaaattgaatataaagcaatgtgtatttgtgaagatggataagtaatatattaacaaacccaaatttttattttatagaacgtaactacactgtctggttgtattaatgctagaaatattattccagtagcatttttatcagagtttgatgacttcaatcaaattctatccatttatatagtagtagattgtacttatattcaattatttcttagttaatttttcactttattcattcatttggcaataatttgttgaataccttccctaggttagaatctgagagtgacaatatgaaaaaacatagttccagggatcaagaagtttatagtagaataaggataatagagaagcagtaaggtggtaacatgatggttgacaaaagtaccatagaaggacacccagggggttgtgaatctacagagcacataacccagcctatccaagaggtgacacctaggataagacctaggtgtcagaagttattgttagcaagtttaaggatgccaggaaacgcattttagacaaatagagcaccaaggtgagagatcacaaggagacagaaagtagatcattagaactgagtaaaatgagaaggggttggggaggttgcaggtctttatctgcataattcctgggatggtgactaaagaatttaagttgaagaatagcataactgaatttatccttgaggaagaatgatctagtggcaaggtggggaattcattggaggaaggtgatgctggagtttgaaacaaattaagaagattctgtagtagtaatctcgatgagagatgatgccagttggacttctggagaaaaatttaggagctaaaattaaaagctttgaagattgatttctgagggaaatgagagtgaagatataatcaggatgacttctggacttctggctctcttttatactaatttatttatattcagtatctcaggtatgaaatttcatcaacacattatttgttctttttataaagcagtgatagtgctgatatatttaagagtttgttccttgatgagtataatagtaaagctaaagaatatgtagggtgttgaggtctgattaacaagcttgagtttgtcctaaagttgagtgttaaccagtgtctgccactgttacaattatgaaattcaaattctataagtaatgtaactggcaagcagccatgggtagtgccttaatagcagcataggcaatagctatcactggatgaagaggagtaggaaaaagaggaagaagaaaagaaagagtagggggaagaggaagaggcagaggattcctgtttgagattgggaatcagggaagcagataatttttcccttagatttaaaagaaaatacgacaattaatgacgtccccaaaagatttcagggaacatgaagttgcttctgagaactctctaggttgctccactgtggttatgccctttctctgtttatagtttatggataggctcatcctataatacaaactgttctttgtttctccattcgcttctgtccaagaagcactggagataatcaaagatgaagaaagaaccttttaattaattaaagttgttttgtagcttgcctttgaagtttcttttctgggaacttcttcagcagctcaaatcagccatgtgaccctgtaaggcagcttgctgaaactgaaggcctgcaaacagtcttgtttaccatgctatacacttttgctaaggcacacactttcttcacctttcagtcacaacaacaataaaagtaagttaaaatctgactagaattcagtagtacattactttggcattccaactaaatgattaccttgattaagccaaagtatattttggaaggaatgagtatgtcccctacttttatttattttctaataacattttattttatacatagttttcagttaggaatcatacactactgaattattgctctttttaattaccaaagcatgctgaattaaactacaaataccagataagacagaggacagaacaaactggcactctccagtacttaaaaattttattttatgttcttaaacacatttcacagatgttagatttttaaatgggacctattttttacatcattccagtaaagctggaaaacaatcttgatgtctgttgttggaggtgctatgagcagaggagaaaaatttttaccagtagtcctgtcccatcaatatatgatgtgctttatggcaagagcagccattagtagtgttgtcaccttttgtggctttgactaaatcctgatctgccttaaggttttgcctaaaagaaccattgctaatagtaacatgctggtctgtttgaggcaatttccttgcaaatcctcagtcatgccatgttatgtcaagttgtgtactaaagcagtagtttttgattgaaattctcacacatatctattattatcgttgtaattggtaaaataaatttttgttcaatattttgagtgtttgagtgttttaagttcaatgttctgagggtttttaaacacaaacttttgttctggtggtttggcacacaaaacactgttgcaaatgctttacccatattgtcatttaattttccttctaactctagaaaacgggtactgttatgtgctatttcagatgagaaaattaagctcaaagcttatgtgacatgctcaagtttatatggcaaattaattcatgttggagccaagattctagttctcgtcattagttctgaatccaaaaactacactgttattcacagtactctgtcttttaagagtgatgtgattccatctcgttgatctgtttaatgttgacagtggggtgttaaagtctcccactattattgtgtgggagtctaagtctctttgtaggtgtctaataacttgctttatgagtctgggtactcctgtattgggtgcatatatatttaggatagttagctcttcttgttgaattgatccctttaccattatgtaatggccttctttgtctcttttgatctttgttcgtttaaagtctgttttatcagagactaggattgcaatccctgccttttttttgttttccatttgcttgatagatcttcccccatccctttattttgagcctatgtgtgtctctgcacgtgagatgggtttcctgaatacagcacacggatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagcctcgatggtctttacaatttggcatgtttttgcagtggctggtactggttgttcctttccatgtttagtgcttccttcaggagctcttttagggcaggcctggtggtgacaaaaatctctcagcatttgcttgtctgtaaaggattttatttctccttcacttatgaagcttagtttggctggatatgaaattctgtgttgaaaattcttttctttaagaatgttgaatattggcccccactgtcttctggcttatagagtttctgccgagagatcagctgttagtgtgatggacttccccttgtgggtaacccgacctttctctctggctgcccttaacattttttccttcatttcaactttggtgaatgtgacaattatgtgtcttggagttgctcttctcgaggagtgtctttgtggtgttctgtgtatttcctgaatttgaatgttgacctgccttgctagattggggaagttctcctggataatatcctgcagagtgttttccaacttggttccattctccctgtcactttcaggtacaccaatcagatgtagatttggtcttttcacatagtcccatatttcttggaggctttgttcatgtctttttattcttttttctctaaacttctcttctctcttcatttcattcatttgatcttccatcactgataccctttcttccagttgatcgcatcagctactgaggcttatgcatttgtcacgtagttctcatgccatggttttcataccggattataaatcatgctgctataaagacacatgcacacgtgtgtttattgtggcactattcgcaatagcaaagacttggaaccaacccagatgtccaacaatgatagactggtttaagaaaatgtggcacatatataccatggaatactatgcagccataaaaaacgatgagttcatgtcgtttgtagggacatggatgaagctggaaaccatcattctcagcaaactatcgcaaggacaaaaaaccaaacaccgcatgttctcactcataggtgggaattgaacaatgagaacacttggacacagggtggggaacatcacactctggggactgttgtggggtggggggatgggggagggatagcattaggagatatacctaatgctaaatgacgagttaatgggtgcagcacaacaacatggcacatgtatacctatgtaactaacctgcacattgtgcacatgtaacctaaaacttaaagtataaaaaaaaatttagactttcaccagcagtgtatgagagttagatgctcaatccttgccaaaacttttatattaaagttttatccaccctagtgatgtgtagaggtctcccattatggttttaatttatatttctttgattattgttattaaacatagttttatgtttattagccatgtgtatatcctttttgtaaaatgcctgctcaagtctttttgaccattttatacaaatgatgtatttttcttattgatttgtaggaggtcctcatattttctgggtatgagatctttattggatagatgtattgcagatatcttcacctaccctggggttggcctctgcacatccataagcatgtcctttgatgaacagaaggtcttagttttaataaagtctaattcgtcgattaaaaaaaagaatgatgtgattccaaaccatctgtgtactttttttttcttttcttttcttttttttttttctgagacagagtctcactctgttgcccaggctggagtgcagtggctgtgtacttttaagaaaagtagtgcgcatgtattaaggttcttcgttccttccttctcttcttcccttctctctttctccctctcccatgttggagccaacattctaattctagtcattagttctgactccaacaactacactgttatccactatactctgttttttaagaatgatctggttccaaaccatctgtataccttaaacaaaaaagtaatacacaggctttaagattattctttccttacttatcttcttccctgtgtcttctttctctctgtttctccctttccctctcccaactcccacctatctccaatctcccatctttatctgtctctaccatttccatctcccattttccatctctctcttcctctccctctctctctctgtctctctccacctttcaatttctagatatagagcatagggcttagaaccaaaaagatattatttcaaagcctggttctgtcatttgccaacgatcttatttttgttatgaagttagtgaatgtccctaagactcagtttttccatcttaaaaatggggtaataatacacttgtcagagtgatttttgtttaaattattttgtgtctgggaagtgcctaacaacagcagctgttattatgaggaaattttgttattattactttaggtcaccttggaacctcacttttaatgctgctgtcatctgtacacccagccagtacagcctgattgcattgtggtccctttagtgcttatggaatagcttgcttataagaacttttacaggactgtattcatacaccaaatgtgagtgtctcaaaaaatggcacaagaagcccagtgggacatggtggcatttgtgcctctcagaaccctgaagttatttgtatgtgttgtttttacatcatccagcagcattttaatatgttgtaggacttaatgccataaacagtttctgtttttcaacaaatgtactggatttcttgatttggtttcttagttcattgtcagaagtaacttgttttaaaaatgcacagcaaagttctgtattgatgaatatcataagttttgtgtgctctagtttttgaggacaaggccttctaaatcaggctgagtgcttcaaaggagatcttattatctttatgacaaacatgtagcaattctgaggtctgccatcctcaatacatagtcacacacacatacacacacacactcctacatcatttgcattatttttgtttctttataatagcatttatcatatttgtaacaacctaatttaattcttgctaattgtgtatctttcccatcatactcttaataaaagaagatatattatttcacttcttttcagtttcattagtgcaaaacacaattcctgaatttatacaaatttttttgaaccaatgaatgaatccatataaagaccagtgttttgttcataactatgccttctgtcaatacttggttgtttcttcctcatttttggattaactttgcagaaacttctgatgatgaagtctaccaaagtgcatatttctcagatgattcaaagcatttaaaaaaaaaaaaaaactctagctcttctgtttcattcttgaggatgacttttttaaacaaattaagtaaaaccaggttaggtcattttctgcactttgtcaaagccaatatatgacaatatatgccatatacatgaccaatatgacacccacctctttttctctcagacaataaagttatatcagcaatgctaccaagtgtttaacctttttttaacctcattttttaatttaaaaagctatgcaagcatatagtttttaaaaatcaaaaatcacagtgcaatgacatgtaagtccccatgccaactcagatcctttggcttcaagactagaaataatcaataacttaattgatagtaatttaacagtaaaatatttagaaacatttcactctttttttttaatactttaagttctagggtacatgtgcacaatgcgcaggtttgttacatagatatacatgtgccatgttggtttgctgcacccatcaactcattatttacattaggtatttcttctaatgctatccctccctcagcctcccaccccccaacaggccccagtgtgtgatgtttcccgccctgtgtccaagtgttctcattgttcaattcccatctatgagtgagaacatgcggtgtttgattttctgtccttgtaatagtttgctgagaatgatggtttccagcttcatccatgtccccgcaaaggacatgaacttaccctttttcttatggctgcatagtattccatggtgtatatgtgccacattttcttaatccagtctatcgttgatggacatttgggttggttccaagtctttgctattgtgaatagtgctgcaataaacatacgtgtgcatgtgtctttatggtagcatgatttattattctttgggaatatacccagtaatgcgattgctgggtcaaatggtatttctagttctagatccttgaggaatcaccacactgtcttccacaatggttgaactaatttacactcccaccaacagtgtaaaagcattcctatttctccacatcctctccagcatctgttgagaaacatttcacttttatgctagcctatatgtatgtgtatagttaaatgaattctgtgctcactgttaataacacttcggttatttttccccacttaaaagtaggtatctttaagatccttgttcattagtatatgaggaactaattttattaaaattgctgcatactgtttcactgtaaggatataaatccctaaatgtagtgattaatctactgatgagcattaagattgttttgtgttttgatatttaaaagcaatgctacaataattattatggtaaataatttttatacatacatttatatatctataggacaaattcttaaagtaaaatgttggataaagggtttatgctttgtaagtgaaaatacatcttgccaaattttcatataggttgattgctcaaatttatactactgagaagagtctatgaagaatattgtttatgaaaaatctttttgattttgtcaatctgattattaaaaaagccagtcctttttaaattgtttttgcaggttttttgactaagtaaaaggcttaagatctttcaaatctatgtatttttttttgcccagttttcttttatgtttttgatttttcttactgatttgtaggaatatctcattcagtacagaaatttgctctctttgtgccatatgttgcaaaattcttttttaggttagttgtttgggctttttcttttaactttaccatgttttttatgcagaatttttaaaatgcaggcatagttattactcttttctattaaccctttttaaggcttctgtgttatttgacatacagaaaggatttcctactccaagattaggttaaatattgtaccattttattctaaaatattacaagtttttaaaaatgtttaaaaccctgatccatctggaattatttttttggaagagtgaaatacagatctagctcccccctccctttttttttttttgtttcctgtgtggctagctatttgtcccaacactaattgttgaataatgtatctttttttctatacgttgagatggtatctttatcctatacataatttctatatacatatacacccaaccttttgtgaaaattgaatggaaaaaatgaagagactgttatgattgaaaacaatattatttcattgttcctttttatttgcagttatgcagaagaggctcagagaggactatgccaattaaaatatctaaaaactttccatcatatactatcatgatagtgtgtattacagtaagaactgagatcctagagaagatctaggcaatgataatggcagtggtggagtattccatcctaagaaatgcaatgattacactagaaaagaaggtccatgaacactctccagcaatgttgagagggtgctgaattttatcttccaagtttccgcattatcagacccttcttttccctatagtctcattttgtcctattctcttcctcattcagattgctccagctaccctggaattatttcagtttcctgaacacaccatgctttccttcctttgggaatttattcctctagtttgagtaatttcccttacttacttagaagaatttgctttaaaacaaaatttaaactctaccatatatctacataatattttaatttaaatattaggtagctgcaagataatgtgacaaaataaaaatgttataaagtggatacctttgtgacaacatctaggttaagaattaggataccacaggcatactagaaaccccctattcttcctttctgattccatcccatttatcttccctcagaaataaccattgtctttgagaaagctaaaatctcctgcttattaagaaacttgtgataaatttcagcatatctcagaaacagctaactttgaacagtggtaaaaagtattttttatgaggagtattaccatatttaaagaactcaaacttcttagatgaatagacagttttcaaagataatgattatggataacatatgttttattttctgtgctttttatgaaagatagggacatgctaagcatgcttttccttctctaagttaaaaatcatcgtaggattttagtgtaacgttttgaaaggctgcactataaaaataacactttgtagcaggtacaaataataaggtagaatgagggtgcataatttttatttgactgttagtagtggaagagttgatcattagaattatatctgattttaaatttcaagtcagtacacatttaaactttataaaaaatatctacttcatggttgaaaagattcttctaacatgggtctatattcatacatactatgtctcttgccgatttacgattttgtgttctttctctctaactccagaggttgatgattattttacagactgtagtagaagctaggtatattgttgccttctttcacccacttttttttttttttctgtcacccaggctggagtgcagtggcacaatcatgcttcactgcatcctgggcctcctggcctcaagccatcctctcacctgagctccccgagtagctgggactacaaatgtgtaacttttcttcttttttttttttttttttttttttttgtagagatgaaatcttgctacgttacccaggctggtctgaactcctgggcttaagtcatattccagccttgacctcccaaagtgctgggattacaggctagggcacagcaccagccagcctgtcttctttttttttttttttttctccaagacagagtctcgctctgtcacccaggctgaattgtgcagtggagcaatctccactcactgcaacctcagcctgcagggttcaaacgattctcctgcctcagcctcccgagtagctgagtggtggcacacgcctggttaactttttgtatttttagtagacatggggattcactgtcttagccaggctggtctttatctcttgacctcctgatctgcccgcctcgacctcccaaagtgctggaaaacaagcatgagccaccacgcctggccctgccttcttttttatgtgcctactcagtaatttaggcaaagggctccacctctcagtgctcaggttacctggaggttgaatttatactcaagggaaagaaaagattatctgagaaacagtcatgattcatgatgcaaaaagttttagaattaggggcttggtggaattctttcattttaaaattcttcttcctcctactcttcttctccttttcctccagagttagtaggctgctgaagaaattaccagatgatgaaggtatcaccatggacacagtaggctttgctcctttgtgcctgtggcagagactggtaccaagatctagtgaagggcctgggatgagaaccaagatacgcaggaccccatggagagtccctcctgtccttgcctttattccaaaagaatagtactacatgagcattctgtgagaatttatgtgttgttgcttctagttaaggagtaggataatatgtagagagtaatttataagcctgcgtcttgactattcacaattatttcataaaaataagtaacattattttttaaagatctctatgctcataaaaattggcatcccttattctgaacatgccctcgctgatagtttcctgtatatctagattatgggaatacaaatatctattttcctgtaactgacattcagaaatttaacccactaatataatcctgtgtgtaaccaaaaggtaatggtggaagctgaaacagtcacttaaaattctggctagttcctttaagatgttaattaatatgtcagccaatccttatattggctacaataagccaatgcttatagtaacttagagctactctctaagtcctttttctgtgttcttttttttaactcactactttagcagtagaagatgaaattctgttgcctataaacaaaggtggtgcttggtggccttcttctgtgtctctgtgtgttgtcccttgagagaatcattcaggtttccaccttgtatgccatagggctcaggacaagttctatgaagcctatatagttaaggaataggttttattgggaaaacctgcatagcccaggatcaaaaaagaagagaaggcatggctgcctcggatcctcccatcatcctgtagaagaccatgtcctggctagagtgcttccggcccaggctgatttgtgccaggcagcctgtgtttaggatgccagctgtttaaaagccttttctggatgtgccccagttgcgcagcacttggaggccttataatccatgggatattacagttccctctgcagatgagagggagccacaggaagctgagcttgcatggtccctcctgctaagatacaaggcagcccccatcctggctagcttattgtccaggaaaccacagtactcagtcatttttcaggcagtcctgatgctagtgctacaatgtaggagccaccaagagcaaatgagatcctaaagagacatagaagctagagacataaatattttctaaatggataactatttgagatgatgtctatattaatttgttccactatagtaaacattttatcatatatgcatcttataacatcatgttgtataccttaaatatacacaataaatattattttaaaaaaataattaacaggtattaagcttgatttttttccctttttgggaggggctggagggggtgggtagcttattttaaatcacatagccacacttctaacccaactgtaattccaaatgactttacatgtgttcttgtttctttgtttttgaattactatttctgtttgtgttttaaaaacatttcctgtgttcagtcctagtttctttgggttgctttgcacatgaatgttatcaggacttctcagatgactttcctactcaaactgatttgttctaagctgtccttcaacagctgcagatcagatatgactgttgtcctgtttttgatgttggcgatagtgttgttgctaattaatttgtgaggactcggctggaatatccatgatagccgagtatccatgataccataatgtggtaggaagcattattattcaggtaatgagtttttcatgaggtacaatgccatgttgtaatggaatttgctggtatgtaaaaagggtatttaacatctttgtcttcttttgatggacagaaggctgttaaaggagcaatagttttagttccctttggggtttattatggtcagagtgatctttcagacttggatctgatacaacctaaatggtgaactaatttgaaaataaaaaatatcataagccttgttgtagggaccttgaattggctcaagttaggctcagtgaaaggccgtgctgtgttcttcccaagcacaattgtaattgggagaggattccatttgtattctgtctttagcatgagccacatgttcatgtactctgaaggcaagacaaagaggggttaccagataggacaaagcaacatttacttaattaaaaaaaataagaaagcagaacagaaaaataatcccaatgaataagaagagagggattttaaagttcctctataggcaatttgagaccctgtggtctatctagttttctcgaaattttctgttatgagggcattgaagtatatgactgccaagttggtttaagcaccttgaacatgtcaatggttaatttgatgtacacaaaacctgtttgtgcctcatattttttgggaaaaatccaacccttgtgatgtcatgaatcagcgtttatcatgtattttgaattgttctcaatatttcatttaacagatatttatttaaaaattggtttgacaggatatgcattttttggtttcgtatttttcctttgagaactttatttatttaaaatctctggaaaatgttctgaaacattcaaggccattgataaattagatatatttcagggtttatgtgatctttaaacttgctttaaaatattcacattttaattcttaaaatttattcagactataactcttgaaaagctaaaatgcagaaaggaagttgtttctcatttgtttttgtatcttccatatagtggccattcaacctacttttcttaaatgatattcttttcttaactgaaccacgcaacataaagttgactgctgagtggcaaataatgaataatgcaatgtctttctttaaataagcttgtgtttttcaacgtttacaatttttatatatttgagtataagtgatatatttctgttactttgaaatttttaaaccatctagaattagaaatattgattggaactttgtctttattaatcatgacttaaagtaaaaagtatgtaaatgcatagaagcaatagttacccatttatttgcctgtttgtcctgtttgtatttgttgatagtatctactaaatgaggaaagagaaaaggtgatgcaaaaatgtaagactcgattttggtaataattaggatagcccaaattaatctagttttaaaaattgatatttaggggttgagttggctctgaattatttgcaggtttctaataaaagattattttaaaacaaatgttcacaagtgaatgaaatattgtttaagagactggataaaaaataatatttacaagactggaaaataatgagataggtcatgagtagacctgtcactttaaaattatatttatgcatattttcatttatttttcttctcaccaaatatgattataatctcaatattattttggatgctgcaatttttgttatataaataactttatatcattatatcaaataaagtgatgaactaagtgaatattattcaaacattttccaaagctgatagtttgtaagtatgcttaaaagtatatcatttgaggatcctatttcagtaacacatatttaaactcaatatattaaagtttttcgagatactataaagtttagtttggccaaaaaacctattatcatttagataagaaatcagctaatcagctgagatttttaaaagtaccttctttaaaattccagcactttgggaggctgaggcaggcagatcatgaggtcaggagatcgagaccatcctggccaacatggtgaaaccccgtctctagtaaaaatacaaaaattagctgggcatggtggcatgagcctgtagtcccagctactcgggaggctgaggcaggagaatcgcttgaacccgggaggcagaggttgcagtgagccgagattgcgccactgcactccagcctggtgacagagtgagactctgtgaaaaacaagacgaaacaacaaaaaaaaaaacacgttataatattattgtgtaaaataagttatttttaaaaattcactctcttagtatgcattgctaaacatgactcaatacaatactgagtttcagcttaagtttattttaatagtctgaagatattgtgatgttttaaaaactcatgatatttaagaataacttgtttctttttagttgcattttaaatctgtgggtgattccagtaggatgtcaaattaaagtacttgaataagatgattacaatctttattttttatattcgaatctgcagtgaggcaataatgaataccttctgtcctaagcacactgatactctaaattgcaaattttgaatgtcattctgtctgaaatatttaattgaaagaggaatgtaattgacatataatttccaaataagttttgtttggctatataatacattaattcatgcctttgttctttttaatttatcttcattatgctatcaataagaaatgtttattgcttctgtttaaagtattactacagataatgggaatcctggaggcataagatatagaacttagtctactgggcaaattgtgcatgaaaagataaacccatggaagcccatactaatttgtgtcaaattaataatgcatgtcccaaaattaaataagcattgcagaaaatagaagggtatttgggtcactggggtctgagagtagtcaatgaacttcacattcttggattatacttgcatagaaccttgtttcaacaaaaacaaggaggaacattttccaagcagtaggaatctgggtaaagttgtggcgttaggaatttgcctggaatggttagaatggcctgcaatgttaggacatagtaagatgcaaacctggtgtgagagaggatagactatgtagtgtggcactaggagatgaggatgaagaagtgtcaggctaaagtgtttgtattatgtagctcatgaatgtctttaagctgtgagcgacaagttccaaagaaccagctgtgtcagataatcagagggtgagctctgtgatgatctgggttgaggtaatatgtttcaaaatgccttataaaataagagtttatgctacatattttgattggtgaaactcagaatatataaactattaataaaattttgtattttctgaatgcaatattggattactcaaggagcagaggaagcataggaataacacatcagcaaaagtggttaccctcaacaatattttgtgaaataatatgatatttttaagaaaggtatcaaagtagtcacaaatggaagcatcagagctatatcatttttaaaatttaatacatttattttcagttgcatataggaaggggatatattttcagtgcttgggtcctctaaaaaatttatctaatcccatatagatacaatctttaatgaaagggctcctagcctacaatgtgctagatgactaagaaaatcagttgactttctgaagaaactagatattggtgtctgtcagacattatgccacactacctcggaatcttgttaaaatgcagattctgatttcagttgctctgaagtggagccagagattgtacatttctaaaaagcacttaggtgatattcatgatgttaatccttggaccacacattgagtaatacaatgaaattttcaacaagttagtctcttaatgtacataaacaaaatattataccatgttgttatgtgttggtttatactcaaagtactgttctaagattctatccaatatttttaaaaagtgaaggatttaacatcctcttacacatttttatgttgttttgtcactgctgtgaattataaaaagttttaaaagatactgtcactgctgtcaagaaatttctatttaactcccttcaagatggctaactagacacagacaggaagagtttctcccactgagaggccggaccatcaaaaagatgcacaatccaagcagatcttctgaaggaagtaatagagaatggaaggaggaaggactcagatcctgggttgaagggggagggagcagagaaccctgcatgtggttatttagtagcaagacccattcttggtcctgtgtgcttcctggagaaggggtgagttaaataggcatggtttgtggcccacatttgccacagacctccagaatcctagcagcaggagaccccatgacccctgtggacatttaggctgggagagattgctgcttggagagtttgcagggtcacgactcagtattatgaagcccagagagtttggtgtgggaactgctacagtggagtattgccagttacactcacgcctcaagactcgccaaattcctctgggtggctttggtctttgttgactgttggttctgttcagaacagggctatcttgcccatgggattgggccaatctaatctgaatacccccttgtctgccagcctctctcagtgtccctgtctggccacaccctcttgcagcacagcctcagatgttcatatggggcacatcttaaaagccactaccatagcttttttactgacagaccttggctaaccatcagagatattttgcagatgggccccagccagtgtgtaaccacatgcagcctcccccacaccactttgccagcatgcgttcatctgcagcatcgcccaccagtttgccagcatttgcagaccctgctgctgtacccccactggagcatgtgtatgtgtggaccctgctgctatgccagcgctggtgcacatacatgtacatggactcaactgccaccactctgacaaagcactgttgctgcccaccccccataccccccattggagtgttgttgccagcagactggggacacattggcccctccagtgatagcaggtcagagaacaaagccatgggtctagtcccagcacctagggttagagcatgcagaccaagagtgctaaactgagccttggccccctgaaatcattgagaaatgaagccagttgatggaacccaacttataccatagtcaaagggtcaaaataatcaaaaaatataaaagcaaaaagcttcatccaaaggacagcaacatcaaagattaaaggaacatcagcctaacagatggaaaagaactagcacaggaatcctggcaactctaaaagccagtgtcctcttcctccaaacaacccactagctccccagcaatggttcataatcagactgaaatggctgaaatgacagatatagaattcagaatctggatggcaatgaagatcattgaaattcaggagaaagttgaaacccaatcccaggaatctactgaaatgatttaaatgctgagagatgaaatagccattttaagaaagaaccaaactgatctaatagaggtgaaaaactcactacaagaaattcattctatattcgaagtattcacagcagagcagaggtaaggtgaggtaaaaatctcagagcttgaagattaattctgtgaatcaactcagtcagacaaaaataaagaaaaaagaattttaaaaaaggaagaaaacttccagaaaatatgggattatgtaaagagacaaaacctatgactcattggcatcccttaaggagagggagagagagaaagcaatgtgaaaaacatttgaggttattatccacaaaattttcacaacttaactagagaggtcaacattcaaattcagtaaattcagagaatccttgcaaaatcgtatacaagatgaccatccccaaaacacatcatcgtcgtattcttcaaggacaatacatgcaaaagaaaagatatttaagacactagaaagaaggggcaaatcacttacaaagtgaacccaatcaggctaagagaggacctttcagcagaaattctataagccagaagagattgggagcctatattcagcatcgctaaagaaaaaaaattccaaccaagaatttcatatccagccaaactaagcttcctaaacgaaggaaaaatataatccttttcagacaaccaaatgctaagagaattcattaccactagacctgcctttgaagaggtccttaaaggagtgctagacatgaaatcaaaagacattactggccaccaaaaaaaaaaagaagaaagaaagaaaaaagtaaaaccactcatttaattacatgggttattgatactataaagcaactacacagtcaagtctaaacaaccagctaacatgatgacaggatcaaatacacatatatcaatattaaccttgaatgtacatgggctgaacaccccatttaaaaggcacagagtggcaagttggataatgaagtaagacccaaatgtatgctgtcctcaagagaaccatctcccatgcagtgacacccataggctcaaagtaaagggatagagaaaaatccatcaagaaaacagaaaacatgaggaaaggtagctgttctaatttcagacaaaacagatttcaaaccaaccaccatcaagaagcacaaagagggttattacataatgataaagggttcaattcaaaaagaagacttacctatcctaaatatatgtacacccaacactggagcacccagatcataaaacaagtaattagagaccaattaagagacttctataaccacacaataatagtatgaaactgtaacaccccactgacagtattagacagaatatcaaggcagaaaaccagcaaagatatttgggacctaaacttgacacttgaccaaatgtgcctaacatccacagaacattccatccaacaaaaagagaatatatattcttctcatatgcacatggcacatacactaagatcaaccacacactcaaccataaagcaattctcaacaaattataaaaaccaaaattataccagccatactcttggaccacagtgcaacaaaattataactcaattacaagaagatctctgaaaaaacttacaattacatggaaattaaacaacctgttcctgaaggacttttggccaaacatgacattaaggcataaatcaataaattctttgaaactaatgcaaacagggatacaatacaccagaatctctgtgacacagctaacacagtgttaagaggaaaggtgatagcactaagtgcacattaaaaagttagaaagagcttaagttaacagctaagagctaacatcacacctaaaggaattaaagaaacaagagcaaacaaagcccaaagctggcagaagaaaataaataaccaaacttagagctgaacagagtgaaatggagtattgaaaagtattataaaaaatcaacaaaaccaaaagtgatgatttgaagaatatataagattgatagaccactaggtagacaaataaaatgagatggttcaaataaacacaatcagaaatgacaggggacattaccaccaacccacagaaacacacacaaaaaaatagagagtattatgaacaactctaagcacacatagtagaaaacctaggaaaaaatggataaattcctggaaacatgcaacctcccaagatagaactagaaagaaattaaaacccgaaaagaccaataatgaattccaaaattgaatcagtaacaaaacacctaccaacaacaaaaagccctgatccagacaaattcacagccaaattctattagatgtataaataagagctattaccaatccttctgaaactattccattgacttgagaaagcaggacccttcctaactcatgctctgaagccagtatcactatgatagcaaaaccttgcagaaaccaaacaaaaaaagaaaatttcaggccagtatctctgatgggcctagatgcagaagtgctcaacaaatacaagctaaccaaatccagcagcacaccaaaaagctaatctaccatgatcaggtaggttttatttgtgagatgcatggttagttgaacatatgcaaatcaataaatgtgattcatcacataaacggaactaaaaacaaacaccacgtggtcatcccaatagatgctgaaaagtctttcaataaaattcaacattccttcatgttaaaaaccctcagcaaactagtcatcaatggtacatacctcaaaataataagagtcacctattacaaaccaacagccaacatcatactgaatgggcaaaacctggaagcattcctttgagaactggaacaaggcgaagatgactgctctgaccactcctattcaacatagtaatggaagtcctagccagagcaatcaagcaaaagaaagaaataaaaggcatccaaataggaagataggaaatcaaactatctctattatgtgattttgtacttagaaaatgccatggtctctgcccaaaggctcctagatctgataaacaacttcagcaaagtctcaggatacaaaagcaatgtatataaatcagtgtttctatacacaaataacattcaagctgagagctaaatcaagaagacaatcccattcacaatagccacaaaaagaagaagatgcctgagaatacagctaaccaaggaggtgaaagatttctaaacaagaattacaaaacactgtccaaagaaatcagaaatgacacaaataaatggaaaaacatcccatgctcatgaataggaagaatcaatggccgtactccacacagcaatttaaagtttcaatgctctttgtaccaactacccatgacatttttcaaagaaacagaaaaaaatattttaaaattcatgtggatccaaagaagagcctgagtaatcaaagcaatcataagcaaacagaacaaagccagaggcataacactgccaggagtcaaactacaaatgctgccgtaagcaaaacagcgtggtactgatacaaaaatagacacatagaccactgggacaggttaaataacccacaaataaagctgcacacctacaagcatcagatcttatacaaagccaacaaaaacaagcacaagggagaggactgcttattctatacataatactgggtagctggttagccatttgctgatgactggaaatgtactccttcctttcaccattgttttagtccattctcatgctactgtgacttagactaggtaatttataaagaaaagaggtttaattgattcacagttccacatggctagggagacctcaggaaacttacaatcatggtggaaggcacctcttcacagggcagcatgagagagaatgagtgccagctggggaaattccagatgcttataatccatccaatctcataagaactcatttgctatcatgagaacaccatgggggaactgcccccacaaactaatcacttcccacaagattcctcgtgtgacacaggaggattatgggaactgtaattcaagatgagatttgggtgggggcacagccaaaccatatcattttgctcctggcccctcacaaatctcatgtcctcacgtttcaaaacacccaagtcatgccttcccaaaagtcccccaaaaagtcttaactcattctagcattaactcaaaagtccaacttcaaagtctcgtctgagacaaggcaagtcccttctacctatgagcctgtaaaatcaaaagcaagtttgttacatcctagatacaatgagggtacaggcattgggtaaatgcacccattccaaattagagaaattggcaaaaacaaaggggctactggacccatgcaagtctgaaatccaacaggccagttattaaaccttagagttctaaaatgatttcctttaactccatgtctcactattgcaagaggtgggctcccatggtcttggagacctccacctttgtggctttgcagggtacagcccccctcctggctgctttcacaggctggcattgagtgtccctggctttcacaggcacatggtgtaagctgttggtggatctaccattctggagtttggaggacaatggccctcttctcacagctccaccaggcaatgccctagtggagactctgtctgggggctccaaccccacatttcccttctacacttgccccagcagagattctccatgagggctctgcccgtgcagcaagcttctgcctggatatccaggcatttccatacatcctctgaaatctaagtggaggttccccaaccacagttcttgacttctttgtaccctcagacccaacaccacgtggaggctgccaaggcttgaggcttgcacactctgaaacaatggccccagctgtaccttggtcccttttagctggagcagctggagctaaagcagctgggatgcagggcaccatgtcctgaggctgcaaagagcagaggggcccttgacctagcccatgaaatccttttccttcccaggcctccaggcctgcaatgggagggttgcgattaagtctctgacatgccctggagatgttttccccattgtcttggtgattaatatttggtgccttgttacttatgcaaatttctgcagccagttttaatttctacccagaaaatggggttttcttttttatcgcatcatcaggcggaaaattttccaaactgctatgctctgcttcctcttgaatgctttgcagttagaaatttcttccagcagataccctaaatcatctctttcaagtttaaagttccacatatccctaaagcactgcacaatgccaccagtctctttgctaaagcatagcgagagtcacctttgctccatttcccaagaagtttctcatctccatctgagaacacctcaacttctacctcattgtccatatcactatcagcattttggtcaaagccattcaaaaagtgtctaggaagttccaactgtcccacatttttctgtcttcttctgagccctctaaactgttccaatgcctgcttgttacccagttctaaagtcacttccacattttcaggtatctttacagcagcacccactcctggtaccaatttactgtattagtccattttcatgctgctatgaagaaatacccaaaagtgggtaatttataaagaaaagaggtttaattgactcacagtttcacatggctagggagacctcagtaaacttacaatcatggtggaaggcacctcttcacaggacagcaggagagagaatgagtgccaggccagatggggaaatgctagacactcataaccatcagatcttgtgagaactcactcactatcatgagaacagcatgggggaatctccttgacaatctaattacctcccatgaggtccctccaatgacatgtggggattatgagaactacaattcaagatgagatttgggttggggcaaagccagaccatatcaaccatatataaaaattaactcaagagggattaaagatgtaaatgaaagacctaaagctttaaaaatcctagaaaaaattccaggaaatactattctgaacatcagccccagcaaaaatttcatgacaaagactcccagagcaattacaacaaaaccaaaaattgacaagtgggacctaattaaactaaagagcttttgcactgcaaaagaaactatcaacagagcaaacagacatcctacagaacgggagaaaataatttgcaaaccatacatctgacaaaggtcaaatatctataatatataaggaactgatatggtttggctctgtactcaaatctcatgttgaattgtaattcccactgttagaggaggaacctggtaggaggtgattggatcatggcggtggatttcccccttgtttttctcatgatagtgagtttttctcatgagatctgatggtttaaaagtgtgtggcacttcccccttcactttctgtctctcctgctgtcatataaagatatgctggcttccccttcaccttttgccatgactaaaagtttcctgaggcctctcagccatgcctcccatacagcctgtggaactgtgagtgaattaaacttattttctttataaattacccagtatcaggtatatcttcacagcagtgtgagaatggactaatacaggaacttaaacaaattaacaagctaaaaaaaacctcataaaaaatgggcaaaggacatgaacagacacttcacaaaagaagacatacacagggtcaacaaacatatgaaaaaaaatgttcagcgtcactgatcattagggaaatgcaaatcaaaaccgcattgaattttgctctgacatgagtcagaatgcctattattaaaaagccaaaaattaagggatgctggtgagattgtggagaaaggggaagacttacacagtgctggagggaatgtaaattagttcagtcactgtggaaagaattttaaagattcttgaaagatcttagaactatgattcaacccatcaatcccattactgggtatatacccaaaggaatagaaatcattctactgtaaagatacatgcccctgaatgttcatctctgcactagtcaccacagcaaagacatagactcaaccttggtgcccattaacggtggattgaataaagaaaatgtggtatatatactccacggaatactacacagccataaaaatgaatgaaatcatgtccttgacagcagcatggatgcagctggcggccattatcttaagtgaattaatgcaggaacagaaaatcaaataccacatattctcacttataaatacaagctaaacatttaggacatattgacacagagaagggaaaaattgacaacctgagcctacttgaaggtggaaggaaggatggtaaggattgaaaaactgcctgttgtgtactatggtctctacctggtgatggagtaattttacaccaaaccccaatgtcacacaattcacccatgtaacaaatctgcatatgtataaaatttggaagaaacaaaagaaaaaataattttccacttaaaaggggagagaagacacataattggggatataaggctatccatattgtatgtagacagtgtctggagtgaacagataaagtaatataacagggctgatgattttgtccatcattttcaaataacatcattattagtagtagtattttattttattttattattattttttgagacgaagtctcgctcttgtccctcaggctggagtgcagtggcacgatctcagctcagtgcaacctgagcttccagggttcaagtgattctactgcctcagcctcccaagtagctgagattacaggtgcccgggattacagctaatttttttgtatttttagtagaggttgggtttccccatgttggccaggctggtctcgaactcctgacctcaggtgatctgccgccttggcctcccgaagtgctgggatcacaggcgtgagccaccgtgcctggccaattagtggtattattaatcaaggaaaggatagtccctaaaatgtctgaagtatagagatcatattacgtattaattaggcatgcgactatgctaggtgtgttatattagatctagaattccagcttggattttgtttagtggcaatggaccccaccactttaaagccttttgagatagtagaggagagtgggaaggtactgctagagagaggatgatcaaccgacacattaggaaaatgggtcttgataggggtatggtataggtaatactggtgagagtctgaagatagttgggtttttgaggagactgctgtaaacatccagccatgagataaggaccaggaagaatgcaaagccgtgggaattgaaagacactgatacaagactgatttatgaaggttctactttttaaaattagtttctttatagtggtttgaagtgcttggacgaagaggatactgccggcagttgttttttttttccatttgtttgcatattttatattcatgctatgcaggtgtggaagttcgagtgtatggttagtgttcaggttgctgccagtctcagatattctagagtttagcagctgcatggtgattggaatcctgctgctttttcctcactccgaacttgagatcccctgtcaaactagtctcttcattgccccaggctttctcaaatcttcccactgcctctccagtaggtttttaacagtttgcaagcactggtgtggtggtgggatggaggggtctggggtagggaaggctggggtagcgtactttctaatcctgatggaagtgaaaggtaatgaaagagaaaaagctacttgatctcccgagaagttcttattttcctgttttcttcaatatgaaaatttgacaggcttttaaaaaaatctctttttgaggaaatctcactccatattccctgctcttaagtgatgtttacatttatttattttattattttctttagaccagttgaatattaacatactgaagtaaaattttttaaatgtcctactaacaatcttttgttgcaatatataaagttaataaaatatagcttttaaaaacatttaactaaaacatcatggagatattaagcagtggatttaacataactccagaaagcaagaaaaacagctttgtttgcattttcttttatatcttgagatgagaaaaccaaccataatcctctagaaacctctttgaacaaggaccctacttttgagagaatgaggttaacagacgcgtaattcctttgtagtaactgttcggtttctgtgcccactgtctggtaatctgatgtggatcttgctactgaagagaatcaaagtaggttgtagaggtacgtctttaggttcttttgttttttaacagacaaattgctccttactcaactattttgtttttctctttaaagagagaatgtgatttcacattcttatttgtaaaaaataaatcttattttctacaaaaaagttaatcttattttttacaaaaaaagtcctattttttacaaataagattttaaatcttattgtttaaatcttctttcactatcttagtgaaatatagtaagtctttatttgtcaaataaattgcagtgcctcttgcccagatacacacctcctgatgttataacaagtatccagaaatataattgtttaaattacaatcacccctgcatctccagctatttaacgcacttcatgaataactttgaaatggtcctagtaactaagacaataaatacttttttagttctctgcttctgtctctacctatgctttgccaatactgctgtggcttttatgcttctacatattttctcattacaaagaattttgtcatggttatattaggtcaaacacatttctaggacttttgctatttatcaaatggttttatatatcttaaccataggtcagccttgtcgatgtattgtggctttatcctaattcatcactgctatggtttagatatggtttgtttgtccgcaccaaatcttacgttgaaatttgatccctagtgtggtgatgtttggagatgttgcctggtgggaggttgtttgggtgatgggggcagacccctcatgaatggctcagtgcccttctaggtcagtgagttctcacccttattactggctcagttctcgagtgcatggattcatttccttgagagggggttgctataaagccaggatgccctcaggcttgatccctctgtgcatgtgtgcccgcttcccctcggaccatctctgccgtgttttgatgccgcccaaagaccctcaccagaaaccaagcagatgctgacaccatgtttcttgtacagcctgcagaaccatgggctaaattaaaccctttattaactacccagtctcaggtatttctttatagcaacacaaaacagactaaaacaattgtgtagaaaaaaatttttttttctaaaatgcattgtattctcacttaaataactaattttacacatgcttgtttgaagaataattgcttgcatgattaccatcaatatggtaatattattagaccttaatataaattttaaaacaactaattttccattctctttcttttccatactcttctcatgtattctttatctctgtgaatggcaacatcaggtactccatcacccagcccagaaacctgggcaattatcttttgcttcccgatactcatacagtcccccaacaccccaccaccaccaccaattatttatgtggttgatcttatatccttaatatcacttggtcccatcactaacttcctgtgtcaccacttggtcccctcttccttagttcaagtctgtatcccttctcccttagatcactgcatttcccacctaattagtctgctatgtttagtctctctggtttttaagcaggcttacccctcaaaataacaacctcgtttatctttccctggtagaatgtctcttagtttttacaactacaatttcataggtgcttcacttgatgtttgtatcagaaaattttataaatttcttattcagtgtagctgcatcagtttgagcaacgactaaaggtttttgcatctctcatgtcactaacgctatgagaggcccttttacttttcacaaaactatgtggtttagcaatcatattgtttgatcagtaaattagagcttgtagatattttagataagctttaggaaaatgttagggatttgcattgatttattttgcattataattatttacacttaaaataatgggagataagccccaattagctttgtactgaggaatattagaacatcttactttcatgagttattgacatttagagtgagactcatatactttctctacaatgttgcctgtgagatcttgctaaaatataaattcaaccctcctatttctcaggttaaatttttttctctgggccaggtgcagtggctcacgccggtagtcccagcactttgggagggtaaagtgggtgcatcactcgaggtcaggagttagagaccagcctggacaacatggtgaaaccctgtctctactaaaaatacaaaaaaaattagcagggtgtggtggctggtgcctgtagtccagctactcgggaggctgaggcaggagaattgctggaacctggggggcagaggttgtagtgagctgagatcgtgccactgcactccaacctgggcaacaaagcaagacttcatctcaaaatatatatatatatatatatatatatatatatatatatattttttttttttttttttcctctggctcctccacatccttttgattaaagtttaaactctctgttgcttgaagaaagctttctatacctctccttgacttttcacactgccccttcaaagcagtctttctccgttcaggaccatgtgtatctgaatcacctgagatgcatattaaaaatgtgagttcccagacaatttcccagacattcagaatcagaggttctgggagtctagcctaggaatcttcacccactgcataagttattggtcaggacactcacctaagcaataacttatgaagtgtgtatgtaattcctctaagaaatctattgcctcttctcctgtcccctactcagtctgtcgagatgcttcaaatctgggctcatgcttgtccttgtgcatgtcttgatctaaccccttccacaccatagtattttcagttatttacgtgtttttttcttctcaactctttggtatattcttaagagaaggagccatgttttattcagtgttgtgtcctccgtaattggtgtagcaaatgtccaagtacatttgcctgaccaataaatgggtgaaagacatctgccaagatggtaaaaattggagatgggacctctgtttatttgatgttatattaccaatatttatgtagcatcttctctcatattttttatcatatacttaagatgatgggtttggtcaccagaatcttgtcctgattcacaatcccaatatgcatatatcagcattatttacaaagtcttagctaatgggccatggttaatattgcactaagaaacatttgcttgtgcctacactttttattttactgcccttactaccaccactagtaacatgccccaaatagtaataatacctaaccagcatattggagagtttttggattactattattttcatttataatggaattcctgttttcactgaatcaatacagcctgatcttttcttcatatcctaccaaatatgaggagagaataaatagaaaataaaaaagaattgtttttcttgtcagtttccatggcaatggagctttctatttgtttaaccagtaaagaatgttcacacaacctgtttttcttttttttcccccgtctcacactctctcacacacacatacatatatacaaacatcataaaagtttattctgtcaaatctagccaaaactataatatgttttaatgctttttctactttagttaatttgtcttacccagtgctattttacttataataaaaagataaacactatgtaaattcgcatgtgtgataaatatttagaaaatgtgagaggagcaaatatgtgatattttcaaaatatactacagctctcagggttatgaagactttcactttgctaattggggtttcaataaaattaaaaaggagatagtcatcatttctattgtttacgcattgtcttgccaatatatgtaattatgtgccatctattggaaagatccatacgtagtcagatccatggagtacaggactaattaactgaaatcattattctttatttgtatgaatgaattaggtcatttgctgggaaggtagattaaatttcttctgtgttctgaaaggccgacattgctttttgaaataccctccagggagggctggatgaattcgacaatttgatttacagtattaatgtagaaaataatttaattctatacccaggggattaatgaatatctatttccacctatactagcttgttattctcagtaattagggtttaccatggcaattattgaactttaattttcatgtgtttgtgagtcacactattctgtagcatagttacgttgttagcatatattagcattaactacatgatgttagtaagtagtcatgactaagtattgtactaagaaactcctttggtttctatacataacattacatttggattgctgctgttaataccaccactaataatgtgcctaaaatagtgaatagtaaatagtaaattatatatatggttgcatttgatcttagcaaagttaaaagtatctagataagtctttgagagtagtaccaattctatttattctgtcaatgacatcttgccttctttttgtgaccctgtttgatcaactgtaacttataatttatttttaaaaatacatttttgaccagggagtgaaatgataaacttaataaatgacaatatcatcagatcatttaatgattttacatttaacagttgctaatttattcagataccttccatgaaatcacattatttaaatgttgccttgctaacttgcctgttattttggaatatatttaaaaattaatggtatatgtaccttacagtgaatgtaaggtaaatataaaatagttatttctcatcttgcttttgtgtgttcagttttctaaaaggggtccatgaaacttccagtaaaatgtgaaatttaattcacctaaaattcggagtataaaaatatgccctatatttgttatatctggggaaggggtaaagttaaataatgatggactcataaacttgagatagactgagaaccataaacaatgactagaatgtccttggatattcctagagaagacctctcaaaattattgaaacatttcataataacttctagaatgttccaggtcagagtgattttcactcttagataatgaaaccttcaattctttctttagaagtgggaaaaatctatacagatgagtgtatagtccttgagttttgtttcttaggttttgttttccctacaggaaggaaaaaaaagaggttatagttgcttacagatgttaggaaacccagttatagggaatctagtcaatggtaagggatttttgagaatacatttcttctccagaaattacataaggaagaagggaccataacctagagtttgattctgatcatgctatacttttactttttcagaggtcagtttcccagcttgcctcacagttagtattgggaagataaatataaagcaagaataataatacatgacaatataatgggaaagaaatttcataaatgtttgaagggtgagtttcatcagctatttaaaactaatgtgtttaaagtacagaggaaaagagcccaaccaaggttcggtgagagctaatcattgggcctaaatgtcttcagatttacagtttttcagtaaaatgtgcgtaagaagtaaataaagaatactgaagtctaaaaccatcatcacagggttttaaagacagttctgagtacagtgctgaagaaattaacacccagggcttacatgtaacaccctccacccttttctgttttttttggtctcatgtattaataaagtgtacagagaggaaaaatgagtaagacggtttagcctcagataggaggaaatgcttgttctctaaatacacagcattatagcacatattatttaaacataacacagtaagaccattccccgcccccccaatagctcttcaaagggaaatacaagctttttggcatgaactacttatcacattttcctaatactaggtattggtagcaactcttaaagtttttaaacagtttattccacttaaaatatgcaatcaatgtagacacttcttctgggtagtacttatatctcctatttaataatcagatgttgtcctcatccttccctatgattgatggtcaaaaaaaaaaaaaaaaagcctgtcttgcttttttaagggctttctccttgcctgttttgtaattgtgtaacccccacccccagggagaatctaaattctttccacattagaaataaaatatcaagttcttttctctagcttttccattattgatataatctaatttaaatgagtttgataagatttaaaaatgacagttgttcatccaaatcttttaaatatagaagcccattgcagcagtctgtattttactgagcctttacttgattaatgtaaggaaagtgcctttcctgcttcgaattttcgagcaattagtttgggaagtgtttatttgtaggaaaaaagaatgtgcagactctgaccctgactttctgcagtgtgctgctctttcatggtgacatctaatctgttttaacccctattaaggacaatacaagatagtcattcaaattatgttttacaaaatgtacttttgctgatttcatattgacaatatggagagttaattttcttctgcgtgcttagagaagtggtcagagattagaaattattggtaaacatgaatagcatgaaaaaaaattggacaaaacattgaagcagcgttcataaatgatctacaatttgagatagactaattcagactgctccctaatgtcactttgtaaactacagtgtataaacttatgttggtaataggacaattctaaaggtattttatattattgagttattctaaaggtattttatattataagttatctgagttttaatgttgcacaggatcaaaagtgacagtggctgggctggaattgagttcagttttattagtctatttttattgattcagcaaatgtttgatgagtgattgatttatggcataaggcaggttatatagtggaaaatagaaagttcttcccttgagaagtattttcatataacacatttttctccactatgtaaaacttattttcagtgttgtattagggtcctttatggattagtgttatgaacatctctcaggctggtcagccccttaatttggctttgtatgagagagagtggtgaaaggatcctaatttggatttggtatagggatcagtgaaattttctctaaggaattaacctttaggttgagacctggtgaaattagccatatgaaaaatccagcaaagagtgttctgtgcaaaagaagcaacatgcaaaaggtacagtgctgggaaccagctaagaaagaaggcctgtgtagtcagagaaggaagtaaggaactcagacaagctggagggccaacaggaggagccagatcaggtggggttctggctcacaaaatagatgtgccctataacaaaagaagccacggaatcaaagagaaacagtgatattgtcttagtctgcttgggctgctctaacaaactaccataaactaggtggcttctaaacaaccaaaatttatttctcactgttctggaggctgagaagtcccagatcaaggcaccagtagatttggtgtctgttgaaggcctggtttttgagtcatagacagctgtctttgggctgtgtcctcccatagcagaagggccagggaactccctgggatgtcttgataaatgtactaactccattcatgagggttctgccttcatgacctaatctcctctcaaaggccccatgcatgtccaaatatgatcacattgtgcatttgaattcagcatatggaattgaggtgggacacaaacctgcagtctatagcagatatcatctggtttgtgcgtaattcgttttgaccaccattgagaatggattgaaaggccaagaatgaaacaagaagaggccagttttattaacatggatagccccttgcaggcatttaggtaagagattctggtgactctaaggaccagtacaatgaagatgaaaagtgaagtgatgtgaaggaaatttcataggaacttgttgcctcacaagaccatgttaccaaggagagttacttgtttgtatatattttttctgatatttctgatctctgcagcccaccctttctttccttgaaatttctgcatgaccatggattccttagcagtttcttatagcattcatagattgaaatgactatttatctgtagtatctcctcttaattaccaatccaacattttgaaaatcatcacattttatttggaaaagtaataaaatgggactaatgaagtgattaaaatgtaaactgccttcaccataattaaatactatagtaaaggaagataataattttcaaaataaattgactgcttgttgaaaacactggtaagcaggatttccttcaatagaattcattgtttcacatcagcaaaaaatattattatggactctcaggtgggatctataaatagcagtgatttattttaccagtattgatgtaaatatattttgccttgtaattctgaacctaatttgcattcttataagaaaatcatgcttacttacttctctgaaaatgggatcttactgcccttaaaattgtatgtaattgtttttggcattttatattacattgtgttttaaaaagtaagttgttttaaaacaaattatcataaaaatttgccttccttctgcaagcttggcatattaatctatttaaatttgaattaaacaataacatgtaattaagtaaaattcttgtaacattttattctgttaccacatttttaaaaatactgacaagtttacttttctgtaatttgagataaaaatattatttttcccaacggccatgtgtgtgtgtgcattcacacataagtacataggtaaatctaatttaaaatagtggggagtgggatgcctagtgctgtcttttcctgtgtttacagccatcatcactagggtgtcgcaacctcacgtgacttgcccttgcagcctctaggaacactgactaaatttgtgccccaaaggcactgtagtagcaaatgcagcctttctggttctctaacactatggtacttcctgagacacagggaaggagtttcatgctggcattaagaagctctgccatggcactgaactcagcaaattgtataatgtgagtctaataaatctacagcatataaaggatttactctttcatttgatatctagaaatgcccaaaccctgaacaactttgtaaaaggagaatatagctaggaggaagaatagccacaagtctggggtagtagagcacctcaacctctgtgaacatttatgtcacctgtaaaagaaatatgataataggcttaccatgaggattaaacaaggcatgcacaatatcagatgcataattgttttttacatcttaatatatattttttaattttattcttattatactttaagttctagggtacatgtgcacaacatgcaggtttgttacatatgtatacatgtgccatgttggtgtgctgcacccattaactcatcatttacattaggtatatctcctaatgttttccctcccccctcccccaaccccacgacagtccctggtgtgtgatgttccccttcctgtgtccaagtgttctcattgttcaattcccacctatgagtgagaacatgcggtgttgcgttttttgttcttgcgatagtttgctgagaatgatggtttccagcttcatccatgtccctacaaaggacatgaactcatccatttttatggctgcatagtattccatggtgtatatgtgccacattttcttaatccagtctatcattgatggacatttgggttggttccaagtctttgctattgtgaatagtgctgcaataaacatatgtgtgcatgtgcttttatagcaacatgatttagaatcctttgggtatatacccagtaatgggatggctgggtcaaatggtatttctagttctagatccttgaggaatcaccacactgtcttccacaatggttgaactagtttaatggccatactgcccaaggtaatttgtagattcaatgccatccccatcaagctaccaatgactttcttcacagaattggaaaaaactactttaaagttcatatggaaccaaaaaagagccctcattgccaagacaatcctaagccaaaagaacaaagctggaggcatcacactacctgacttcaaactatactatgaggctacagtaaccacatggtactggtaccaaaacagagatatagaccaatggaacagaacagagccctcagaaaaataccacacatctacaaccatctgatctttaacaaacctgacaaaaacaagaaatggggaaaggattccctatttaataaatggtgcttggaaaactggctagccatatatagaaagctgaaactggatcccttccttacaccttacacagaagcatactttttaataattatgaactattattacaattactattttggctaagcatccaacatgtcacctggtacataatagctgcttaattaaattagctgtagtgaaaatgacaacttattatctcacataactgaaaagtataggggtggtcctagtcctgggctcatctggagagggtgctggaaaaaatctctgtctctgtctctctctttctttatttctgtcattctctctcttattactttttgtattgtctatttttatctcactgtttccatatcatttctctatcttttttcttttgtccctttctaaagctctcttattatgttttatctcattatcattctcttgctgcctctgtctctcttcctcttttctctctgcctctttgtctctcccccacatctgcttctcctactgattcctcaccacctcatatctctctcttctttttccctcctcctctctgtctgtccttctatctttgcttctttatctattctgtcttcttccctccttctttcctgtgtgttggatatgattcttgatagactgtcatcagtgccggtggccccacagaaaagaaattactacttctctcttacccccagccaaaagccagttgccccaatcgtcacagaagtgagtaaagtgctatttgccgaggtctggagccagaagctttgttctacccaagtctcttggactcaaagggaattgtgtgtgaaaacaataactactgtagcttattagattaattattatttagcaggtctcatgctacacattttaataatcttatttcatcctcataacatttttaagtgttaagaactatgctatcctcattcaacaaatcaggaaattgaggtttagaaaattaagggtctttcacaaggttgtatatcaactaagcaactaagctggcattattaatagaatatagactgtctgccccaagccctgtactgttaatgccacacacacaccactgcctcacaaggaaattaaatttactgggtctccatgtgttcatgaggtgtttgatttatatatttatgctgtttagaccttataatattaattttgtaattaacatgcaatatattatacacacatttgagcaccttctgctccttcccaaaagttctcagctagccctcttttttttaaaataaaactttgtgaggttttcatttaacatattgttttatatctaccagaacttcagtaacataatctcttggtaacatagccattagagagaaaatcagcattggttgcccactgtgggcacagagacagaattgattctcctaccaacccccatccccactccatctttccgctagaaatggaggggttgaagtccaaagacttcttatattcaacaacatgtcaaattgtatctcttttgtatagccaaaaatgtaagtagtagtggattatacctttttctttgaatattataaatgaaagttactacagacacaaatatttgcatctgtcctatacttaaatttttttcctaaattagttttctgatttttaattttttattattttcttatttcttttcaagagatcctccactttatcctctaggttgatggtatgctgttttttattattttgtctatatttaaccacaatttgaattatctcacctaaaatatctttgtcatctcaatgttttgttctaatgaactgaaaaagaaagttttaagtgtcatagttttctggttatatgatgttttgccagttttgcacagatttagagttttaatgacttttaaaattgcttccagtaatggaggcagcattttacatttcctttatcctatgtcagagatgatacacaaaatcctgaatttaaaaaactgtatatgctaaaaaaattgtttatcaggaagtcaagtaaacttacttttattgttaaaactgtattttgaggttaattttccaaaaggagcatgtgccacaactctgatataatactggtgcttagaacattattcaaaaatagggaaattttaatgttattctttagtcattattattttggtttctgaaaataacttgttaattcaatagaggtttttaaatactgtttttgaaaagttgatatgtaaatagtaatttaatgtgtttaattccaatatccatttttggaatactagtaaaactattatctgagacctaatcccacagagccttccaggtggactctactaagtcaggacagttttaagagctttgggggctttagtgttattccccggagctaggttcttagagtgtttatgaacctagtcccttgatctgaactttccattgaagatttgaggatggtctaaagaatggtaattaaggcttgttataatacattttgttgtaagaataatgaatgaaagtttttgcctcattgtatgtccctacaaatcagggatagtttttactttttttaattttaatagctagagtatagtgggcttatcctagaagaattaaacctattacttatggagtataagaagcagatggtgtcatataaagaagaccaaatgagattggctcattccgagtggtatgaaaaataaataaataagtaaataaataaaacaaaatggaatttctaagataaacagttaaaaaaagatgaagactgggattctgcttctctggatgtgtatcctgatgagccattaatttctctatatttttgctaacacatgagagggctgaagatctgtccaaggagttatattattagactctaattgtctttattcatccaagatatacttatttatttgctgttatctcatactttaatggattttatgcatatatgaattatctaactttgaaatagtgtgatatacaacattattatctcactgtgtgcacaaaatatttactagaacatcccccagattaactttctactgttaaagaattgggaaatttccaagatgggtgggtatttgtttaccttgtttacagtattccatgtggcaacattgctttggctagtacaccaataaaactgtcattggtaatcaagatcccagtgaattatacaagttttgaattggttgatatgtgcaggggatatatatcttgcataaactgtgaatacaatgtacattgttccatgtaatatttgtaagccatgcaaggtttgaataaagttgttcattcaacattgtaactgtgttgtttaagatgcaaaggcacaaaattgaatctaatggacatagtatcttccctcagaaattatgcaagatagtgttacaaattgacatttgggtaaatatgtaaaaatctattttcagttttaaaaataaataatttctgttgaaattaacttgttctagcagaaatatgcccaagccaaacattttgatatttcacagaggcaggctagaaactcaggagaagaaattatcttcaacttagatgtaacttgataaatatgcaatttgataaatcagagaatgtaggcattcgatgatgaattcagtaaatcaaagtaaaatcacaacttgtatttcatttatggttcctccctattcctctattgcttattgtcagtaaataccaactacataaatgcatatgtatgggtttggaatgtatctgttgcatgtctatataatatgttctatttcctgtagttatgttctgttatggcagcctttatgtttgcaaatcatttcccgtcacatattatagatgtgagatatccttgaacaataagggaatatttccctcataaattagttgtttggaagatagtgttcatagcacttagattatatgtattatcatttctactaatgtaaaaatattttgttagattgtgcctgtttggataataaggtgtttaaatggaagctttggcagagacacattataaaggtagattttgcctaggctttcctcagaagaatcccactgtgactcaataccacccatttccaaaatgaaaatggtgcatgttgctatcacctatcctaagcctagtgagagagtcttcaaggagatttattggagagaactctgctatgcctcccccatctcaccttcccaggagttctacccgcctcacttcaggttaagagagaggagatttcagtagaccactctgagggcataaaatgagtacccaggttagacatacgcctgggaaatcaaagctgaatacgaatgagagagaggtgtatgctttgggataaacctacactcctgaagtttgttggagtttcccaagatgaatctcagaagattcatgtgagatttaacaccattaacacctgtgaaaggagaagggtgaggaagcccaattagttgggccagggaagccattagacagccacgtagaccagacagtgtctctgccagcccagccagaatgcacattagacaagtcccatgttgtggggaagtggccagtccgtcataccagtcttgctcaatcctgggctgtgggccactctgagaagactgtgcctttggcttaaaagctgaagcagacccagatgaagccgacagctggaggctgccaactaacccacactcctcacagatggacattgaatgctttcttgaaggagaatctggtcaggatatctccatttgtaaaagtcctctagcaactctgttgatactcctataatcaaagtattttgtgtacttttagtcatcaatcttaagtaaactttttaattagttacagtctagtgtaatcatcatttggattttcttcaattattttatcccttcaaccccggcatatatacaactattctctttcctccatttgttctttaactcctctttccctcacttgccagaggtagcttctaactcttccagtttagacccaaagaagagaggcattagtgaaagaagagatactgttggggtcccctgatccatagatgtgcaattactgattctcatgaaactgtcttgtgataaatgaatatcattgaattataaaaatattggatgatattgatgtgttttattaataacagtaactcccactgatttggaagacactcccaggaactgtatttacaaactctatgtatttttaaccattacaccaatttttatgtacaagaaacaaaccccactgataaatggagatgctggagtctggatagctgaagatcccagagtttttgtgcctaggctgcccaaacatggggtagactttttaaatgatttccacattatgtactttatatttgctttaaaaaaaacttttggcttaataaaatttttgagtttgattatatttaccaattactggtctttctattagtacaaatcaagagagtaaataaaagtaactatctcagaacaaattaaagaaatccaatttgcaattctctggatgtttggaaggtagttttaaattggaaaatctatttttgttttagggatttatattttaaaatgcaagttgcaaaagagtgaattttgtaggaaagggaggatctgcgaataacatcttcttaaactaaatcttgcttttaactattgcttaagttttttacacaataacgttccccagatgtttgtttgcaagttgttttggtgtttatcatatgaaataggacaaatattaattgtgtctctttctaatttttcttatgtaagaataatacagcagttaagtttttctttttcaaataacatacttgaaatggaagcaaatttcacttcattttacaattaatattctaataggcttttagctattaatcttggatgattctcctatgaaagactctatcattataaacttcctaagttattcagaattcatcttttccatatttatgagaggtacaacttcacatttttaaaaagaatggttcatttcctcaaatagaaatcttagcgctgccaattttagcaacattttattatgagcagttgtcaccattctcatcgttgacatttaattggtttcctttcaaaaccaggaaaagatccattcaacagatatttatggtacaggcccagctctaagggctgtagataaaatggtgaacaaaacagtcaaaatccttcacttcatagaagttagactctaaagaggtgagataaacaattaaaagtaagcaatcaaaaaaaatttaacatacctcatggtgatatgtgctctgttgaaaaaataaagcaggatgtcaagacagggagcactgatgtgatgggagaagacagtgttttgcaattttaaatcaggaagttgtcactgagaaaatgacacttgaataaaaacccagtggaggtcagaaaatgaggcagaaaaatatctaggggatgaacatcccaggcaggcagaatagcaagtgcaaaggttttgaggcaggagcttgcttgaaatattaaagaaggaacagggagatcaatatggctagtacagagtggacagagaagggaacagagaagaagataaggatagagaactaacaggggaaacagcaagtaagttcttttaagtgatttgaggaactaggatgtctgtgctggtgagatgggaatgcatagaagtattttgatcagatgagtcacaatggtctgacttccatttcaacatacattaggaatatactaaaacaaggcaagggaagaagcagaaagatgaggtaggaggttgttgttataatacaaatgagagatggtggtaacttgggccaggataattacaggagaggtgggagaaggggcagttttgtgggtatatttttaatttagaacccatgggatttcctgatggattagcagtagaaatgcaaaaaaagagaggaatccagcctgccttcaagatttctggtataaacagccaaaaacatggagttgccacaaaatatgagtatctgcagtccaaacaaaatcacatatgcatttggtatttatttgtcagtaatacaaggtattgcagagaaaaacaaactaaattggctacagttaaagtaaagcaacatgaagcctataaatgcccccaggctgtacatagcactgatagagtaagtagaaatgagtgatatgacacacatgcctcaagatacgggaagcagaaatgagccaacctctgttagcagtaggtaaaaattaccatgtgaagggtgtaatcatttctgttcatgagaaatctgatatatcagatcttcagtcactttgaaaatgaaagcttctaagctaatttctttcctttttcaaattcaaatgacaagatcagtgcaggtaagtcctatgacaatgaaatttagaataagatatgcagttgatcaggatactggcattcccagggtaattctagggcacattcccaagtctggtcattcatttggttgttttttttttttttttttttttttttagtgttgctttagaaagtagttcatgagcatcaatgtgtgaggtatgatcatcaaactcctgtattaaaaagatgtacattctaaaaatgtggcaaggccctttgttcaatcctgggcaactaagagaagagctttggttccggatgcactgactgtctcaaaaaaatatgggaagatagatttagcatctcagtgttgctgagcactctagtgtaacatgacagtaattcttgatcattttcttacactgtctttcctggacatgataaagaattagttaagtaatgcccattcttgagggaatatattgaacaaaaagggtagcaaaagctcttgcatatactttattgtgtcttctgtatcttctcactttgtttgacaagattatgatttgcatgcattcttaaattacttatatattttcctagtatatctcttccataactgtgctagcatatcgtagctaatctagagcaccaaatttaagtatctaaaatgcacaaagattgcttttgaaatgtgtactaatttcaatgacattgggcttggatgctgtaaatgctctcccttttaaacataaaatggatttgttcattgcttaaatatcatgtcccctgttaaactgcaaaggttgctggaaaagtggaaaaacaatagaagcaggctattgagaaaagacctcagaccttggagccctacagatctgggctccaatcctagtcctgccaggctccagctgtgagtccttccttcggctccctaagcctcagtttcttcatgtgtggaaaggtttttgttttaacatggattagtaaacaaataactgagtaaatgtggttttactttgtccccattttgaaaccagctctgtgtgtgtggctgtgggtgggtgtttgtgttatgtgtattgaggatcctaaatgttaaagatagaagaataactccacaactccttgtcagtgaaactggtaaagagccatagtccaaaccacagatgataaattccatgctaagtagactgaaatctggatcagcttgaggaaagatactaaaagaagaaacagatctcctaactcatgtggcatgtagatcctccaagaacatatggtatcctgaatggcccaaagatgcttattggaagtaggatgtatagggatggtagctgtcataaaagaacgaaacatgcatagcaagagagacttccttttactcagtgggatagcaaggaggcaaattgaaagaggcacctttgagacaggccatacttaatttctggaacccacctcttgacctagaaaaaattagcccagaaattagacagaaggagcatggtgagtttcaccaccaatgcagctgaggcccttgatgggcaagtgatacatcttagaaagcaggatgagggacacccttcccaccctcagccccctcttgccaaggaaggtacaggaagacaaatcatgatgtgcccacagggcagaggctgttagagttggcgaaataaaaagaaaatgagcagttggaaaaattatttataaaacataaaccagcaaaattctccatttcttataagtattttaaaaagcttttaaatcagtaagaaaaatgagtggggaaccaaggtagtttgaacatactatggcctgactgttccacttctatgatatatattatataaataaagtcttaatcatgcctacttgtcaggaatgagatggagaggtgacttttccttttaccccataatttactatgtttttagaatttttaaaattaacaatgtaatttattttcttttattatttaattttttaaaatgaaaggaaagggcaatattcctcaaagtgcctagtacagggcagcagctaatatcctagagctcaaccacttgtgtagttaggttgttcaaattctgctttcacttaaaagcagccatttgatcacatatagagacaagaatgcagatttttttgaagtctaaaaatcattagtactggtaatgagatatttatttttagaatcacttatcctcttgacccttaatttgtggtgctgtttgaccattaaaaaattgtgtgagaggatggtaagtgagataaatattattaacctgaacttgatctttcattagcccctgtggtatgcagtgctactgaagtcaaaagatacctgtattagcaggttaatttctgccacagagggagttgctgaaatttacatttgctttgtatttaactgactgtagggagtgactttaaatacctctggctaggaaaagggcagaatattaatattgggtaattatcctttcctttatgttcccagaacttttgttcctgaaaaagattgagggacagtgaaaaaggtacctctttatgtttctctatttgaaaagttataaggcagcattgctctattacattctaggaataacacaactaattcttattaagctcgaaaatagacttcttaaagtacagaatgaccgtgttatttattgttggttgtagttatgactttttaaatagaggcttgataaactttctcttacatgtgatccatgtgatcatcagtttgtatttaaccaaaaagagcaggtaatgtagagattttgcatgtgtagattcctaccctgcacacaaggattgggaagaaaggaagcacattcaagccttaaagatgctatgaggtaggaaattcttttgaagggaatttccactttcctctccatagtgtattgtttgtctatttcagtcttttattactttgccaaataattagttttctctgctttacatgtgcaacagaagacaattaacttcctccatgctgggtagggaatggtttatctgcactgcactacaaaatatgtgtatttttattgttattaagggtgagtgcctggtttataacagaattataaataaagccatcaggaaggaagaatccatcataattactagattatctttactggccaatcttttaacctcttccacatattatatttacatttccttgcaattattagaagaaaagaaacagaagcaccactgaaagaaatgctgaaattcatacgaatatttctatatcgtaacagttcctcaaaaattattagagaagaaagaaaataaaaaattaatagattagggttataatattttcaagacatttttcttattttactttacctccaattaaagcttcacacagaacagggagttcattgtgtggcagattccctttgtaggactttagagtcatttagagtatctactagagattccaggaacaggataatttggattaaaaatagatgacatcccagagctttgggagaccaaggcacgaggattgcttgaatccaggattttaagaccagcctggacaaaatagggagaacctgtctctacaaaaaataagaataaaaatgtaaccaggcatgatggtgagtgcctgtagtcctagcgacttgggtggctgaggtgggatgatctcttgagccaggagtccaaggttacagtgaactatgatcatgccactgcactctagcctgggtgacagagcaatagcaagaccctgtatctaaaaacaaaaacaaaacaacaaaaccaagatgatagattaatgtggaattttcccagtttgtataaacttttgttgttgttttgagacagggagtgcagtggcacaataacggctcagattctcctcaggtagctggcactacatgccaggctaattttttgtagagactgggtttcactatattgttgaggctggtctcaaactcctaggctcaagtgatccatgtgcctcagcctcccaaggtggtaagattacaagtgtgagccactgcatcccaccaacattttttcccctaaatagcagttgtggcaaatggcttttccctgtgaaaacttccccctaaatagcagttgtggcaaagggcttttccctgtgaaaacttttctgatcctcttatttctttatagtatttgattttccagggtttcctttcaagagattctggacgtgtgtctaagttgcttaaattttgacactgacattgtcgctttagggaggtaaagtaaaaaactaaggtaaaattaatttattccatggggaacgtgaagggtgtgactgtaaacattttgaactttcgtctagggtttgtctccatcgaccacagtattactattgctaagcatccaggtacttgggtgcccatgtgcaagagctctagtgaggtctttgagtgtctctccattaaatctgaaataaaactgatttcaaaataaattccattttcagccactaatcagtgaccattttcctggaaacacaaagtaactatcttgtatttagagtacaccacgtgaagacaaatcacagggaatgctgtctttgtccagccgtgagcttccagagtaccaatttcatcaggcttgcagaataccagtttcaattctgagtgacaaggtgtccattctaaagtttgctccccgaaattgttcatacatgtaataatatgtatttgagacagtaaaaatggttaaactgtcaaaactgtctttctttgtccatatttaattttgaggagatggcaaaggctcagcacagccaagaatttactcacttaatggcctatgataaatcctttctggctttaatgctttcaatattatgtcatgtacagctgtaaataataacttgcaactatagtcgtggaaatcagaaaggtaaacaatttgaaacttcatgggcactcaaaatgagcaaattgttaggtttcagagaaactgattcttatgtcaaacacctaaatgaacagtttgcagcctatctatattgacagcatttcttgaggaaaaaggaaaagctgttttttcaaggctcttcctaaactctttcagtgtctattctatactgatccctttgtgaggcccctatatggttcaatacaaaaagtggtctacttaattttcagaagagaaaatactgtttagtaagctcaagcagcaaaattgcttggctgtttatttaacagaggcaaattagtattgatgaacagatttgatgaataacaaggatcctacttgtcccagctgttggagtgcagctcagatctgcacttgtgctgtcgatgccctttagcaagctgctctaagtgttggctgctaacagcttggagctctttctctggaatattgcccttggtccaacaggaattgtcttaccccccaaaaaagttacatgccccttacccacccaatgactgactgataatgggatgtggaagatggtctctttgtcccaaagtggaataaactctgctgtgcaattggcatccatttctccccaagcaatcaggctgaagctagacaccagctgagaccacattctcctgcaatggtttcctgacactctgttccaagagagtgctaactcagtaagacatgtgcacctgaagctgcctctaggcactccagcccaaaacaaatgtgaatgctgcatttctacaatactatttttaccctattacattagtaatatcaaatgtaagaggcatcaagacaccaaaagtgaccaggaagccacacgttacttaggttacttagcactagtcaacatataaactgagaaaacgataaaagcaatggttgttttctctaaaagggtatcccaattgtgtaaagataatatttagtgaaagagaaagagagaaataagcaaagagagagagtgactataaaatactataaaatgttcaggtcattaaattttccttttttgatcatttaaaaatattgcttaattttgaaacttatgaggctacattttaacagatataaacaatgtaataatgaggattaaatgcatagtgatcacatttgaaatgtttaaaaatgtgaaagtttctcttaatacatattttagtgatgtctatgtctttataaattaggaaacagagagaaagggtaacaatggttgaagtaataaaagctttctacataattttaaggaagtttggaatttaaaaatcagcctggtacagtggctcacacctgtaatcccagcattttgggggaggtaggaggatcacttgagtgcaggggttcaagaccagcctgggcaacatattaagacctcatctctacaaaatctgaagaaaattagctggacatggtggcacatgcctgtagtcccagctacttgggaggctgagttgggaggatccctttagcccaggagttcaaggctgcagtgagctaagattatgccacggtactccagccttgggggcagagtgagaccctgtctccaaatttttttttaaatctcctctgttacaggatatcattgctaccttctagcttttaatttgcatataaatttattatagcatagcagctcactaatatgcattttcccccaaacagtaattattcaggcaaatctttaattagatcaaggcaaaataaatattcatacattctaattttgaattgttggaaccttctattataattttaaaatgataagttcccattacaatatcaattcctttgtctattggttttaaaaagacaagcacatcattttatttgatagcaacctgcacatatgaaactatttcagtatttgttttttgttaaagtatagagcatttatattctcagtttgttaaaggtactctataagatttttttattttttaaccatggtgcattagagataaaatcaattactttcttaacatgtatagaaatacataacaattacagttagcaggacagttattacctaccaaagtggtacattattctttttagtttctcactcttcatataggaaataaacattaattcagtgttttgtttccaacagtaccctagagcagtttctgcttgttatcctggtacgtattacctaaccctcattagtataaacacaaagatgtatttgcaaaagtagttttattttcgagttcttcagtagggtcatgataataactcacagaattctaccacaagaactgggatagcaaagttgggtcataggcagttaagtaattggcctcagatagttatcctaaagctggaaatttttgcaaagttattgttggtccaaagaaaaagctgaaacattatccttaattgtgatataaatgttaaactccatgttaacaaggagccctttgccttaagactgcctctacaaactaggtcagaacacaaaaatcccccaagttagagattacttttgttgttttgttgtttgtttgttttttttactgtgctaaattgaaatttattgtcaaatacataatttttaatagatattttatcttttcatttaaaattaataaatagatatttaataaatatatattgttaaagagaagtcacttatttgtctagactataatttataatatcagggggatgattcatcagatatttccctgagaatagatttcaattaaggaattagagattgagaaggagagatttgcatgaatttggatgtctggagaggggagaacttagaaagtggaggttacttcagatatttgccctgtttcacagtcttgtccacgtgggtctgtttgcattctgttttggtggacaggaataatgcagcagcatctctaagcagagtgttagaacattagccgtccacaatcctaaatgtaggacattgacgatacaattatcctttgcagtactgttgccttctagtatggaactaagtcacatataatgctggttagtcatttattatatttgatgtcatgtagcagaattagtttaagaaatcattggaaaaacacctgacgtgtgcatatgttttatagtgtttaaggttgttctaaagataatagacaaagaccagtctttaacttcattggagaaaaaggttgacttttggatttaattacaatttagttctagattccagatcagattttttttatgttgaaaaacaccatttcaccatgcaaggcctctattgtcagctttgtacttccatagatttggccatgctgaggttaaaatgcatgttagacatcaatatggagatatcaggcacacagccgaatggagtctgaagctcagagagagatcagagttggaaatacatatgctgaaatatgtaaatcttcagcaaatataaaaggcatttaaaggcccagggtgagataagtttacttgaagaagaaggaatctactgaaaaatttgaacaattcaagaatgattatctaggaacttcattatttggaggtcaagtagaggagaaagaaggagtcactaagaaagtaatataaaaaccactggagcatattatcatggagaccaagagagcggagtgtttcaagaaggggagaggaggtcagctgcatcatctgtggctaaaatatgatggtagaagcatcatcattgattttgataacatggggttttgtaggtgaatttggtgagacttttcagaagtgtggcagatacacatcagattggtgagtactgaagcatgagtggtaggagaaacagaggaaagcagatgaagtcagtttggctttgaaacagaagaaaatagttgctggagagaatatgaagtcaaagaaataagtgactctaaaagggatggtggtgggtagcagaaaagtggattggtcagtgaaagtcattatgaagtagtagaatttttaaatgtatttgagtcaatgaaaaggatagaggaatatagtcagagtgagatatgtattataaagaagatgaaggaggcgggatatttttctaagtgaatgttaggactagggtatcattatgggagtgggaagctgtcaagtaacgtaagaaaagcttactggaggcgacaaagtcaaggaatcagatgtcggcatattgggtgggtcattccccggatgctgatgtaacacagaaggatgacagagaagatacttcaatagatcttcaaggatcttcaatgaatgacccaagttttataaatgacactagaggaaaaaatggcggctagcatacttggatggcataagtagttttttgtttttgttttgttttgttttgctttgagacagggtctcactctgttgcccatgctggagtgcagtggcacgaacatggcttaagtagcagcctggcctcctgtgctcaagaaatcctcccacctcagcctcccaagtagctgagagtacagacacacaccaccatgcctgtcagtttgggtttttaatagaactaaatgaattacaaatgggaaaagtagagtgaaaacactcatcttcacctcctggacctgaggtacacagagtgtaaaagaaaatttaaaaagcactcactagggagagctagtaaaacaatgatgtgctcagggtacattcacacttgagttatggcaaggggaaggacatatttttaaaagacattgagggtagaggaacatttagtgatcatagacatgggcttctggcagtaacaaagtgtttagaatggagtggagatgtgaatgaggggatgcacacagaacgcacaggggatgaaagtctgagtcatagtgagtgttatgatcctggaggtctggttgctagtgacacaaggatgtggggcaagatgaaactaatcccgagagcatcctgagcagaaataagactgatcagttctgtctgtgtgcctgaaaagttatctgatgtagatttggtgctctctatgggagtacgtggggatgccattgccctggaactactgtttctggtgaaggatgctgaagctttgtggattcttcttctaatttgcctcactcttgagtcctacccaatcagtacattttcggagatggaaactttgtcagtattatatcagcaaacatgaacaccttgtgcttgctcagagtgggtaaaagctctcaaccttgccaagatgtgcttcaaacttgattgctatggtaattttcttgtgcttaatgacagggcaaggagtaaagggaagaaattttcactgagtatctagatgtgctgaactctggaaacccttgcctcatttattgtggcttcaatctactcttctgctcattttgtaagcaagagtctcaactctaatgctagcaatacttaactgcaggaaacgactattataactcatgtcattatacccacgtcttgaaaactaccatattaaagggaaaaagtaccggctcggggaggctactttattaatatcacattacatttaagtcaaagtaatgctgcttttggaatttagatttcttgcatccaaatctttttgaaggttaggaagccatgtagcatacaaatgaaggtgaactacattatctatcgccaaagttagactgatttataaccaaatactatgtctgttatactattcttttagtatacgttaaagtatagagttaaagcttgaggagatgctgagaggaatgttatcatgaaaataaaatctggctagttattaaggtgcttcaaaattaaattttcaccatggtttgggtttgaccttaaatttgtaggctaatggatttcatcttgtgattatctcaaatatctggtgaacagctactttgtgggaagctgtacctacagagacagatttattgtttagtggagacaatatcaaatatcacatacttgctgacttgaatgagctgacgatcttgtaaaacatacaatcaattgtcaattagaatgtgctaatcatcggcattggaacaacagggaaactaaacgtgggggcagggtataagggctcttaaataaatgcatatctaagcaccaataaataatttttacagataccttgcataaaatcagcatttcagtttttttaaatttactattaaaaatgcctgtatagaaaatcagattattttgtgatctcttaaatggcagcaagttaattaaaagttcagtgtattcaattgtcatctttttggaagagattggatttttaattaataaattaacacattaaatataacttttcttaatataaattgttaaaataaattaaaatttaaaatatggtattgtttctcctatgctgatgtaaattttcttaatataaattgttaaaataaattaataaaaatttaaagtatggtattgtttctcctatgctgtttcagtgggtacatttatttccatgtcttctgtaaatataagaaaaataaataaaatttaaaagtatatttgataacttgcaatatttgatcctgcaaaagtcttgggaaaataaaaataaaaagaggaactattttcttcatattcaataatgtattgaaatgactttaactcagctcaccttttatctgatattgttccctaagattttaactgcttttaggagttgaaatggctcattcatccaacaaacctttctttttcacctactgtatacaaagtcccacatgacctctcaatatgttatcaagataaagcagacagggcacccagccacagaatcttacaaatataccttaccaattgcaagttaaatactacattgtaggaaagaattgtcttctgaaatattataggttagtaatttattggccatccagaaatgatcatggtcccttatttatccagaattttcctggaccagatttctcctctatataataggaaaagtctattggatgcagttcactagctgaagtgaataaagttcaaataatacatatttcttatataatatgttctaaaatcctcaataacaacatactgaactcttactaatgccaaagcaagaataatatctaattccatttaaagcatagaaaccaggaaatggagatcaatatattttaatcacttttttcattatgtaatcaaatcaaatactatcattgcattatgtatatgcgaatatatgttttaacgaattttgttaattcaaattttaatataacatttcaccttttataattactgaacagaattattgtcaggtttttgtttgtgttaacttgtacatcttaggagtatcaaccttttttttccttttttaagtaaaaataatgaatggctttacctattttgcacgcgtggctgtaaaaaaagaagtaaagaaaaagcaaggaaagaggaaaagttttaaaaaacgggaaggaaaaagagaaaatgaacaaattagtagaacgaagtacggatttagtgtgtatatgtatgtgtatagagatgggctcttctgagttctactcttctgcccagttggatcttaagtctaatccttatcattatcattagtccatgcagggtgggcttttatgtgtttagtttattatttttactattgtgataagcatccaagaaccctccacatccacaaaatagtaggacttttaaaatacatatataaaatgaaatatatagctactccctgaaatatattcctgctccttgatgagtttttccaaatatttttaatttcttttccttttattattttatagtttgaaactatgattttcagtgtatacctttggaaaatattcactctttttgtataattaatacagcaggtgcagctgttttctttttctgtctccttaaatctatggagtgcagcttggagtggaggaagaatttgatagggcagagccctgtctctgcagatttttgaaggtgctcgtgtattcagttagggaagaaacaacttccagatctgtgctaattactctgctctctctctctctgccccctgcctgcatctttctccacttctctctatattttttctttttcttatttattcttgttatgtatcttttctacaagttcttctctttccccagtcatcttccaacttgtgagtgagatggggaggataaatattaagaaagcagagggtagaatggtgattaccagaggctagggagttgagtggaatggggagatggtggtcaaataatacaaaatttcagttagacaggaagaatgaattttttgtgatgcacaacatagcgactgtagttaatagtggtgtattgtatatttcaaaattgctaagagagtaaatttcaaatgttgacaccacacacacagacacacacgcacacacacacagaattctgatggtgagtaaaacctacttttcaatcctcttcttccctttcacaaagttgcagcaaaagggatgggatagtggttacataatttacaacatttataatttggctctaagtcatgagttatattaatacatctctaaactctcactttagaactgatgttgaatttctaaataaaagataaaatatgacatttatttcatgagagttgagaattttgattttcatgattgaaattatcacaccaggaaattatcacaccaagaagatatttttaaaaattctttcattgacaaaaagaagagcttctctttatgtcagctgggaacatgcttgcatagtacaggcttctcttatgaaagaaaatttattaaagctctttccccttttatttttcccacagatagctggcacatgccatagaaaagaacaagaagtcattctcaatgttctgttacttattgcccaccatataagcagctcctcaaaattagggaccctaactagaatttcaggaaaaacctttaaatatcttttatttgaagcagaggctgtcaactactctagtaacaagataagctcacttaactggcaaagtatgaagataaaattatcctactaggatgtgctttataaatgtcatgataaaatgctctttgatgcactaattaattggtacataattgggtagttttgttccacagtcaagaatcaattataaaacgttccctatatatctccccatctttttttttttttaatttgagattgtcaataaccacgcctcttctttaacaatttagggacgggaagaaatgaggctcttctgcttcataaagttagtacaatgggagaataaggggatcaccattttgctcttttcatgagacagcaaaatttctctatggtttgtacttcttcgactgccttgccaagcatttttaaagtagaatctcataccttaagactgttttttcaacactttaaagacaccatggagaaacttgtaggtatgcctgtaagctgtatctctttaatatttgaacactaagaatcaaagtattactactaagccacttactgttgtagggctttgtttactactccacataggtgaatacacatcaaactacaacaatgtatttaagtacttttcttttgactagtgcattctgttctggtgttataaaaatcctggcagttgtatgtcaattgtcttctatctcacgttaaaagattttatgagaatcactcaaattaccttccgttcattatctttacctgttcaaaaataacttaaatttcatttgtggtatctttaagcaatatgttattgataaaggggtgcattagaaatgacatcatctggcaactagaacaaagagtgctatgtctacacaaagaatacaaatttatggttatgtcatgaaatctggttttgaccagctgctctttttaaataccaaattttataaagaaataataattttgtctaatattgtacaacaatagctggttgtatatagaatttactctctatggaagatttagtaagcactcatttaggaagaaaacctatgttttaaaacttgaaacatgatataatgaaaagaacgtgggcactgcaatcacatagagttgggttcaagttctagataagaacctgtcttagccatcaaggaaatgagaattttcactaggcctatgtaaatgtactcatcttcaatatgggtactcatctacgcatacatatgagtcagctagactcagcaaggtttgaggaaaaccagccagcagaattgttaccacattcagctacacatgaaacacgtttatttgtctttttcactatggcattgttgctattagccatcagtaagttaatgattgtgttaattgttatatacccacctttgggctgttaatgcagctattacaaaaaatatggtatatttaaatgtactatcataaaaatataaaatatattcttaaatggaaaaaagttaaaagctataaagtattatttgatttttgttaacaaaagaaaaacatgtttataattgcaagtaaatctttagtaagacataggaacaatgtataccaaactcttaacaatggtcacctctgtggaagggagtggatggagatgaggatgtggtggaggtgggcgtgcatggagggaaacgtcatattatgttgtgtgcaattctatattgcttggatttgtttttagggtaaaaatatattcatttgttgcttctgtaagtaaaatataaagaatataattgaaaatcactatagaacttttttttaaaggagctaaagttctttaaagactgcctatctgtctaccagatccactaaattttgattctttctaggctcttactttcttaaccaaagaaaaacatgttttttagacacagtgggcctgcagtgctcacaatgtaatcaagttattacacgctagggaagaaaactcataccacatggtatatatgtaatagaaccccaaagaatgacctagaaaatgatcataggatgtcattaatacctgggggatgggacagggacatttcctgtgaggaggacaagcttcattactagagtgataagccagaatcagacatttgaggaaaggaaaaaaacttatgggaaaaagatagagataacatttaaggtgtattcaggggacagagacccgggcagatgaaatgcaaaacaagtgaaacattctgggaaagataaggggagaaaagcaaattgtggaaattgtgaatggacttgtaaaccagacgttagaatttgagttgccagagaaggtgacaggcatttaaattagatgcagtacattgagatgacagaaaaatattcagtagtagaattgggaatgacaactgtgtgcattaaaattcttaaaaaaaaaaaaaagaaactcacctcgaaaacaaaactggaatgtactaaaatgattagggtacagcaaaccaagaactaaactttgcccctctcttgtttctctgggtgtatctgcatcattcttttctttctctctgcagatgagctttcatgaactctcagtccacactgccatagatggtcattcccacagctcctgctctgcatggtgtagccccatagacagaggtactggactccctgtcacctaatctctctcagggggagagagaaatctaattagccaatctgggctcaagaacccatccaataatctatagtgaggagtagtgagcagttcatggtgcagtcataactcctgggagttccccccacagtgggggtgtggttcccagagcaagtgaggggaagacttgtgatcaggtaccttctctctctattaactatgtaactattagctacataattgccattgggaagattttacttttggtattattatccataaagatattgataaatattttgtgacaaagcattggccccatggcactgctcatgccagtttaccatcaataacaatttttttttattttgtgaacttaaaatatttatgaatgtcttattttatgaactgctgtgagagaaaataagggggaattttattcaaagggaaaacagagacatctgtctaatcaagaagtgctgaaaccaaacttgggaaatatacttttttttctattctggtaagggagcctatgtcttttatccaaggcttttcacatcttaataccatttaaatattataatcagataatatccacaggcgttaatttatcctttctgcctctattttacaaatgaaaagctgaagcatttaaattttctcaatgctacataagacagaaaaatggactcagtaactttaagtactggaatatgctccagtactaaaacaggaatgcccagaagagacaggaagctataaaccatgttaagtaaacaatacaaaaacttaataattatgaaatacagcaaacaaggagtgaattggataacaagcccatgatgaactgttgagtcagttgtataattacagatattataagttcagaggaaggcagtatcctaaagattagacatggctcaataatttatgtattcccaaataggaacacttctaaattgaataattaaagaagagtttgttttaacaggagaaatagctggtctgtatagagttagtctcctgaaggagaaaagaatcacatgatagctaagtaaaacaaaaactaggatgtaatagattttaagtaacaaacagaaaatatagacaatgagggcagagtcaaagttaggaccaaaatgagtttacttttagttaaaagtaataaggaagcaagaactataatcaagcaaaagctatatagggtgaaatgtaagaattagtgaattggaggtgggaagcccaggtaggcagatctgtagaaggaatctatagagtagaaatgcatccgttagtaatgatggtcattcctcatgtttctgattctcaaatgcatacatactctctcagttccagaactatccttcagttcctaattgggaggccaagcttatgatgtgtcttgattgcagacttgtatgtgatacccttatctttattacgtcacatgtgtcttacagtggctccagtgctggccttagtgagtctctattctttatagcaggggaagataaagtagaaccatagaacaaatatggccagaaaagggaagagttaaagaaagcattgcattaggagcctgagtgattgggaaaatatcaacattaatgatagaaatcatgaaaataaaagggtatgtttagatgagctcacttttaggtgtatttttcgttatcttaattttgaggtgctcaaaaatgaaatataaatgcctcataaatctggaaaattcatcatgagatatcaagatatgtttattttactcattttcccagcattcattagaacttctaaatccaagagcctaaaactttcctcagttttaagacattttgttccatgcttgctttacatgtccttatgctttattttcttattcttggtttctggaaagcctgtcgtcaaatattggaatcagtccttcatatcctttggctttactttcacgctttgtatctcttggtatttttaatagcttctgggagaattctggctcattcttctaatttgttctttcgctgtgcccattctcttattcagctcatctattgagatttaaatgtcagtgatcatttttgtcatttttctgaaaattagttgatttttattatggatatagcctcctatttccctgatgatattaatcatacttaatctaaatttttgagaaatttcttctaaccttgttttcaaatatattaatatttattagctgcttttcatggcattggctttccttaaatgtctatatgctcatctttagaatcaggattccttgttagctcaagaaaaagtctagtgaagtagttaagaagataaggcccagagccccatggcctctgatgaaattcctgcactaccatgtgctggccctgtgatattaatattccctaagttaccctgtgactaatgtgacttctcatttctgtgcctcagtttcctcacatatataaactcttacttcacagggtttcatgggaattaaattattaacacatgcagtgcttttggaaggaaacctaccacttaatggatattagttattaatgttatgagaataatgaagtgttttagtattaataaatactagcttttaatattatatgactactgaaacattttattgcattcagactccactagttatgtgagtggttaggctgtgttgctgagcagagttggagtgtactagtagtttgtcctctaggtatggaggctttctgatcctacctaatgtagtcagccacctggggaatttactactccagcagggctaggtggggtctgaggatggtggtggaaaatcatatctccttctcactccctggtccaagtgtatgtatggaggtggaggactccctggctactccaatcttgtatcactactcttcaccctgtggggagtgtgtctggctgtgggtctctgtcttctgatacgtatagggatttttgataggaaaatgaagtgcagcatgtactctgatccccatcttgaggcaattctgagtgtttgttttgaatgtgacttgcctgatgtgattcaacaaacaattctgtgtttttgacatgccctcctttctgccaattatgtcttagaatttgccccttgtaaaaaaaaaaaaaaaagtcgttttgaactatggatatggaggtctacaaaagtgttataaagatagcttttgtttttatttcatagtttatgatacgtggctacaataagtaaatacatccattaataactagtgtatagatttttcctggttttcattaataagtagattgtgaaacaagagttggaaacaagtggaaaatattttaagttcttggcttttttgtactgatgatatgttagaagagacatgggagtttcttcagctattagttgagctgtcttaattagtttcatggaatcaaatcatttcatgatggctttgaggacataaaataagatgacacatacaccctagtagtatatatatgtcctctatacatcccaaagattattttgaacaggagaacaacagcagcagcagctgctgctgctgctgctaccactgccaccggaagcactgtggtgggaagggactcagttttccaggcgaaatgccattgagtcccggacattttaacaagatgatgtattcagtgtctgagctcatgcagggcagtggcagtggcaccttcatccctctccctgcagaattgtcattgtggctactggtcaccaataccaagggacaacgtatgataaaaaatgatgctggtagaaagatttggagggggataagaattgatgttgattctctttcccttttgatcacataagtattaatgttgcctgaatctgatgcatattaagattctcctttgtggaagaggtaaatgcctataatgctgtatctaagaattgaagccagtgtgacatgccttgaaaacctcaaactgtactttctttcctatgtgcatcctaacttctccaggttggatgcagttcattgacccagaaggtatctgatggcatggagttgacatttaaacaaactttctgactcaggtggttcaagaaaaaagttttggttcatcagaaagagaagtttgttaaaaaaaaaaaaactgggcagttaatctgacagcttcgtgttcactttgatttaaaatttgcttctctgttgttaaaatgttaacattccatttattgtggttcccatctttagaatttttctttctcttttgcttaaagagctttgatagaattgcattagaatactgtgggctgttaaatatagtcgtgatttgtaagaaaaggaatttcaaaatgaatcaaagatgaatcttcactgatcttagaaaagcaaaggatacatggaagcttgacttttcagaattgatctttttgttttacagcttgttttcatttcaataaaaaagacactactaagtctgcaaatacctatcacaaaatcttaaagtaaatgtcatttttatttatagcatgcagtgcacagagtagtgtagcttagtgatttagatcatggataaaatcctgactcagtccttactagctatgtggtcttgggcaggattcttaactgtattgggactcaatgtcctcatatataaagtaggaataataagagtatctgtttgatggggttgttaagaggaccatgtgagtcaatactcagaaagcacaaagactatatgctacctggaaacaatatgtatatgtttatttttagcatttctttctttttttttttttttttttttttttgacagagtctggctttgtcacccaggctggagtgcagtggcgtgatctcggctcactgcaagctcctcctcccgggttcacgccattctgctgcctcagcctcctgagtagctgggactacaggcgcccaccaccactcccagctaatttttttgtatttttagtagagaaggggtttcaccatgttagccaggatggtctcgatctcctgaccttgtgatccacccacctcagcctcccaaagtgctgggattacaggcgtgagccaccgcacccagccatatttttagcatttctttttttaaaaaaccacctgaaattatggggaagcttaagttattggactatataaagtgaaattgtttctgaagctgtttgtaaacatattttgtgattctgacatcatgtgtagtaaattactaagaaaaaacttccctagttataattaagaacaataatcattctcactcttatcactgttttctgaaactaaaatatatttctttcctttgtatagctcagtataaaaactacagaaaacttaatgtgatgcttttagaaggaaaatcttatcaatgatcccataatactaatatttgtcattaataacctagcacagtttatcttactgtttgtagcatttttattcattttcagagctggtagcaaaaatcacattaaattatattgttggatgacagtgcctattaatgtaagtataaaaggactaatgatggactcatctataatttttggcttgctttctccataccttctccagtagtaactctgttgatgaaaacattcgtaccaagatgtttacccaatttgtgaaattcaatatgtgccaaacttaatttttcatcattcatgctcagttctcagacctttatctgtttctcccacctcctttcaacctttcccttatactgcctatgtcaacacatacatgcacacagagagagagagagagagagagagacagagagatacagagcacctctgttcaactttcttctcagatgtatctttgtttcctatttccccaatctcaaatatttagttatatttgagtcatcatttctctttttttaaaaattcagaacacagtgaaattgtaatgaatcttcctttaaaatcactcttctttcctaccactgctgtcatgactctagagatagccttcagtgtctgattttcttctttctgtattgtcactatacttaacaacaatctgtatttgttggtcatattgatttttattatcaaatctaggtgcaaggtactcgttgcttttgaaatgcttcattgacaaattatcctttaagtatgggtaggtgaaaaatggacaaggaaagatgatatcatacaatatcataaaataatataatagagaataaatggccaggcgtggtggctcacacctgtaatcccagcactttgggaggctgaggcaggtggatcacctgaggtcaggggttcgagaccagcctggctaacatggtaaaaccccatctctactaaaaatacagaattagttgggtgtggtggcatgtgcctgtaatcccagctacttggggggctgaagcaggggaatcacttgaaccctgaggtggaagttgcagtgtgccaagattgcaccattgtactccagcctggactaaaagagtgaaacttcgtctcaaaaagaaaaaagaggaaatatttagattgattggttaaaagtataaggaacatattaattttctattttcagctatcagttttctgtggctgtcatattaccacaaactgggtgccttaaaacagcagaaatatgttctcttattcttctggaggccagacgtctgaaagcaaggtgtcagcagggctgtactacctctgtggctccaggggagaattcattctttgcgttttcatcattctggctgttgccagattccttgacttgtgtccacctccctttgctttatcttcaagtggccttcttctctgtgtgttttttatgagacacttgtctttgaatttagggactatgaaggttgattttttgtatgggtcaacttgtctatggtgttcagttgttgggtcagacacttgtctagatgtgttttgtgaaggtaccttaaagatgtgattaatatttatgagaaagcagattatcttctgtaaaatgtggatgggcctcatgcaatcagctgaggcctaaagagcaacagctgaggtttcttggagaaaaaagaattttgtctcaagactgtaacataaaaatcctgtctgagttttcagtctgctaccctgacctataaatgtcagacttaggactgcaacatcaacttttacctgaatttcaagcctgccagcctgccgtgtggatttcagaccagcacttagagttgtgggaactaattccttaaaaccagtctttctctgttctctctctacctctctctctctctctctcgctcttcctctctctctttcttccccctctccttccccctccccctctcccaatctacctccttatttccatcttttccattgttctatttcactagagaaccctgactaaaacaggatccaacttgcatactctgggatgatcttaactcaaaattcttaacttggttacatctgcaaaaactctttatctatctgaaaaaccctttatccataaaataagagtcccaagttccagggatttgatatgaataaatatctttggggtgggtggacatgttttaaccgactacaactaccctataattaggaattccttattctgtctcacttgtaccacagtacattaccaagtttcaaaaggtatcatatacttttcaaaagagttatcaacataaaattaattttattcacatcagaaaatgaacatatatgccagatgaactttatgagagaagactatcttaaggtataataaaaatagtatagttaattataactttaaatcccatgcataaagctatatttattaataacatctagaatctgagccacacttttaaaaaatgaagtgaagatgtacaaaaaaaaaactggtaccggtcttactgaaactattccaaaaagtcaaggaggaggaattcctccctaactccttctggaaaacctgtattactctgctaccaaaatcgggcaagaacacaacaaaaagagaaaactacaaggcaacatccctgataacacagatgcaaatccttaagaaaatactaccaaactgaatccaaaagcacatcaaaaagataatgtaccacaatcaagtgggttttattctaggatgcaaggatggttcaacatccacaaatcaataaatgtgattcattgcataaacagccgtacaaacaaaaaccatatgatcattccaatagatgcagaaaaggcattcgataaagtccaacatttcttcatgataaaaaccctcaacaaactatgcatagacagagcatacccctagataacaaaggccacatacaacaaacccacagttatcatactgcatggggaaaagtcgaaagcctttttttccaagaactggaacgagacaaggatagctactcttagctctttcattcaacataggactggaagtcctagccagagcagtcaggcaagagaaggaaataaaaggcctccaaattgaaagagaataagtgaaagtatctgtttgcttgtgacatgattatacacctagagaagctaaagactcctccaaaagactcctagacttcataaacacattcagtaaagtttcaggatacaaaaatcagtgtgcagaaatcagtagcatttccatatactgataacattcaagttgagagcaaaatcaagaactcaatcccatttacaatagacacacacacacacaaataaacacctaggaatacatttaaccaaggaggtgacagatctctaaaaggagaacaacaaacactgatgaaagaaatcatagataacacaaacaaaaagaaagacatcccatgctcaaggattagatgaatcaatatcgtcaaaatgaccgtactgcctaaagcaatctatagactcagtgaaatccctctaaaatttcaatatcatttttcatagaagtataaaaaactcctaaagttcatatggaaccagaaaagaccctgaatagccaaagcaatcctaagcaaaaagaacaaacctggagatcccacactgcctgacttcaaattatactacaaggccatagcaactaaaatagcatgatactggtacaaaaatagatactttgatcaatggatcagaatggagaacccagatacaaagccacatatttacaaccaattgacctttgacaaagttgacaaaaataaacagtggggaaaggacaccttattcaataaatggtgctagaaaaataggccagcaatatgcagaggaatctcttttatctcttcgcatatacaaaaattaactcaatatgaattagagacttaaacataagacctgaaactataaaagtcacagaagaaaatctggaaaaaattcttttcgacattggcctaggcaaagaatttatgatgaagaccctaaaagcaaatacagcaaaaacaaaagtagacaaatggggcttaattaaactaaaagcttctgcacagcaaaagaaataatcaacagaataaacagaaaacctgtagaataggagaaaatatttgcaagttatacctgtgacaaaagacaaatgtccagaatttataaggaactcagacaatgcaacaggaaaaagacaaccccactgaaagctgggcaaaggacatgaagagtcattcctccaaagaagaagtacaagtagacaaaaaacacatgagacaatgttcaacattgctgatcatcagagaaatgcaaactaaaaccgcaatgaaatagcatcttacatgagtcaaaatggctattattaaaaagtcaaaaaaaaaacagatattggcatggatgcagagaaaagagaacacttagacattgttggtaagaatgtaaattagttcagcctctatggaaaacaatatgaagatttatcaaagaactaaaaatagcacaacccagcaaccgccactactgggtatctaccctaaggaaaagaaatcattctatcaaaaagaccactgtactcatgttcattgctgtcctattcacaatagcaaagtgatagaaccaacctaagtgtccatcaacagttgattggataacgaaaatgtggtatatatacaccatggaatattacatggccattttaataaagagtgaaataattccctttgcagcaacatgtatggagttggaggccattatcctcaatgaactaacccagaaacagaaaaccaaatacaaaatattttcacttatacatgggagctaaacagtgggcacacatggacataaagatggaaataatggatactggggactccaaaagtggagaggctgagagggtggtgagggctgaaaaattgcctgtcagataaaatgttcactatttgggtaatgggtactctagaagcctaatctctatcagtacgcaatatacgcatgtaacaagcaagcacatgtaccccctgaatataaaatatgataattttttttgactgaacttgttttcgtactttaagttctaaggtacatgtgcatacctatgtaataatttttttaaatgcagtgaaattaaagtaatttcagaggaaattcatgtttctataaacaagagacctaatttttcaacattaggtccagaggctaatacaaactatatttgttctattaatttgcatatttgccagagtttatgaagtttttttttagtaaataacttattcaagctatttatatatcagactgaaataaatatcgagcatattttaagttatatattaactcacaattttttaaagcatgttcaaaaaaatatagattttttttacacatgggattcagtgcccaaatgaaaaacagacttccatttaaaaggaaatttgcatttggtggataataaatagctcctggattttgttgagtgtggcttcttttagcattcttttctttcttgcattttaatatctgttaagattcagcagtagaatttggtcttctatattaaatggctatgtctattttttgatttttaaatttattttcttaccattttaaaactgaagataaactttacagttttttattgtatgcatgtaatctaagcaataattttgtgaatatatgtctactcgcctgaatctcaatcaggtatttgattttgggggtggggagagtagctgaaaatgaagaaaaaaataaaggactctcagcataaacaaataagccttttgtcttcaacttttggagcccaactttcatttatagttctacactgattgtcataaaggttcacaaaattggatgcatttcagtagtgaaactgtcactgtactagaatgttcttcatctgatttttcgttgttgtgacatctcagatatatatttgtgtcatagttttatatctctcttcttgctttttccctaaatttccatcttcattcctcttgagaacctttcttcgttattgttgtcattaaataattgaagagaatgtactctctttttataaatttagtattttcatctcccaggagttctgttacgtcttagtgcatttgtgctaccacaaccgaataccacagactggataatttataaacaatagaaatttatttctcacagttctggaggttgataagtcgaagatccaggtgccagtatttggtgtctggtgagggccttcttgcagcatcctcacctggcagaagatggaagggcaagaaagcaagctagcccaatgctgtgtggagcctcttttatctgggtcttaatctcattcacatggagagaagccctcatggcctaatcacccctagaaggccccatttcttaatactatcacattggcaacatctggattttggaaggaacacattcaaaccatagcatgataattagtgaagattatactgatgagggtgatttttaatggtaatttttttgaagatgatttaggaggaattactcatatggactaagtttgccttcctattcagactctaataaaaaaagtagtcacaggaggctttgcagatatactaaggaagactcagggacaactgacttgctatttgggctggagacaatcttatgttttaaaatgttttcatcagtagcccataagatgatagacattcccaactaatatattattagtgattattttaggtacatactctatatccaaaatgcaccagatgttttgcacatattctctcctgtccccacaggagtcctgtcatgtagatataaggtccattttacacggaaaaattgaagctgacagaagttaaggagtttttacacaattatacagtggctaaggaaggactagagatagttctatgtattgctttaattcttcactgcccatcctttttgtgttcggttaaggaaggtggttttgaaatgacttttacttgctctaggcaagtttcagaaacaaacctacttctatggcgcatgttaagaatttcaaaaacagttcaaataattttgctcaatttgggaaacagttgaaagtcttgtctgctgttcattgacttcacattttacataatgagtataccatgtttaaatctgcatatgcctgactctttatctggagccaaatctcagagaattctcaagagcaagggctgctcccagaattcttccaagtgatttgcagggtctagaaagttaagtccaaacaaagtcattcaccatgagaaaagagaaagtctggataggttaccaaataatcgtgctgcgcatgaaatatgatttgcttttcctttttctagagctgcctttgtattagatttaaggacatgcctctctgaggagctgcctagggggaatacttttattgtgaacagtcaggaacccatgtatagtttctactttgcacacatcagtttgcaaaagtagtttctttctcttctttttcattaccctgtgtcattgatttcctgcataggctgtgaatagaacttggtttctgtaactcattcatctggaagaagtcctttattttgctactacggagccaacagatgccaaagcctcagaacagttaaatttattttaaagtgtttttttatggtggttgtttcaattttgcctgtaaaatatgaacttagtgttcattattttgaaagaataaatccactttaaaataagaagaacacctttgctaggtaatagcaactttgacatttagaaccagcttgaaaaattctctcttaacaatgtctgaatatttattgaagatttagtggtagcccttggcctctgtttagtacaaattaaaaacaaaacaaaacaaaaaacgactcatgtaggccattggcccttcgtctgctcctttccttagaatttctgattatggggattttaggatacttcatagaaaatgaggttgcttctcggaattgtatggagtacactagggcccatcctctatgtgaccctttctattctctggggtagcttcttgttcttgggtgaatctgagaaactggtgaagatcacagactaccaaagactgtccctgagaaccttagtgatcaactttacagctcaagaaaagctggttaagtgtaaaatatctaagatagcactactgtgtcaccagtttaaaaggttcagacaaagttgtatttctagtctgacaatgatccaatttgtgaatatgctcctaaatttattgtctgacatcattgtttaatcacagccattcatcgacttttccagtttggtgagactccagtttactaaactgaaatgtctggttcacacagtctcctcccctgtcgtattggttcagggcctacaagtttttaaattctgaacaatgtccttgttcatactgctttatattacattaagatctccccagcctgctttcaggtcattaactctttattcccaaacacattttggcttctaccatggaaaataatccaaaacttggaacacaccttcttctgagactacatcaacacaaaaagccatgaatctttgccctcatttctccatgcttcttcaaaccagcattttctactgtttgtgacagaggtttctgctactcattacttccttttcaatactcctgttcatgtatctctttcatttgtcatattctagaggattattgaattcctgaccaaaatcatctattattattgattttgcacacaactatgctgggtattatttcagaacactctggggataatattttgctgccctcaaaataataccgcatgatgaatccagagaggccactgagaaaacctccctccttttgaatactatgagaactaaggagcataaaagttaagtgactcttccggaggctcacgattaattagtagcaggatggaatttgaacttagggcctctagctgtaagtccaattatatttatattgttccattctccaaacaaaatgaaactggggtgtatagtgtagtaggacttgaatactccaagaggatttgagaaaaaattaagcatagcatccttaagcaatctcaagaattccacccagtccttaggttagtaaagctttacttggtcctatctctattgttattacttattcataacttgcatagcactttgacattaggtgacttcattatgtaatgtaacttttccatggagaaaataaggagtcatctactctgagtatttaggccaggaaaaggcgtaagctgcaggaccagccagggaacacaaaagcaagcctcactgtcggatgcttctcaacactcttcaggatccggggtctgtcataggcttatggtggctatttcagcaagagtgctgttttatctcatgcctgggctactgccagcaaggccaggatgctagattccttttcagtgatctgctaatgtaagaaatgtgtttcataatagtgctttagaattttgtgaactagcacctcagtttcttctcctgtctgcatttcatttttattttcttcaagtatatttatataacacagttttactaaaaaatctgtggtgactttgggtgggaaataatccttactaaagttttcacatcttagtttgctgaaactcacaattaggactttccaataacagtgaaatagctctcttcctgaagccctctctaattccactgaccaaatagttctcttccttgtatgtactacaatcattttatatcctgtgtgtttctctatggatttgtcagcattttatattttcattagatgtgtcaccatagttctgttatgtaacatggtttgaaatatttgaaaattgtcatatcctttacaaacttagttgaagagtttgtacaccatgtgtgcactcaaatattttctaattgaatgcctctttgaagtaatgaaattttgtttactctcccaacttctcaaacagctgtgtaatgaaagcatgattctagagtatttatataaaacagactttttagtggtaggaatgtttgtttagcagagttaaagcagtaaaggtacctgtgccacctctgtactctatggtattggacttttataagagaaaacagccactcctagagaaggtccagggaaagcagtacactcagaataaagaggttagagcagtaagatgagaataggttagaacaagaaggtgaaaggaatgtttagggtagagtttgagaatatgagtgattatgtatgtttgtatatctgcttttgtgtttacatgattgtgatatcaaagacatcaactatatattttattcgtctctgggttccacacatctatcacaataaagcattgttgaatgatttaatgttacataggttccccaaaataaatgtagaactttttacaaaaataaatccaagccatagtttaggtctatgaaagtttaatgtttgttggtctataaataactttcccagtgaataaatgggtactggactcataaatgtccaggcagctgtaaatatgtattacatgtaactatctaatgtttaagttgccatcacctcttctcaccccttcttcaatgtggcctgtttcaatattgaatttaatttcatttgtaattctttattggttttccagccaacaactaagtgtcattatcatacacagagcaccaccaatttctgttaattagctctataattgcaagtgaaagagctgaatacacttgagtttcccatgaaaattaaaaaataagatggaatatccactaattgcccatttcagtttcagaggatttcataattaccaaagcatccctctgctgcattgaattgatgcctctgactgtacatgatggtccacgtgctcacagggtgggctgtcttcagttgtgctgatttcctgtttgtcagtagtcaccaagaaaacactgtaagaaaaatactactcctctaagaacaacaacaacaacaaaaactatacaacaaaatgtctactccctttcctagtacagaaacctttgtggggaattcacttaacatcctgagtgtgtattgggagggttgccacagagcaaatgcatgcccaagcacaaaagtgtggtagaaaatatgaagcaagttcataggaataagtaccgtatagcaattccttatgaaaaacaccattttaaatggtatgagtctgtaaagacattttctaaaagctttcatcaatcatgctggtacatgatgcctgcagtcaacttatttacagcctgccactgtcaggttctggctcgaagagctgatctttcactttcacacatttatataggtagttcaataaccactagaaagcaaatttgtcaaggaaagggatttggttttgctccttctggcatctacaaagtcttgtagcagagtctattgccagtctagaactcaaaaattgttttgtgcatgaatgaataaatgggtggagtactcaaaatatatatgtatttcattgtgtttgtaaacatcttgtcatagaaaatccatattttctaataggttacccagggttcaattacctgtaaatcccattagctgaggttgaaaacataagcactacttaactccttggatggagaatgttactgaagaggcaaaacagtgcaagttcaggcctgtcatcatagcctctgtggtcatcatacttagcctgtggtcggtcatcttcttggacatgggatgtaaatgcatttgaagctataagactatgtaaacagaaaattactgtgaatattgatctatgaccaataaaatgagcagaaatgaaacatacattccaatcttatgaacttaaataaaccaagatagaagaagagtatatggccaggcatggtgattcatgcctgtaatcccaacattttgggaggatgaggtggaggatcacttgagcccacgagttcaagaccagcctgagcaatatagtgagaccccatctctgttttaaaatatatatatttttaaaataaataaaaataacttacatggaacaattttctcacataattatttttttgacatgccatggcctatttggtaaatgtatacatacaaatctttgctgtcttagctacttaacatttgcataatcttatggctttatttacatattatatcatatatgatttgaatcttcactatcgctatttttattggattgaacttctaggaaacatagcatattccagactgtgctctagattcatctaataggtagaaatctctgataacatggaaaacaaaagatatttctcttacctttatgtttctccttcttcttaccaattctttctcttctaaattaagattttagagaattcctctgtcataaattaaatgattaagtacatttgataattttcatatctcactaggaggtactttattaccatttctactgtagcatttgcatttaatattgacatttatcttaaataacatttttaacgaaacttataagatataggcatatatttctatttctttgatgattatagaattagaaacacagaaaagatcacatatctaagaaaaacataccaacaatagacataatgaaaaatcagatcttatagctgttttacaaacacagtccattctttagaacttcagaaacatatttacccttactattaactgataggagtactacctatgaaaatacttctcttcatgaaaattctaaataagtttgtattatttcatttggattactgttatgtattcattgtcataaaatgttaaaagaaatgatagacattatactgaatcaagcaatttgagtttttcccagaattgattatatttgattgctagtgaatgctgggatatctggttttcagaccaaaacaagctaagattaggacacagtgattgaaaggcaaagagcttggataaatgaatccaccacgtccagctttccctggtacatcacagtaagttttatgtggattttggtgtcagaaaatcatgaaatgaaatatcttcttaagtacaaatgttcaattaactatagaaatcataatgcagtattgaaatattgaaatggttaaatgcgattggttttatcggatgttgaaactggaaataattttaaggttaatactcaattatttggctaaaggccctattcctcatttatttattacagtcatataaaaataaattcaacttttactactttgataaaatatacagatattcagtactgttgaagtgttaataaaagtaagatgaatcttaataatgttaaagctgttttcagcagccaaaataaaactcactaggaataaacacagtaagaacagtgatattttgactgctttaagactcagatttgttttattgatgcttcagaaagattggaagtcatttttatgttcctttttatttgtagagagaagggtttgtagctttcatagataaaactatataggttcctgtgttcatttatctatataagtctatgccatttagatagattagatagatagacagagagacggatagtaatagatagagatgttttttcgagattatatcagtttagcagtgtggtatccaatctagtgcccaacactggcaataaaggaacccaacactctctctataataaggctgctgagctacagagagcttcataagcacatttattgttttgtagctaactttgaaattagtaaatgcacagttttataaccatgtataagagagaacatttgtcacctaaaatattaattagttcttggttgcctggacttttacgtttatatgtttgcatgaaaatgaaggtttcacatgcaaaataaattttcaaacctgacatttgtattctgtcaaaagaagagttgggtccatcctctgaacagtttggacagtttaaataaatgagtgaaaagactcatatctgtgggagaaaacaaaacagtttattttgcctcataaaactgcgcaaaatatagctgagtaaaaagatgacattatagtagttcattgtgtgtgtgtgtgtgtgtgtgtgtgtgtgtgtgtgtttgtatacacatatcacattctctttatctatttaccccttgatggacagttagatttcttacatatattggctattgtgaataatgctgaaatgaacatggaagttcagatagctctctgacataaaaatttcaattattttggatatatactcagaagtgggactgctaattcatataataattatgtttttagattttgaggaccctttgtattatttttcaaagtgactgtactaatttacaatcccaggttcccttttctccacattcttactaacattggttacctttctctttttgatagtagccattctagtaggtgtgagaggatatctcattgtggttttcatttacatttccttgataattagaaatgttgagcattgtttcatgtatctgttagccattcatgtctctttttttgagaaatgtctgtttagatcctttgcccatttttaattaaggttatttgttttcatagtattgagtttttttgagttccttatgtattttttatattaaccccttatcagacatatggtttgcaaatattttctcccaatccatggttgtctcatcacattgttgttttctttgctatgcagaagctttttagtttcatgcaatctacccaagaaatcattgccaagagcaatgttttggagattttcccctgtgctttctccttatagctttacagtttcaggtcttacatttaaatctttaattcattttgagttgatttttgtgtgatgtgagaaaatattttacttttattctaatgtcattcttcggcatgtggatatccagttttcccagcatcatttattgaggagactgtcctttccccatgtgtgttcttggcatccttcttgaaaatctattgatagtaaatacttgggtttgtttctgggctttctatcctcttccgttggtcagtgtgtctgtttttatgccagtaccatgctgttttgattacaatagtttataatatatttaagtcaggaagtatggtatgatgcctccagctttgttatttttgctcaagattgctttggctatttggggtcatttgtggttccatgcaaactttaggattttttcctatttatatgaaaaaatggcactggaattttgataagaatgcattgaaattgtagcttgctttgggtggtgtggacatagtaacaataataattcttccaatctgtaaacattgaatactgcacagcctttaaaaagaaggaaattctgccattcatgacaacatgagttgaactggtggacattatgctaagtgaaataagtcaggcacagaaagacaaacacttcatgatctcacttatatatggaatctgaaaatgtcagtctcccagaaacagtgtaagtagaaaggtggctaccagaggctgggagaagagcaggataggaaaagggaagatgttgatcaaagggaacaattcagttcagttagactagaggaataacttttagtgatctattgcacttccatgtgaccactgttgttagtagtgtgttgtacattcagaattgctaaaagagtagattttaatgtactcatgcaaaaaaaataagttgattggatgatgtatatgttaattagcttgattcagtctttttacaatgtatacatagatcaaaatgtcatattataccccataaatatacacatttttgttcaattaaaaataaactttttttttttttaagacagagtttcactctgtcactcaggctggagtgcaatggcatgatcttagctcactgcaacctctgcctcccgggttcaagcgattctcctgcctcagtctcctgagtggctgggattacaggcatatgctaccacgcctgactagttttggtatttttagtagagatggggtttcaccatgttggccaggctggtcttgaacacccgccccagctggatcaaaaagagaaagataacaaatgttagtgaggatgtggagaaaagggaaccattgtatactgctggtgggattgtaaattagtatggtcactttgaaaaataatacatagggtcctcaaagtgctgggattacaggcatgagcccctgcacctagccaaaaataaattttcaaaaataaaaatgtcatcattggctaaactttattgaaatcaactgaatcttacattgtcgtattaatctattgtatatagtttgcagtgcatacttatgtttatttcttatctgattttcataacagactttagtgacaggcatggtagaaacatcatcctgtgtcacagacttgagaggtgagatacagagtttgaagtgacaaccacaagttcatagaactagtatgtaaagagcgatattcttccaagtgggcatcagactatctttgtttacctgactttttcttttcttttctgtgtcctagtgaaatcatatcacgttggaagatttaacaattatctttcagctagaatacaagttatttttttgttttttgtttttttttgagacagagtctcgctctgtcacccaggctggagtgcagtagcacgaactcagctcactacaacctcctccttccaggttcaagtgattcctgtgcctcaggctcttgagtagctgggactacagttgcacgccatgacgcctagctaatttttgtatttttagtacagatggagtttcaccacgttggccaggctggtctcaatctcccagcctcaagtgatccacccgcctcagcctcccaatgtgctgggattacaggcatgagccacagtgcctggccatacaactttttttaatagtgtaccacactagaagatatggcacacattcctaaaagataaggtaacagagtagaataaaaccgttaaaacataggaaatgagaggatgaatttgatataaccaaatgtgctctcttaatatttaggaactgctgaaattaaaatactgatacaatgtggaatttctacatgacttccacaatgtctacttatgaaagatccaactatttaacatgggaaatatttggaatacttttattcattggttctgaaaataggggacagttttctacacaaaatgctcttgagagaagaaataatttattaaagattataagactgttcattccttcagtttttacattgacataatgttcaatactgacagaaaaaattacatatttaggattcaatacttgttgaatgcaattggaaaccttgcttttatactcaataaagaggaaagttgatttttgagagtaaacagttggagttatataaacaaatacattaatgatagtaataattaagcttttaacttaattgccacatgacttcagacaagttaccccttgttcctgagctgtatttagttctgtcatctgtagatgaaataaaaattcctctcttactggaatgctgtcaggattaagtggaatagagggctttcagactctagagtcacacccatttacggagctatttctgtttgttttttaaaaccactattactttttttccaagaacagagaagggccattgcggtccacctaccttaaatgcgcttaaaatgtttcaggcttagagaggggtacatccaactcattattctccttgctttataggaaaaagtcaaacacctttttataatcttgggcttaaaatttaagaaaaagaatcctttttagaatgttctagtgctcagaatatttttaaatgaactgagatatagtgataatacaataaagcaatataaaattcaaagagatgggtctctagtcatatattatatactttaattactacagcttatgcagttgtattcattctactaaaaatattcctgtttgaaagtacccaatgcctttctgttcatttttatttaggttttatgggataacttttttcctttcccattcattcaaactcttatttttcaagtggctgttacacacataagacattatgtaggcactatgaaaatataaagacaaaatatttgtaaatcttgacctcggattgcttagcatctagttagataaaggtaaatcaatttcatatgtataataaaatgcaaaaagcaaagaagctctgagtgccttagggaaatgaagtaatagtgcttgctgtgccatctccatggaagaaagggctgtgtcaatggtgtgagatcaagtaaggctagtgccacctgagtttcatataggccaatgtaattcattcatatttctggtgataatttctgttgctatcccagtacctcaaattcaatgatgtaccagaatttatcatgttttcaaaaagtactgtttcctcttgacctaattttcctttttaagggaattaccaacttcttagctatcaaggcttaaaatctcggttatctttgacccttccctcattctgcatactcaaatccataggaatagggatccatgtcttctttgaaactatacttatctattgcctttctggtccaagccttgccttaacctgactactctccactgtgtcaatttaccctgtgccattgtacttctatgcgcttgcatatatattttcctctacctggaatgcccttcctcaattattttttgagagctataagcatctaactaagatgcagccttgtccatgaactttgtctgtcctctttcttattgcataccttcacttcaggacaccctgtcctcccagctaaaactgaatcttttttctttcttttttttttttttctccaaaatccacagccctcagtttctaccacttttgcggtcttatcacattctatgccacattataattatctgagaatatacttttttttgtaattagtttataaggccataaagaaaagaaacctttttttttcccattttggtatcctgcgtcttatacagtaaaatagtagtaaatgtttgtgtatcaatgacctaacagataatttcaggcaaataatttaacagcatttccttgagattaatatttttttaaatattcctacatgcacacttcatatgttctctaaagaaaaaaaatatgttaagatacatacacatagggttttacttttcttgaaattttctcttattattaaaaaaggacatcattttaataatgctacattactcctaaaatttaaatgtaaacttttgggagtaaggggtagtcaaaggtctttcattggagttaaaagactttaaactttccaatgtttaaaatctttaatcatcattctcagtaaactatcgcaagaacaaaaaaccaaacaccgcatattctcactcataggtgggaattgaacaatgagaacacatggacacaggaaggggaacttcacactctggggactgttgtgggatgcggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaatttaagaaaaaaaatttaaaaaaaaaaagattgtaaactacgaaagagagtgacaagtatagttggaagaggcataaatggtgcccacatgtggccagaagaagtatgaggcctgcttcacaatatctttaaagttctacccactccccacaccctcagtgattctggaatttgttttaattttaaccatgtttacggtagtaatgtatatagacagtcccttctccttttaatttgaagtacctggataccataacatgactagagtgtggcagaagcccaaacaggaatttatttttcaattgcctggtctctgtgaacctaaggatgggcattttaaaggaggctgatagaataaatataggaccttttccttatggagacgttggaccgctaatatccatatatgttttatgcagaattaatattctccactattcagggcagtacatttatttcagcaagctaacgaggaagaagagtttgaaagttatttctcaatgcatataatatgttgtatacaagcaggtgttctatactagtaaatggaaatttgaacttatcagagaagtctgaatatcaaaagcggataattcacaattactgactagcgatcctgtatctctttaaattactgtgtctaactttttaataaacctacttgtagttctgacatatatatgtgtgtatatatatatacacacatatatatacacacatacatttatatatattcttttttgtgagaatacatattgaaaaaaagttttattttatataacaaatagaaatctcctaggaaaactatttctaaagaaacctaaatgtgaatatgtagccataataactaacacctattgagcacttaatacttgccagtcactgtgctaagcaatgcattttctctgttgaactgtattacaatactttgaagtattatttccattttatggataagaaaactgagatttggagagttaaaataactcatgcaaggtgaaatatcttataagtgttggtgataggattttgaatcagattgtctgatcccaggttccaaatacaccatgttggggggccatccgtacaactttacctggcagtatctgtgtttcctgaatcacaaatgcctctccgccagcctacccacttgggcttcagaaacaccaaatataattttcataaattttatgtgatcatgatgctgagatgcttttattccatgggtgtgtgtattgtttcatgaagaaaacagtgagtacttgcctatagaactgccacataaagagatacatatcccggtccctgcaaagcagctgccccatcttgctaatatgatcactctaggattaaaaggtaattcatttttggaatcatttttaaaatattttaaagacttacacgtcagttttgtcattgatgggagttgactattggatttttttattagatattcaaaaccctcagctattatttgtatttattgctctaaccaattgttgctaagctagaatgctctcctagtcactattatgttttaaagaccatttggacataggatgcatagctggtccttaaaaacacaaaatacaaagtgccaaaataaattcctattgacttcatcaaagcagaccttattcttttgctcagtgcttgaaccttcagtgatgctcagctgggctccgaaggagagggaagaagacaggcagctgttgagaaacagctgtgcctattggagaggctgtgaacagcagtggagaataaggccggatccattgctacatgtctattatactcagtctctctttaatcacccatccctctgagctcacttgctcaatatgctatagtcgtcaaagcaagacattaagtatatactgagatttcttctcctccaaaggttattatgaggattgatgagattatatttgtgaaagattccagcaaatatcaaatgaaaggcactgcctgcatatcaagagctcctgtatttgaaggaaaacatcgttcttctctgcttttttctcttgtatgcctcagagacctatgacaacctccattcttccatttttccagcctggatataggctgtaaaaaggacaaagctcaaagctgaggtcagagcttctttccttagaaatttagacctgacttgtattgcttttacctcttctacgtagaacatttcctttcaaatatattttatacacttacagatgtatttaaataaatggaagtttcttttattaaagacttgaagccaaatcttataaggaaagctttttctggctatttttcaatttttaacattgggataaacttcaggatttttgtggaaaatagaatcttgttaggtttaaaagcaaatatttttgcctctttcctttatgatttcagtgaatgctgtcgtatgtagagtggatatcttttctaatatctaaagaaaatagtttccgggacaagaagaatagaatcacagttaagaacacagagaggggtcttacagactgggttcaggtactggatctgacactagctgcctggcttaaggcaaatagttaaaacttcccaagtcttgttcttttatctgcaacagtagcataataaacttacttacttcatagagatgaagaaaccagatacttgtaagaagtatttggcacaagttttatatgtgcagcaattactgattattttaatgtactttttcaatccatatcagaaacaaggaagtttgtgaatactacattagcacgagaatttatcaataaaaggctaacatttctctctctggctaccttctaatgatccaagggtcctaaagaagtcattacattgtttttttgtttgtttgttttctgcaaagctcatagctatccttgcttaggaaaatgttttcagcccttcagaaatacacctgaacatacacacacacacacacacacacacacacacacagaaaaacacacatacatacatacacatacacacatacacttaaatatatacataaaatgtatatctatcatgctactgtttctgcaagctacaggtaattcaatcaatctatactatactatataatataaactacttcaaggaagtaggtcagacctccaatacacactttcattataccatgtacccatctctctgtgtgaccatggcttctccatgggtctgtggctcctgtaattattctgcccgtcactgatacctagcacagtaggtattctatctgcattgattgtagcattggtttatagctgagaactgattgctgtaagctgtcatatgaagcccactaggatgttttttctcacagtgtatttctgcaagcaaggtattttgtgataagtttattactttgttcataatttgttggctccattcttaggatattaggtaaaacctgggaatgtaaacaaaattttagtaattgtttaatgtaactcttggaaaataatcaagatcagaactcagggtgggctcagctgaacagaatgacctctcttttaaaaagactatcttcattgcttcattacttaaatacctaaaaatcatggacagcacagagaaaaagcctgagtggatttgaggtaataaatatgcttcacttactgtgtgatcatagtcaatcttttagactctctaagtccctgtttctgaattgaagattatacctgtaggggccaagagaaaacttccctttcaccctcaaaaggttcacagaaaaagaaactcaaaaaagacacattaataggagaaaaggcatgcaaatttattagcatgcacagggagaaaattatagagtgattactccgccacacaatggggtacagtttttctacaccatcttcttagagacactggagatgggaaaatgtggatgattttagggaggtcgtaatttttttaggggaattcaatgggcttgaagaacatacaatggctgggaacaaagtctgttgggcctgcagagcaggcaatggtttgtgacaaaaatctattcagatgtgttgacagatttcggtctttcttcctgtgatatgagttcagttaatgaaaactcagggaggattccagaggtcactgttttcttccttgttggatctggacttcagtcagataaaggggcttcaagagaacagcttcattctgtgctttgggtgggacagaggattgtcagacaggatagacaggtgtgtgtgttggtggggtgggtgggggtgctgcaggacttgggggaggggaggtcagaaagaccttgaggcttcttcttcaggtcagcatgtgaaagtgccatatttgggagtattggtttctgaaccccaacataccccatgaacatagtgtgatgattaaattagataggttgtgtaatatctcaaaccagtacctggctccctgatatcgtttgactgtgtccccacccaaatccactcctgaattgtggctcccataatacccacatgttgtgggagggacctggtgagaggtaattgaatcatgggggcaggttttcctgtgctgttctcatgataataagtctcatgagatctgatggttttataaaaggcagttcccctgcacaagcgctcttgccttctaccatgtgagatgtgcctttgctcctccttcaccttctgtgtgattgggaggcctccccaagcatgtggaactgtgagttcatcaagcctctttttctttataaattacccactctcggatgtttcttcatagcagtaagaaaatggactaatacattcccaatctatatattttttcctttctttttaaatatctgtctcaaagatttaacagaggaattaaggaatgttattttgaattattgcttgaactagaaattttccttacttatagctctataattaaaagtaaatcctaaagacattatgcgttgaacataatctctctcctggaaatatccacagactggtgtgcacattatgggagtacaatgaaaaaattacgtttcccatctgaatccaggttaaccagaacccaaatgttagcatttgtctccaaaccccatctccagtggggtttcatggaattatgattattatggtcacaatcttaaaaggccagcagaaatgacatttaaagtggactgctgaatttttacttatataaaacaagctttgatttataaagtaataagtgattgataaattcagtatgattaataacttttaaaacatgaattcttcatagaaaaattaatacaagggattctgaaataacaaatttgagaagcagctactaatatgttttgttcagagataagaaatccaaatcacagtgtagtttgtttcaaatcatgtgtttgatccaataaaacattttcttttaatgatttctcttaacgatgtaagcacggaattaattttcctcttatattattgcaagagtttatctgaataaatatcattaatgctaatctctggattaatctggccaaattccttatatagtgattttccttaatgaatattttcctattggccatactgtgttttattcccaaaggttatgtatggttaagtcggcatggagcagggataggaaggcatgttggcatgtgtttgtgcttttgaaaaaagccttcaacaaacacatgagaaacactattttcacagtgacagaaatggagtgtatctaattacttgtacacgcttaagtgacagtagtcctcctgaaatgttggagcactatatatatgtgtgtatatacatatatatgtatatacacacacacacatatatatatttaaaggaattgtgatgggttgatagctgcagccaacaatcatggcacacatttacctatataaaaaatctcacatcctgcacatgtatcccagaactgaaaatataaaataaataaaataaaataaaataaggaattgtattagtaacaggaacagaggtaacagaaatgaggcgcttcaatcatttccaatgttgtaatttcccattgaatgcagagaagaaacatacttttccaagacctgaactttttttctttccttcttaatgtaacaaatgactgctgtgattcaaaagcactatttggtctcctatcaattattttattttacatttggggtttgtacatttgatcagcagtaaagctaattcatttctcaattcatcttcctacgtaggtatatatgtgagaacaaagcaagtactgagctggcaaagcatcttttttcactggatcctcttctgttacttttaaaatgtgtctctctgtgttagcattttatggaaatgtatgcataggaaaatacaccctacttttctcctttctcaagactcatttccactaccataaggctaatgattccattttataagcaggcttcattacctagccataaatatgacaagaaaaatattaaaatcaatttgagtcatcacaggtggtaacatccaatttatctgacattattaaagaattagatgagaaatagaaatgaatgtttgagataataaggggtttagttccttatgtgctttttcattttagcaagctttctccaatgcgtctttctaaagtacattatacttcagtgaattcttgacatacagtgttctggataccagaaaacattttcatggtaattcagggtcattatcataaacaaatgctggtttttgttttttttctgtatggaaatacctcagaagcctttgagaagtatacattttttttttggacttttaataaacagatgtacgctggtctttctgttttctttttttcctcttcttctttaaatgggagattgtatttcagttttttccttcctccaaataagaaatatgcatttttttcaaacagtttactacccaccttttatatttacatcccttccttttaatcagataactaatcgtgttaaaccatttaatgtaatttagccacaactaaagttttctgtcgtctgagggatatttcattgtctccttaggtaattcatattagttctatgatatccttcaagaggcacttttccacttgctattgggtttatcattatatttcaaatatctgaaattgctaaaaatctgctgtcttcaacaagtgggaatttctaatattgaacttttaaacggtgactatagctactaataatgcatatttcaaaataactaaaacagaagattttaaattttctcaccacaaagaaatcataaatatttaaggtgaaagaaatgcaattagcttgatttgatcattccacaatgtagacatgtgtgtgttgacaaagattcaaactctgtaaaatatttgaaaaaatttattcagagcaaaatatgtgtgaccaatgacctgtgacacagccccagaagaccctgagaacatgcgcccaagatgtcaggctacagcttggttttatacattttagggagacataagacatcaagagagtaattgatcttttaattaattaattaatttatttatttaataagacatcaaaagaataattaatcttttgcagcattttgtttccagttgtgctgttctgatcctaaatgtaaacacaatctattaatgtcttatgtctctctaaaatatataaaaccaagctgtagcccaagtgaggttgggaaggtactttcaggtaattgaattcaaagattttctgattggcaattggttgagagactttatctaaagacctggaatcaatagaagggagtgtctgggttaagataagaaattgtagagactaaggtttttattatgcagatgaaacctccaggtagcaggcttcagagagaatagattgtaaatgtttcttatcacacttacagagtctgttctatcaattgtaggatttatgttttcatgttaacgctggtcagctatacctgaattccaaagagaagaaagtataatgaggcatatcctacctccacttctcatcatggcctgaactaacttttcaggttaatattggaatgcccctggccaagggggatggttcatcagtagtttagaggattagggttttatttttggtctacatgttgaaacactgcattgtaccccataaatatatacaattattatttgtcaataaaaactaaaatttgtaaaactttttaattggaaaatgtaatacacatatttgatcaaataatgatatgaatatgagatttcaaaagcagccttgaaaatattacaaataggtaaagatgattagactcagtgtcagaaaaaatagtctataattatgatgatttttgaaccagagcatcttctatcttggttgatatgaacttattttaaagcacagaaacttcccctttatcattttttattgtgtctatttgattcttctctcttttcttctttattagtcttgctagctgtctgtcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagtgcttttaattgtgatgttagggtgtcaattttggatctttgctgctttctcttgtgggcatttagtgctataaatttccctctacacactgctttgaatgtgtcccagagattctagtatgttgtgtctttgttctcactggtttcaaagatcatctttatttctgccttcatttcgttatgtactgagtagtcattcaggagcaggttgttcagtttccatgtagttgagcggttttgggtgagtttcttaatcctgagttctagtttgattgaactgtggtctgagagacagtttgttataatttccgttcttttacatttgctgaggagtgctttacttccaactatgtggtcaattttggaataggtgtggtgtggtgctgaaaaaaatgtatattctgttgatttggggtggagagttctgtagatgtctattaggtccgcttggtgcagagctgagttcaattcctgagtatccttgttaactttctgtctcgttgatctgtctaatgttgacagtggggtgttaaattctcccattattattgtgtgggagtctaagtctctttgtaggtcactcaggacttgctttatgaatctgggtgctcctgtattgggtgcatatatatttaggatagttagctcttcttgttgaattgatccctttaccattatataatggctttctttgtctcttttgatctttgttggtttaaagtctgttttatcagagactaggattgcaacccctgcctttttttgttttccatttgcttggtagatcttcctccatcgttttattttgagcctatgtgtgtctctgcacgtgagatgggtttctgaatacagcacaccaccaatcccacagaaatacaaactaccatcagagaatactacaaacacctctacgcaaataaactagaaaatctagaagaaatggataaattcctcgacacatacaccctcccaagactcaaccaggaagaagttgaatctctgaatagaccaataacaagctctgaaattgtggcaataatcaatagcttaccaaccaaaaagagtccaggaccacatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacagtgatgcaaaaatcctcaataaaatactggcaaaccgaatccagcagcacatcaaaaagcttatccaccatgatcaagtgggcttcatccctgggatgcaaggctgtttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggatgtatctcaaaataataagagctatctgtgacaaacccacagccaatatcatactgaatgggcaaaaactgcaagcattccctttgaaaactgacacaagacagggatgccctctctcaccactcctattcaacatactgttggaagttctggccagggcaattaggcaggagaaggaaataaaggtattcaattaggaaaagaggaagtcaaattgtccctgtttgcagatgacatgattgtatatctagaaaaccccattgtctcagccccaaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacatgggacgtgaaggacctcttcaaggagaactacaaaccactgctcaaggaaataaaagaggatacaaacaaatggaagaacattccatgctcatgggtaggaaaaatcaatatcatgaaaatggccataccgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctatggtaaccaaaacaacatggtagtggtaccaaaacagagatatagatcaatggaatagaacagagctctcagaaataatgccgcatatatacaactatctgatctttgacaaacctgagaaaaacaagcaatggggaaaggattccctatttaataaatggtgctgggaaaactggctagccatatgtagaaagctgaaactggatcccttccttacaccttgtacaaaaattaattcaagatggattatagacttaaacgttagacctaaaaccataaaaaccctggaagaaaacctaggcattaccattcaggacataggcatgggcaaggacttcatgtctaaaacaccaaaagcaatggcaacaaaagccaaaattgacaaattaaactaaagatctaattaaactaaagagcttctgcacagcaaaagaaattaccatcagagtgaacaggcagcttacaaaatgggagaaaatttttgcaacctactcatctgacaaagggctaatatccagaatctacaatgaactccaacagatttacaagaaaaaaacaaccccatcgaaaagtgggcgaaggacatgaacagacacttctcaaaagaagacatttatgcagccaaaaaacacatgaaaaaatgctcaccatcactggccatcaaagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattatggaagtcagtgtggcgattcctcagggatctagaactagaaataccatttgacccagccatcccattactgggtatatacccaaatgactataaatcatgctgctataaagacacacgcacacgtatgtttattgcggcactattcacaatagcaaagacttggaaccaagccaaatgtccaacaatgatagactggattaagaaaatgtggcacatatacaccatggaatactatgtagccataaaaaatgatgagctcatgtcctttgtagggacatggaagaaattggaaatcatcattctcagtaaactattgcaaggacaaaaaaccaaacactgcatgttctcactcataggtgggaattgaagagtgagaacacatggacacaggaaggggaacatcacactctggggactgttgtggggtggggggtggggggagggatagcattaggagatatacctaatgctaaatgacgagttaatgggtgcagcacaccagcatggcacatgtatacatatgtaactaacctgcacattgtgcacatgtaccctgaaacttaaagtataataataataaaataaaaattaaaaataaaaaaatttaaaaagtaaagtacagaaacttcattttaatagattaattaagcatcaagtaaccaaagaatttgctgctttcaagtgagtagtaaaattttgctcatcaatagtttcaattggcaaatggtacaaaatgtgttcattgacttaaattttcagcatcagatctatttgtgacaggagaaacacaagtgttggttgaaaaatatttgttaaattgctgttagaggactaggcattgcctgagaaacatgatacatgaaacatgatcactgcttgatcatgcctgtttgatttcttctcatatgtttagaaaactggatttctcttattttgttgtatgtgtataataatacacatttctctctggatagacatttgtaggaagataggtaaaggaattgcagagctctgtaaattggcatccctgaagtcctgatgacaagggaaatggaagcttattactgtcagcatgtgtccagataacaactggggaccaacaaaggttgttcatccaatatttacacttcagtgtgaaaacgtagttgtaactgattgattgaaccagctaaacacagtagagggaacgcatctttattctttcacatttccttctttccttcatgctcctagcttcagcctttatcccttatagttcccgcggcttgccttcactccaggtactaataccaaaacttcagcctcttaaaaaattcaaagtttctgtcttcccctgctcaggcctgctttagcttcttcactatttgccttcctcttccactcactaggctacctctccattggagagttacaagagagagaagaggtaatggggcagaaaaggcttaggatggtgttagtgccttctgaaagagctagatatctaattgcagattatttccttgtgaggtatggagagccctttactggagtcttccaattccctagcatgctgaagacccctctagtgggctccctacaacttaagtctcccacagtacctggctaccagtgcttccacactagtcacttctccagtccacatggtccacacaggtgaggtcacattcaggaaaacaaggctggtgccctttttcaaggatatgcgtctggtgtttcacctctcaccactgttgcttgcttctttctctgcacactccaggtgggctcctgataatttaaacatttttacctgtgagcacacaccaatccctgcattctccaaattctggagaacatgtatcacgttgttgcattactcactcatttttctcctcattggttaatgcacatattttatttactcaggatacacacagataacatgagtttgtttcccgttaagactgtcttgcccattcagtgtgatatcatcagaaggacagaaggaagcaattacataatgtgaagtgcctcctcttctcagattaatacttcccaacacagaaacattgtaaatcttttttgagaagaaagggggaactttgcctttgcctatgaaataagtgaaagaatatgctatttaaagcatgttgttagtttagctggctagaagctatctgtctgacaaaaatgttttctttcctttcaaatctgtgtttttttatatttgggatgttctgtttatgaattatttatatctcttatttaccagaaatgactttggaccattgccaaagcaccaggtctgctgtttctgaacttaaacgcaacacacacacacacacacacacacgcacacgcgcgcacacacacacacacactacttttgttctgtttaattatggaggcttctgctttcctcttatcagggccatgattcagtccttttagtatgtaattatcccaagtgtcctcgatttaaaaaagtgagactctgtatttttgtcagaatgcagtgttattcagcgatggaaatcttttgtggcgttttgtttccagttgtaccattgtgattctaaatgtaaacacaagaatttgaatttctacttggtaaagagaattcatcttgacataaactaaccaacaaaaaagtgaaggaaaattctaagtactcattgccttatctgcaaaacagctatggatagcttaaatgttggatggcaggactatgcctaatgatcttttcaagatccctctaggtcaaagtaccataatgtagaacaagaacatgaatggctgaaaaaaatcacttttcaaatttctaggttcctcatctgtaggattaagataattacacttcataaagttaataggaccatcatgtgatataacagtacctgaaacagcaggcatgacataaatgcctgttcactctagcaatgcgttatatttagatagggggaaatggcattttaaaaaactgcactcaaaaagcacttcaggaaaatttccaaaaatctcaattttaatgacctctttgcagagttaattgttatttcttggtaccgcaggcttcataaggttaactagcctagagttcaaaatgagattccattaatggtgaagatccctgttttgctaactcctgcccaagtgagatcacctacagtggtactggggagtccacagagagagacaatccctctcacttgttctcagtcagagagcatttggggggtctgtcagtttcttcctctctgtccctgccattttgagtgaggtcagttgctgagccctctgaaggcccacagtgtttactcatcctccctcttgccctctgttgctggaccccactatgcactgcagcagacagctccaggaggcagatgggcctatgctctgaaatcctaaaaacactgggtctgctctaaattcctcatgtgtgacatgggagaataattttctctctaccctgctacaatttatcacactgtggaaaagggtttagttttggggacaaatcttgagttacagatgccatacacagaaagcattggcaggcctacactactaataagctagacctgcataagtgggccgaaacccactgtgaattcatcatagtcttgagttggaatgattatgtttaggttcacacctctttataaaatacttagagctttgtttactgtatagactcaaaagaactacatattccactaaccctaaaattaagtattctgattcctcaaagtaccaaaatatggacaattttaatgtacccaagaagtttcctgtccatctttcactttaaatattggcctttgctataatctgaacataatctgaatctaattttttaaccaagataccaggggtttggtataggtcctgctgcttgcattacagaaaaccaattactgacacaagtattgccaggaaagaaggctttaatcaggtgctgtggcagaggagatgggagatcagtctcatatccatctccctgaccaactaaaattcagggtttatataccagggaagaaatggaaccatgtgtaggaaaacaggaattagggagtggtaagaaagaggagttgatcaacaggaggcaggtagtcagttaggcaatcataacagccaaggtgtctggcatctcattgttcaaatccaatgatctggtgagtatcagctcctagctaccatctgggaggcctcatggttggtttccttagaaaggaactcagataaaacaaatgtaactttctcaagttttaagactgggagaatcaatttatgggtttattcaaaaaattataaataccatctctatgggacaattgggttagtttcaatctaaacaattccattgaatttagagagttttcttatgactacttttggaaattcctagaaatacaaagatgaaaaaggtatgagtcactcttccaggacctccacagactataagagaattaaacacagataaaaatttagatagatcatgtcttgttgtttttgaatatacaataatgcatattatcttgcttttgaagcacaagtactgtttagtttatttgaatgatataaccacattgaagttttttggaattgtggttattttaagaaactatatatgtttggttgtaaatattaaatgctgctactcttatataaccagatttccctatcacataagaaaatacacacaaatactactaataatgataatagcttttattgctgttgcatacttatttatactagatgcttcatatgcttgaatttgcttacttattacaacaaccttgaaagttatgtatgatatggtttattttgcattgaaagaaactgatgaatgatgtagtcggttgcacagaatcacacacaacttgccagggcaactgtaaagtcaatactttaggctttaccttctctgcttgattatatctcaagaacacagcatcttcttaagaatgggctcattttcatcctttaatttttttagccacttatggtaaccaccaggaagcttgctttgagaaactgctatttcagcatagaaaaagtccatataatggtgatcagaacagattttaatttttttctgctgcataaaaagtaccacatctcttctatttccttctcttaacattctggtgatcacttgtcttccatcccacttcaccattatctactattatgaacaataataacaaaatatcataatgcatacaaaaatgcacaagcactttctgcatgagccatttgttgtcagcacactcagtaaaggggctcggtagggatagacagtggcagcccttctagtaatctttgacaagtactggatacttctccaagaaagcaccaccttcttctattaggtggaggagggagagagaaggctggtattttcattccttttcagtgaatagatggtgctgaactataaacttcttaagaaactctaaatgtaagcattcaaagaaagaaaaattaccccctaaaaaaatctacggtgtaattttatatatatttaggcctaaatagttttaaagaccaaatctgaatactaacgtattataaaacaaatggcagtttgtagctttaacctgttggactttttctgtgtactgaccttcagatgcatttttactatagcatagttaaaatgcgctatttaattctaattaattccaaaccatatacaggatattgaagtaaaagcttgtttttgtctggtgtcaggagtgaagagtttcttatacaggggtagcacagagaaattttgggggtgacaaaactgttctgagtggaagtgtggaggtggatacatagctccaggcatttatcaaaatccataaaactgtacaacaaaaaagtgaatgtttttcttcaatttaaaaagtccattaggaagtggcaggggggtagaacacagacagtaacaaatgaatcttaactatattacacagtgaaccacataaccacattgggggatggtaggaagaaaggagctgaccttccatcatttggaaaatgatgtttagactggatactataaaataaagataaaaggaactgtatatatgcatattagtgaggaattttgaaagtaatatgtttgtatactaggattgaacaaatagctattatatcatagataatgggagctaggagtcccactgttaagagtaagaagttacaaaagaaaggggaatgctagaatgagccctgtggtcctgaatgagaggtggaggtattaatgtggatatactaaaaaattgtatatactataattatatatacatacataatatgtatacatatacacacatagaggaatagaaatagacacagaaatatagatgcttacatatgcatgagttaatatacatacctatatttcctagttctcttcattgaggagactagaagcagtaatttccccaatagcaatgagcatgttcagtgcttatagcttagtagtttctaaatacagttctgcagtaaaaaatactcggggtccttggagaactgtttgattccagggctggggcagggaaaatacaagttgcatctagagcatcttgctatactggaaagtgccaggtgctaaacataagggaaccggggacgaaacctagtgaaaggagcacagagccaacctgaaagagcttgagcaataaaaagattataatagtggattatactccaaagaatggaataaatatccatggccccatgccaatataaaaaattgaatcaatgaataaggtggttaaacaacagtgctttgcagaagaattccaattttaagtgtagaagaagggactatattaaaatacaaaattataaatagaaaatcactattagaatatcacagtaacaattgctgcaaggcaagatccaccaatggaggctaaaattaatgggcaaaagtataagcaaaaacaggatatttgcatagtctcaaagtatctctttcaaactatttaataattacaaatgaaaaaagtagtaacttgacagtggacaaccttggcagacattatcctagccgaggttaacataaccaccaatacgtatagtcataatgaacccccgatatgacgcactgcggagactacatcacctgcgtggtatcgttccagataatgcatggtctcaatacaattatgagaaaacatcagaccaaatgaaattcaggaacaatctaccaaataactgacaagaagtattcaaagttctcaaggtcatgaatgataaggaagattgagaaactgttacggactcagggtgactaagggcataacaactaaatgcaatatgggatcttgaattggatcctggaacaaaaaaactgcataactagaaaaactggagaaatatatatatatatatgtattttcagatggagtcttgctctgtcgcccaggctggagtgcaatggcgcagcctcagctcactgcaacctccttctcccgggttcaagcagttttctgcctcagtcttccgagtagctgagactacaggcgcatgctaccatacccagctaattttttgcatttttagtagagacagggtttcaccctgtcaaccagtatggactcaatctcctgacctcataatccgcctgcctcagcctcccaaagtgtgagaaatattttaaaagttctatcgtgcactttggttagtagtattgtatcaaagtgcttagttttgataaatcttccatggttatgtaacatgttaacagaggggaagctgtgaaggatgtatgggaattttctgtactatttctgcaactcttctgtaagtctaaagttatctcaaaataaagtttttttttaatttgctttgatttttttcactaccattggttcttttctaagtatgacgtaaggtgttgccaaccattttttttagtatttttttaaatgagcaaccaccacctgcagttgaaagcagttgtaccaatttttatttgcagccaaattcagcctctttatcccagtacagagctggttacttccaaatggtcttaaggaggaggagaatctggaaggagtaggagcccgaattgtccagaaattattatttttattctcttatccttatagtattaacattttattgctctgactctttctcctcctatattcgttttgtgatctataatactttgatatttaaatatgatattttagtatttggtgtgctgcttccaagtgtctaatttgttttttgctccccttgtgggtacacacatacaaagtagagcaattctcttagataattctatgacagctataattttgctaggagattaataatttttgattatccagactgttagatagtatgtaaattatagtacagtaagcactcacttctgcttacagaatcgcccctccagggcccctaggtaacccactgtgtttgtcattttctaagtgattcttcctatttccgaaaccaggcattagatacaccaatactattaggctgaccagagcagccagtcagccagtgtggacagacaaaacttgaagaaagacttctaccctgtttttcgcctccctctgtgagcagcctcagggaagagcagttcaaacactggctgccatggcttgtatttctactcttagcatgtcacagatgaacctccaggagaggctgggactctcctgctacctgtgagaatgacttaattgacaaagtgctactgcaggattccactacctactcctgcctatcttttgagcttccctcttgtgtttggatttttgaaacactggtctgactttttagttctttggttttcctttcaaactaattaagtgtaactacgtgttaagatgtctacactgtttttaagtaaatgtttttattttgagataattgtagattcacatgccattgtaagaaataatagaggaggcaggacgcggtggctcacgcctgtaatcccagcactttgggaggccgaggcgggcggatcacaaggtcaggaaatggtagccatcctggctaacacggtgaaaccccgtctctactaaaaatacaaaaagaaattagccgggcatggtggtgggcgcctgtagtcccagctactcgggagactgaggcaggagactggtgaacccgggaggcagagcttgcagtgagccgagatcgcgcccctgcactccagcctgggcgacagagccagactccatctcaaaaaaagaaagaaaaaagaaagaagtaatacagggaagatgccgtgtatccattactcagtttttttccaatggaaaaaaaagcctacaaaactataatgcaatgtcacaatcaaggtattgatattggcacagtcaggatacaaaacattttcatcccttgaagtatccctcatgagaaccctttatagccttaccctcttccctcctgccttaccccctccttaatctctgccaaccttcaatctgttctctgcatctatatgcagtactttaaaaaatcatgatttgtctgcttatcagagaggaacagtctttctcctataacttggaaggtatacacacccacgtttattgatatctgccaaaccttaatctgtctagttgggtgtttgtgggagctggtgcacttggtttggcttcagtgcctgtgaatttactaccaaatcaccaaggattaaattctcactctctctgccccatgctggctgtgtgaccttgcacaaataagacttctctgaaacaaagttttcttaccaaggggagaaaaaaaatggataataataacgtttaccttaaagtgtttgggatgaactacatgagatgatttaagcaaattactcactactacctgatggagtaggttctagaagaatttagaatatgaggaaaaggcaagtgatatctatagacccagtttcctaattccactttctcaggctcaggagaaaactaaaagcaataaaattcatagaaggttcttgaccaaagggaatcattaagaatcattaagatattcagaaattatgaaaaatgaattaatattagaaagtatccatgattaatatttcaactttgaataatagttaatgacagttgcctttaattattagtgttttctaatttttttaactgtgttagaatttttccctaaaaaatgcctttacattaatgtgtgggtttgacttgcagcacaaccctaaatatgcacctggacagatttaaattcattctccactaagcatgcagatcccaaaagcagttgggcagagcaatgtctgtaattgatataacatattggtaaatcaacacatttatttctcccccagtgactcatgcagctgtatacatctaaaataaactgtaattctacctcccacaaaccaatttgaagactctctgctaatgtttatttggtggttgataaaaatggaataattacgtggaagttgtttttctttctggcatttccagtgctcctttccaaacagatctttctttgagagaatatttggaaggcaatgctttccattctccaaacctcctttgatatgctggtagcaatatagagaggcaagtagatgtgttcgttgttagtagtgtgtccttttactagagctggataacattttagtacagatgccaaggatgtagtgactatggaaagtcttatataattctcaaaaattagtcaaacaatgacaatgagatgggaatatcccccgtctttataagtgaattaatacgtatgtctgtacgcgaatgtgtgagaatgattctattttgaatggaatttattccttttacataagagtcattacccataaaaatgatattcagaatttcatcttttcatttattttgcactggtgtgaggagctatctactcttataattgcatttgtgaatactcttataagtgcatttgtataattggggcagagccaaatagtgaaacattttcatggggtctactttgcacagattctcaggctaaaatcatgaagtaagctatggcacataatatgtcagtcccttaaagccaacctctaccgagctttcagagctgactgttcaatgtagcagaatctctggtgcagttgtttctaaatgaggctcatagactgagcagagcctaatgtaatgaatgtgtctcacctctgagtccctgggtatcttgtctccactttattttaattgtagtgactacaaaaaaaaaatagaggaagttttgcagagagaaatttagaaaatagatactgtattttggaaagcatcaatgctttccaaaagcattaattaatgagggaatatttttatgagcacagagataaggtatgggaatattcatagaagggcagacataaaaaggaagctttcaatgtactctatttgaggagttagatttcttttttttgagacgagtctcgctctgtcgcccaggctggagtgcagtcgcgcgatctccgctcactgcaagctctgctgcctcccgggttcatgccattctcctgactcagcctctcaagtagctggggctacaggtgcccaccaccatgcttggctattttttttttttttttttgtatttttagtagagacgggctttcaccgtgttagccaggatggtctcgatctcctgaccttgtgatccgcccgcctcggcctcccaaagttgaggagttagatttctaatgcatctatatccttgatgctcatacacacctatttatcaaagtatccgattgtcagcagattattgatttttccctagattccacctaaagttgaaatgacaaagtcaaatttaggtcccttagtgacaaaagttaaataatgtagctatcattaactgagtaattattatgttccaattaatagggtaagagctttacgtgaattctatcatttaatccttaaactaactttatgaagttcatttatctttgtaaatgttaccagtcaaaggaaaatgaggcttaaagaaggtacgtaacttacacaagttgttagtattcaggaaatgtatacctgtaaatttgtaattgccatttcaaccctcttaagtcttagaaaaggcacaatttgttgactttttgatctaatcaaacataaactgtgcaagaaatgaaaaagctcacctcaactttgccttgaaatataaatgtttcactgatcaagtataataagtttctccagttgggtcgccccagaggtataaattctctctttgcatctaaatgtattaaacagtcccgcaagtactttttaattgaaagtgaaaactgctagcaattgtctaacagctggagtatccgtgaagagctggcattcagtggactatttcttcatactcttattttctcgtgcatgatcacactgctacaaaatcttgataaaccatccgagtattttttgtttttgtttttgttgtttttgtattaatttaacattgtcaaagagcaatcacgatcagtttaatgatcaaataaatgctgtcttttactgtatcatttccttcatagaatagcataacgcaaatttctcaaaatcaccattgattcagcagttattacaagcttctcagaaacatcacaaagcacaagttttttctaaaaaattaccaaaaagatatgattatgtcagttaagactataagatatttttcaacgtatcctgtttttaaatgacaaaaattatatatatttatagtgtataacataatattttgatatatgtagacattgtggaacggctaagtcaatctcgttatcatacccattacctcacatacatttttgaggtgagaacacttaacatttatttactgtcttagcaattttcaggtatacaatatattgttattaactatagtcaccatgttatacaatagatcccttgaaattattcctcttgtctaacttatatttcgaaatttacatttaggtagatatgtatgtcatgatatcataaaagggacactgggaaatcatttgattccaaaaaatttctttcaatacttcgattcataaagtatttgaaatctaccattggttaaaaattacaccacaattttgtatcattcttcagttttaatcagtcttgtcaagcttcacttgctccttttgtattacatttaaaggagtagattatttccaagcattgttgtacttttgtattttgttgcttgtaatggatgttgatgcaaaaactgtatcatgaaaaacaacattgttttgtggtgttgttacattggagtgcttccttttggaagatgtcagttgtatttcttccaccaattattgggcttgatatctttcacaagtttaaatccgaatatattatccttgtatattaacattgttaacacattgactttaaaatatttcagtggtatattaaagaacaaaacatcaagattctggcagtaagacagtgctatagctactaagttccaataataacagccaggtagcaacaagacaaataatcacctctactattaactaattttgaaagaggatatcttcagggtagagatgatttgctgcattaattatgtgtcttttttgtcattagtcttgaatactattttaattaaacaaaattaaaattcatactgtttaataaatcaatgtaatttgaaaaccttactggtagttaactgttgagaaagatcttgttttttaactactctccttctacaaaaaaaaaaaatgactagtgagcaataatatttctggtcgtttttagcagtaaccacatttgccttacggtgtagagcagcacaatgatttcactttcagatggggctagtcacattacctctatgtaaacacacacataatattccatctgctaggtataagagcatgattaattggatgagaaaatgttgataaccataaataatccttgaacctaaagccaaattatgaatatggcttaattgaaatttaaattcctacatattggcctggttgtcgagaagaataagggaatggggtaccaggaatcttctggtccatgttatttcaaaactgttttctgctactttatttatacaccttctctcctacacattttttctaacagcttgttctctaaggaaagaccatataattactctagtacagtgtttcacttgagaatgaaagttgtttatcaagtaactcaaggaagaaaatatgggttatttatttgcctaacaacaaaataaaatgaatcacatgcccagctaaaaagaaaaaaaaataggactacttagtctccttgtgcctagaggcttggtgcttcctgggatgcaaatatggattcagccagatgaacatatggcagagactagttacaagactcctactgggaacaagccactttcagaaccatttctagaatgttgaaaatttctagcaacagcatactttgtggtcttgtttagccttgtggccaaatttgcaagttctatgacaaacctattaatgcaggagacgggtcatacacaatccagaagtaaagggatctgtggaattctagaattaatatattatgaagttatattagaatttctataattgagttatttacttctgtggcattgtaccacattgagagcagaaagtaatataaatgtatgactgttaaatgtgacttataaagttggcctaaatgttctctttatgtgctgcagttttattattgttataattatcttctttttatgttttgttccattcaagtttcatctttttgctgagcatatgccagacctagggtagcattgtgttatccagtattttaagagaggaatatctcactgttggcagaaaaatatagagagagatatatgtatgtgtatacatgtatgaattatctgttaactgacaatgaaatgtttttctgtatttaaaaagcacataaacgttttactactgcatatagccaactcttaatgttatatataagtttacctgagagccttgactccttgtttatagccaggccttgtattacctatcagcatttcactctgaataaaatattaccctagttctggctatcctttgctttacacatgccttgatacacatttcttgaactagtgaccatacattgtttactctgggataattaattctcctagtatcttatatcttaaaagtgtcttatatctcaaaaacagtcccttgttctagccagagactatgtattgatggactttaagcattcattttttacaagtagctaaatggatctgctagtttggttgttagcccaacccatttttatgttacctttagtttagttttttggcatgtttataaggttgattcttgctttggtaggcttaccttttagtgtttgtatcaccagcccgtaaaactcagcagaagcacagagttataacaaaacaaaaaaaattgattattcacaataaaaaagaatgcatctatgaaaatttctcagaggattaaaattaaagctgttgattaaacacacattttagcacatctcagccgtgatgttttctcatgggaatcctttctcaccgaagagttactttacacgtggtttcaggaatgaattaacacccttgatcaaattaactaaatgtgttttcagatacctccttccatcacggtaatgtgcttttgttgatgaaacaaaatatgacttaaaaagaataaaactggaaggttcagagttggggggaagagattacctatttttaggagggacttcacaccaaaagccaaaggttcagggcttttggtctcataacgtattaggtaaacagagagaagaaggaaggactggaagagcaatgccataagcaaagccatgaggatatttctttaaaggtgctattactggcactaatgtgagacaagtagcgtaaggcctgtcatacttgttaatgtttcgacttgttaatgttttttgttaatgaatatgaattaacaaaaaagtataagtgcatgactgtaatagatccacttaagtcactacagagctaagcattgtcttcttatgctaatgaaataaaaatatcatgcagtttatatgactaattaaatgtatcatttaattagtggtacagtaaaattatgtaattggcaactgctttctgaaaggagcctgagactcttattctcatatccaaatccacttgaccttatatgcttggagacagttagggtttgggttagactgatagacagtcagggtttagcttagacttataaagtcaaggaaaccattattggtgtttgagccaaggggccccaagtagtttttagggatgagtaatgtgataacaatatggtgattaattggaggtggaaagtatgaatatgagatgaaggcagtgtcacctttcagcaatacagccctgtgcacatcctttctccctttcttttttcttgctccctttctctcttcccctgaaaataatttggacacaagaatttaagaacttcaaagtattgtttgattttcaatatctaatgtttaaacatataatttagtctcactaccagagtgtttccctgagatagaagtggctcctaggtaagtaaagatcgctattcatttaatgcttcacactgacattttcactgtggcatagtttataattctctgagtcaatccagatccaactatataaaaagatgacagagagacttattagtcacttcaagaaaggcctacatgaagtagtaacattctcagaacaaagtggcatggaatttagcataacttcatcataggccctgtttcattctggaaatagtttggagttatgctgtcatattatgcacattcctatgcagtggctactaactagatattgtaaaattacatttacatttatagcaacttgacttgggttgtaattttgtcagagttcactgaagtagcccatcctcaatcattacttttcagatgtattagtgccattgtcatgagtattgaattatctccaggttattttataagaagatcctatgtaaagcaagattttaaaaatatatatggacataaaattattcttgaaaaagtgataggcagcaattcagatactctgttctcaaagttccaataattgatcaatatggatagttataattgagtcaaaactatttttctccagtattcccccagagaactaggttgctgttctttttttaaaaaaattctgataaacagggttttggtttttgtttcagatatttttcactgtgaatatgtgaaaatattttactctaatatcttacttaacctccccaagcacacaagttcaagtggatttggatatgagaataagagtctcagacttctttcagaaaatcattgccaattatgttattttactgtaccacgtgatacatttgtaatataaattctgtgataattttatttcattagcatgaacaggcaatgcttagctctgcagtgaggtaagtggacgtatgacagtcatgcgcttacacttttttgttaattcatataattttgctgcttttggatggtgtaaaagaccaatcttgtcactaaatccattaatttgtgttatgggcatatcactcccagcagtacaggagaagaaaacacactcatgggcaaaccagttatgtaaaacacctacttttgtgtgctaggcattggggatacagcagagaataaaatagatcaagtctttgccttttaaaccagcttttattctactgtagggatacagacaataaacccataaagaaataaatatgtttcaggtggtgacaaagttctatgaaagaaaataaagtgaagtaggaatgagaaagtactgttggtgggaaggcattgaacacagtttaacctgcccttgagatgacttagcatcatctattataaatattcatatttgcatgactcattgttatgttgtctgtctctaaacttaaatttataatctcagctgtcactgttctagaagtcattatacctacctctaactgcaccacttattgtatttattacttgcatatgcaaggaaacatggaaattaggccagttagaaaaattatgttaagaaacaatccaggaatgctaaggaaggttcataattttagcttaagcagtttttatgtgacatgtgctgcacagtctcagttacctttttgacaatttgttatgctttgaagagttgagaatgaatgacatttaattaacaattctcattttgtcactgtaagtctctatttctggatttactctcaatttattgagaatcttagtttgtttactaaaatatgggtaactaagtttattaatatgattatttaacataacattgataataattgcttcagttaatgtgcttttcaaagcaaaatgattcttgcttgtataattttgtattatttgatcagagccttcattctttactcttcacctataaaaacagaaataaaactgatctaatttgcagttttgccatccaagcattatgtaaagggtaaattctcctgaccttcttcacaatgttactatagctaacgttaacaatagtaatgtggagttccacattactcagcaaaagagtagtatatatttaacaacgaaggtgacttgctctgagtctcttttactgaataattaagtattccttacggggctagtgtgtgtgtgtgtgtgttcgtctatatatatactttttcaaatttattttaatatatatagaggaaatggtacttatattaaaataaatttgaaaatgagttgttttccttctgctttatacatacatataccacttttgcaaatgtgctgttagcttagacagccctaacttcactctttgtagtattacatgtttattgtcaaaatctgttctgccaacttattgacaggccctggcaggcaggcctttgactacacagaatagatacaaagtaaaacttagtggtatttgatcaatcaagtcagttcagtttaataattaggtctaattattggtatcatgcctgcaaagcaagctctatcctctccaccctgccccacaatcactcaaatcagttggctgcttaattcttctctcttctagcttattacctcttttcagagcagaatagctaaggggttatatttgcttcagtgtctaacactctttttcatatggctgatagaatccttcagtatgttacaacgaaaaacatttttattatcaaaataatttatcaaccaactgtaagcataacacatctgacaattttataattgcttataatttacaaagcactttcatatatatttttaattgtggtgctaccaatggtcttgtaaggtaggtggggcaggaattaatattcttgcctaactctataatttatacactctagttgatggcaatttaatcagtttatgatgcaaaactttttacatcatgaaaatacacatatataaatacttaaatgttagtgttatgtttgaagttatctaaacatcaagctcatattggcatttccatgcataattccagagagccctttcaaaaaattatcctcctgcgttagtgttttatatttttatattattgtatatatcacatattataaattgtatagggccatccagagtctgtgcaaagtacttaatacaaataaataacttctcctttggctaacttaagtggcaatttgccatttacctaagattgaggttttattctttcagaaataattgtaatcaagatttcatgaaatggtagaaaaatgcaaaactgacaatcatttggattgtaatgctttgtcaaaaagttatattatcataaaagcacaatcccatatatgcggttatgattagttattggaaggttttatcaaagatgaggttgaatttattggttttgattttaaaatgtgataaagtttttacagcatttaaaaaaatgactgcattcacacttaggcttttcattagaacattcacatgctatattatcaacttcaaagcagatgcacaaatggaaacaatagttaagcattttatccacaagtattttataggtttattaattgaataacatgtcaagcacccagaatagtccttttgtattgcatctattaaatataaggcaaatactaatattttatattttgtataacatttcttctgaaaatggaccaaaatagtctaaagcatgggtattatccatttgactatgaagacatatgaagccctcaagtttcttaaacagaaagaagattgcaaattacttcagtcatgttctatagtttacatttacaggcacatcagtgtctaaaaataaggaaatgaaataaaagttctaatggaaagagacaataatttgtgaattaggataaaggtccaagaaactttaaaaccgttaatatattcttatgcaaatagggactcattgtaacttagaaatctttgttgcttacaaaattgcctctttagattttgcttgatagtattaatatcattttaagagacatagatttcctttaaattttcactagagaagcacaaaaatgccatactttctacttcatttccactagggggtgatctcctattgaaagtagcagaggaggattgaaaacactgtgaccctaccaaggcaaaatggataccttggtaggttagaaagttctcaactaaaatgttgtaagtaagagaaaaaaaattaatacattagaagctaatttcagcaaggagaacttctaaaatctttacacatctacaaaacacacaattgttaggcttaaattttttctcaattttaaaatttcaggagttctagtatttttctcatcaatatagaatataaggagcatttcatgagagagagctgcacctttgcttcttccttaaagaacacactttcctattctgaggagagtaattttttttttaagtgcatatttactactttgaagatgaatatcgggaaatattaggtggggatttgacatggggttggaatctgacaattatcaaggacttgcccagagctggatattgtcctatgtaggttttatacatcatctcatgtagtcttcactgtcatcttgtttaaaccaaaagtgacttgaaaactccacagatctccataaggggaagtgaattggagtttgggtattaagcaaggaaaagagatgggatagagaatggagaggttcaaaattactaggaaaaactatggcttataattaattactaaagaaaaggcttataagtactggaaatggtgatgctgaacaatctgcaactactctgataaagaaaaatgttggcagttcatgggtatgaagagcaaacctggctgcttctgaaattttttcctgggatttatctaaaaagtatgctctagaaccttgtttttgtagtgacttcagaaatgagcttggcttctactgaacatgggttcttatatagtcaccattgttttttctcatttaatttcctgacaacaaaatttgactaaagctttgcctttagtcaaaatttcaaccataaagagctctgttttagatgcaatggttagctaaatgtattaagaaataatatattcccacctgattttcttcattttactgtcatgttcataataacacacaggcagaggcagctattgaaaagtgttgtttctttagtatttgtaattcataagaaatgtgttctgacatttctcaaaggagagcacagataaaccacagtctaatctttggctttcattctgcccagagggttttgtgctgacagtatgtgaagcccagacctcataagatctgtcttgagccttagggagataatcttcatagtggatggatacttacatgcaggttttttttctaacttagatgaaaactacttccaactcattttcattttcatataaaaagcatagagaatattaatgatgacatataatacctttttatatttcattaacttggggattaaatctaaataaactgtgcagcattataagataacttaaaactctgtatattatatccctgataagagaaatatttgtaagatctttagaaatcttcatgtttgggaatgtaaaaatgtttgaacagtcttttgcttttgttaggaattgaattttggctgtgaatttttaataatttatttttattaaaataaatttattttaataaaaattgaatttttattgctagctcttcaactttcaccaacatttaatttcttatgttggctgttactcattcacaaacctccatgtttgtatcattgaaaaaaggatgtatgatcatatgaaagaatgctgcctgtaggctaggctcactgatgagcacagcagctcaaatcctatttgccagccccatggcatgaatccttcaaatctgtgtttcagtcaagtacaaatccccgtagtcatggatcttcaggatgaaaactgattaacattaaatcctcacatgccaataatctgctatactgtgtttttaaccatattgctagaattgaagtatcacctctttaatcagccagttgtttaaaattcttttcacattgatggtggattatctgaaactatatattttatgaccctgaatatatatggctaattttatcctaagtcctcagattcattaaaatctagctgttgttaagtttgtgagcacattatacaatcagcccgattttaaaaagctctaggcaacagagctttgcactattcaatatgattatttatttgtgtaacaaaagatcccaaatatgaccaccatgttctagaaacatactgcttatttataggttaaggcaataatttccaatcctagctgaatattataattgcctagagtgtatttaaagtattctagtaccaaggcttcagcctacatcaaataaatcaaaataatgaaatagtaatttttaaaagcttcccaggtgattctaatattctgccaagattgggaaccaatgggttaaagtgattttttttttcagccacctggaaataaaatgctgacagaaatatgcaggtgcaatgaggtgactgtgggtaaaatataacagatgcaactaattccacacattttattttaacacacacataccggacttactagaattcaggcagggttttaagtggttgactcatttaaccctcgtatcatgtttatgaggaatacactaactcatccccatttacagaaaagaattggattaaacagttttcttaaagttatacagttgataaggggctgagcctcacttcagaatctatgttccagtccgttgattctcagactgtggttcccaagtcagctgcatctgtgtttttggaaaatcatcacttcaaacttaccagagaaaaaggtttgtaagtactataattggagatatcaaacaacttgttgttctcatgataaagatatggatatcatagatcatggatatcaatagcacaccttgctacttctgaatattttcccggaatttgtctaaaataaatgctctagaaagttatttttgtagtgacttcagaaatgaactttggtttctagtgggttttaacaagttctcagctgggaacttgttagaaatgcaaattctcagaccggatttccacagtttcatagtcagtaaacctggagtctggcccgagaatttgcatttctaagtttcaagtttctgctgcttctgctggtggtctgctaagcacatgtggagaaccactacactgtctacaccacctctctaaattagccaacgaattttactgtattgtccagctacactcccctatagaatagtctttttaattataagaacaatataagtgtaaaagtccaagccttggtggacataaattgtttctattactcagagtcacctttgtttgtttggagagatatagactggaatggcttaagttgatgaatctgtgtgtaaaatgtacaagctgctgctgagtttcctattagggattgaaaaagtgacattaaacaagcaaaaaggcaatgaaagaaatgagattatagatatagagtatcctcatttcactatgcctttgaccacaacccaactcattttcccttttagatcttttatttcatgccattttcactccgtttccctttggctaaataactcagtgattaacaatataatgcagaaaattactattacatagtcatttgtagcttatatttaaaagcaattagaagtcacattttaagatagtactattaatcttttgtttcatgtagtctgtgttggaatgaggggtatatttggaattttgtgatcatgagtcatgttgtaaaaatgatataatacgtgtgtgtgtgtatatatattatatataatgtatctgagacaaataatttctggaaagaatatgagacagaatatcagctaacatttataacaaggaagataacaaatgatgaattcatatattatccttccagtaatatttcagctgcaaaatctcagtttttgtgtaaatcatgcataatgttccaatttatttttgtcagagcatagatctttagttggcccttgtcaaatacaagtgtatatctcaatctctgtaggaatgtattttaagtacagttctatgtactttgtaatctctccatttataaatgtcacaatatgtatttaaactcagaaacaaagctattaaaagagcatttttaattcattcaaaaattgtgtttgtgttatagacgggaatacagaatttaaaaatatagacgtaacagttagaaaacactaatagagttttattctgggacttggcacagagtaggggtctgctgagttccactcctattgcatgattcctttgtctattacaaggcccagtctctccatttgcaatcttcagtttgatacattccaggagtggcaggaagacaggtctacatgagagaccacaccatcagagttgtttcaccagccacattaatcacaaaatggaatcatttttgtagtgctattttacagatacataaaaaccaactatattctacaaaaatatgctccatccaaaaatactgctacaaaccaggcgactgctaaaacttctattagtggaggcaataagaattagataaataattccttaaattatactccccttttgtcattgccaccatgagaactatgttatgttttggaatgtgggaaaatgatactacttttctgctttatgccaaatcattttgagactcaatttttattcatattttttcttcattgtttccataaaggatttgtgtgaaatgactaagcaaacatgtttttattacattattattacaggtttgaaaatctcacataatagtttatccaaatgcagtgattattgagccttgtttttgtcattttaattgtggttcttgatattagcttataaggataacaaaacaaccagaagtctggtgaggttttcaacttgagaattatgaaaaaagttcatgtgatggtggttgctatagataagaaggcatggaaactatgtataataatgaataatacagtgaaagccttttggatattgctgttatcctagtttctgaaaactctaaagcccctaagtgaagttagaaatgtggaaaaagtctacggccataccaccatgaacgcgcccaatctcgtctgatcctggaagctaagcagggtcgggcctggttagtacttggatgggagaaatgtggtaaaaatacttctaaaatctctgcatactatgagtaatagtagtatacacctcatggagatattgtgaggattaagtaaggtaatatatgtaaagttcttagaacagcgtctactacacactgtcatggaactctgaaaaatcggtaatgaattaaccaccaaaagagtcacttaaagtttctttatgtggtatgcctaaaacaaaaagctttttcctctgaattctccttgccattttcaaaatatctgcaagtagtgttcagagtgtgtcccttccaagctgtcagtttaggacgtcatctggcactcctaggctgcatgacacgatcttttttgtccctttcctggtacctgtttctgttcctatctgttgcctacaggaccatctgtccttagctgactcctgaagatgccactcaactattgaacagtcctctctaaatttgtcctaggtctttaactattaatgggatctatagctatcactttggaatgtgcaacagagatgggttaaaatccaattttaaaaaattgcttgcagggcatgattacaactatggaaaaataagcaaattgttcaaaggtttttttttttattgtaggtaattttatttcttttctcaaatttttataaatcttccacaatgagattgaaagattacagtatgaatgattgcagagtattttttttcatccccctaacacttcaaaaagaaaggtttatagttcttttttccccccatttttttcctccataaatacagagaacataatcatcttgtgaacaaataattatgtttaatgttttaatggtaatatatttatataattgtaatattagacctgaaaaagtcacttcaaagcaaggcataaatttcacaatttcacaatttccatatagtgtttctccatcttgtcaacgttttctaatgtttttacttatgttttatgtctccagattaccatagctagaactcccattttttcctacttataatgcttgctgaagatgaatgctgtgatcattctactagagctagaatttgacattatactgtcctctttaaatgtatttattaaacaaacgattcagccattctctttgtttctgtagtatcttatacttccacaagatcttctgtccaaatctgttaacattttactaatttagggcccaattattcacttcttacttgggttattgtagcattgacttcttgtctgtgaatttcagacaaccaaaaacaaagcgcatgtaatcatgagtgctaactaacgtagtctgagctcagccggattacatactgacacttacagcagagcttttcttgtgaatggcagtgttctgtattcttcttccagactagcagcggaggggagcccacagtggcccaccatccctggagtctgactgagctcacgtcgacctccttctacgatggctcaaagactcctctccttgtcttcagttctctcaccacacggatcacacaggaggttctcctttcttgtcattttcatcctcattccattctccatcccaaagtgaccaacctaagtgcattattgcccctttcttctccagaatccctctggcaatttcttcacttgcctcccagaattatttctgaaaaatcctttctgggaagttttaagatacttgacccaaatagcaacaacaataacatttccagcagtaaaaagaggacatttatactcccacagccttaggcaatcatactaattatcttagaagagttcacaaaaaaacgtggcaaggatagagtgctaattgtaatgttcactctttgacacaattaagctataaatagcatcttctgcatcagagtaagcatggtgcttttaaatatgttatcaaaataagtttgtcattttttatatccagtattcaatttttctgtcattcttttcctatggactatacaataattcagatgaatcaactattagaaagatttgtgggcagtattaatgctgtaactttaatagtctgagcaagaagcttaattggcactcacttttctttattcctgatgtaatagtctctgtagttggctgtgatgaattattccaccgtcgtgggtgccaagtggagcgattcctgattcattagtccattgctcctgaaatggagagttcactacttgtatggatggatcttgtgagatcccacagagcccatctgtgtgctactcacagaaatgcggacctgaaggcagtatcagcaagcgaaggtcagatgataaattgtggctctccaagccaagcttatgcagcagtgtagtaagagacttgacaaattctcctgaagtgaaaaattgcctttcagctctagctttgtctttttttttttttgagtaaataagttattgcaatagaaagagaacttttgattaagtgtttaattattgccacttgtgtagaaaatgtggcatcatttcaaagggacctgggcttcttttgggggagagagttgagactggaatgcagagcatcctaattcttgcagtgtatcctttcagtacctaccaatctcttgtcacccaggtgaagttggatgggagcatgccatggagaacacagagactcactacagtggtgtgaggaggagcaattagatacctgtatttggaccagcagggtctgggagccctacgggtggtgctggagcacaaggaattggtgggagtgggaaagtgatggtcttaaattgacacaaggatgcagaggagcccagaagatgtgttggatgttactaatctctacactaaggaaccatgggatcatggaacactgttgatagaagaaatgttggaactagagattccagaccatttagtttatagccagtgaaaatgaagcccaaagaagttccatttgagatctcatggtcaggttgtggcagagctgaaaataaaaaccagtcttctgattcccagtcaatggctttctctctgagctctttgcagcttcattagagacattctgtcaatagttacaccatgtctactttctgggtggctgtttttgtttccctggtttttttgttcataaacaagcttagagcataataaacaaattttttttatttttccttcatattttcagtgtgactacaaaagtttgtaaagatgttaatttttctaaaatttctaaattttctaaaatttcaccaccaaaagtttcttcaaaactacagatgtccagctacttatctggtatcaaacacatcataaatctgttaaatattgatgcttccagatcatttttcttgatgctcagaataacactgctgcatttccattaaattctcagcattaatgttttgctttggatgtttgtctcctccatatctcatgttgaaatgtgattctcaatgttggaggtagggcctggtgggaggggattggaccatggaggcagattccgtgaatggcttagcaccatcccttcggttagtgagttagcactctgagttcctgtgagatctggttgtttaaaagaacatgccactccccctgcccctcttgctccctgtttttcaggtgacatgcctgctccctcttcactttccgcaagcactggtaagcttcctgagactctcactaggagcagctgccagcaccacacatcttgtacagcatgtagaactctgagccaattaaacagtttttccttataaattacccagcctcatgtatttcatttcagggaggtaagaatggactaagagaattagtaactaatattttagctttgttttcaatatttataagtcagggcatttataatgttttaaatgcagataaacttaacaaaacaatcagaatttacccagttgtttttatcagtgaagcaggttattctaagtaagcaactgattgcacatctacaattactacatctctctatctgtctatatatacacacacacacacatatacacatacatatatataatgtatatatgtgtgtgtgtgtatatatatatatatacagacacatatgtgtgtgtatgtgtatgtattatatagtggtgattctcattaaccttaggctatttttctgtatatgcagaggataaactggaacatctgctgtcaagtatgatacttttcagtagtatttttgcaaactatcatcgatttcctttttccacatgtaaccttaaaatgaagaattttgtcttttcttttaatggaggtgaaattttcttccttagattaccctctgtaaagcactttattaaagtgctttacctaagtgtccatgaaataggaatgctgggtgcttttgtatcccaggtgtgtcattaagcgaggctacagtaatgataattctgccaaattttcctctttctttcacatactgataggaggaaggaacatgatgactaaaagctcaatgctggctttacacacatcaaatcatttaatatccttatgatgaggagggagcatataattttttcaaattgggaccattttagaatgaaagggaacactgttaatgacttagaggcaaaggatataaacaaacactatcctaggaagttgaggaaatgtggtcattctaccttaacccctagatgagggtatcaaaccctctcattgtacaggtaggggaactgaggtgcagagaggatatatagtaggcccgaggttgcatttagaaagtagatatccagaactccaactcaggactgactgacttcaaagcagatgctccttcctctagactgcctttctatgcagttcagcatttccttcctctagactacctttctgtgcagttcagcatttcccagcctgtttctacaaacatgaaattttgtagccatgattgcaggaataagaagggtgcctgcttgaggaagatagagatgtgctaaacatcctaactgtttctttgtatgcttgattcattacgcgtgtatttagtgtgctaaacagctttgaggggcctcaggtcgcagggaggagctccccatggccactttttccctctcccactggcagcagcacctggtctgtattccaggcttctccttgacatattcaacctgagactctcaactgaagggtttatcttcccttcatagaggttcattgcttatattcttgactcagcattcatgtcatttcccaaattcgaaaactccaggatcaataattaattattgagtaatgattacaaaactaaaggaaagacaggcttttcccctaacttgatagaatattttattccttttgttttcttttctacttactatcactcctcttaatatcattagactcaaagggaaattttagtctacgcaaaaaggcaaattaaaatagaaagcatgtttttatacccatgaaaaaataaataaaaggtagcctatctatttaaaatttatttcattcgctaaaaatgttaaaggagtaacatgacattgtgtctgcttctttttccttttgttctttttaattccacattcacttgctatcctcagattactatacacatttaaacattaaatttaaaaagcataaattaaactatcaaacccatccatataaccttaaagaacacaaatataaaattttaaaaatctactaaaaaagaaaatataaactttcacttctcctcttctcacccacctgcccatttatagggagagtcttccagccttgctgcttggggtcccccacctcctccagtgcctcattatctcttgcctacatagttttagggacttccttcaaacattcctgccattttttttcttttattgctaccagggtcatattcctgaaaattaaaccagataatagcacgacttggacagttcctgtagtgttctctgtagcctgtaagataacactcaggcttcccagaataatatacgatcagctccttagggaaaacaatcaatctctcaaacagacagaatgaaaggtggcatgccaatttctgaaagaaaaaaaaaaaaaaaaaaaaaagacaaaattataaggtctgtcttcattaacactagttgtgaacagagctgaccctgacccaaactacctgtgactgcatcccccaactaccacttactggttgtatgtgtgacctatggcaagttattttactaacttctattcctcaatttcatgagtgtgaaaagtgtgtaataataatgcctacctcatagatttgttgtcaggattaactgagttaagattaataaaagagcttggaacaatgaaaaacaaaaaagagagagagagaaggagtgagggagggagaaaacattactatttcagggacacaccgtaaaagctggtggttgcacagagcaaccaaatgttagaatgtggcctgcacaccgctttccatatccctgagtctaggtatgtgggatggaccaccttgaagaagagactcctttttctaatttgtacaaaaactcctccacttgccagtgcatgtgcccacagggcttcctccatctggggatcggcatcttttcaatgtgtgccctactgttccgtttgggctggctgtggccctgactctttcctgtgatagactgtaaatctcaagggtagggctgtgtctttatagtggttccccaactttaatgtgcatatgagtcagctgggggagtcttgttaaaatgtaggttctgattctatgattctgggtaccgatgctgctgatccatactttgaatatccaggttctaaaatctaatcgtgttcttagcatataataggggctgcatgaataaatgctgactggatgggtaaatggaagcatgagaaagaaggataaagctgtatttcatacacactagagacctagaaatccatttttctaatgtatttagagaaatgatgccaagtaaaggtaaaatgttgaagagttgtgaattgtatttttccataggtaaacatttttaaaattcagggccagagtataaatctattaaaggagcttcctgcacttctcctggagcttccttgtagctcaaataataaagcatgacctccacagtagcacagaaacatagatacttggggcacatcacatattaaataactactctataatatttgtgtactctgagatttatgtaatttggggggtaatttagggcagcaatattgtttagtatacttgaaaccattcatttcaatgttttcccttaaaaaacaaaaacaaaaagtgtatccttcatcattggtgatagaaaaacaatgagggcaagcacattattgctttattgagccaggtatgtctccaaattgcttatctttttttcagaaataggaaagtgaggctgctaaggaggatgaggctgggcataatagaacatgtaatgggctgaccaccagagactggccctcctgattcatggctgagtgatcctggacatgtccgtctgggctcagcaccctcagctgcacagttcaccaatccagcatctatttattgagtgcttactttgtgtaaaggccctacccgaggcaatatgagtgagtacactgaattaggtgaccccatgctccatttgttagtctataagtcagtaatatctgtgacttgccagaatatacatgaatacatgaattaataagtaaacaattgatataatagctcaacaaatatatacatatatacatacatacatgcatacatgtggaaaatcagcctgtgataacagcagatttagacatccttcaatttgttcctatatttgttgttttcctgtctttatataattattagagtaaatttcttcttagttgaattagacattttttcagactttaagataatatttgggcaaaataagagattaatctaatctaagccaaactgttgatttgtgtggctctttacttcttaatgatgagtattatttcacacttaggctttcttttgatgcctttctggaaaggaaaataaaagaaaaataagtatgcatttttgtcctctaacagcctgtggcaagtagcacaaaggcggcactcagctttctaacaacaccgtcttgaagaaagtgtttgtatcactttggaagggaggtgctcagacagtcccatagtcagggatgcgcaacagccagtggttttgtgctgttaggataagggtagtgttgcttatggcatttccaaaatgaaagcggtttttgttttttccaggtaaacgtaaatattttggtttgcctaaatatttaacaattaaaaaagaaaatcttatcgtcagccaggaataagcttgttaaagcctaagtgtgtttttcttcgtgtcatttataaatgttctttcataaaacacatattagaagctatgtataacatgagaaaatgactaaaatagggagtccatttctggggtctgtttgctctcacttcagttgtccagagagatgatgttaattgaccatatggcaaagttttagtgatactaggtatttctcatctttacattttatattcttgaaacaaatattttagaattcatcctattggccatttcttgaattaggaggtatgacccctgcctccataaggtgcaagaaaaaaaaaaacgcaagttaaatagagccattagttaaaaacatttccatcggatatttataaaataagagattaattttatatagttgccactatgtaaaaaataaaactatagtaatttggaaacatttctattgagccccaaatagggagactgtttcagaaagagagtatgttttaaattcaccattttcaatctaatgaatatgctgatttttcaaataagcctgttagaatggcagtcaccaacctttttggcaccagggcccagttttatagaagatagtctttccatggaccagtaggggagatggtttcaggatgaaactattccacctcaagcattagatcctcataaggagcacacaacctagatcccttgcatgcacagttcacagtagcgttccttctcctatgataatttgatgtcactgctgatctgacaggaggcagagctcaggctgtaatgctcacctgctgctcaactcctgctgtgcggccaggttcctaacacaccttccagtctgtggcctggggtttgaggactcctgtgttagaccacatcagcttctgctcttactctgtttcttttgtgcatttgtgcatgcacacacacagagacacaatcagtgccctaaaataaaaaagaaaaaagagacagagacagtgatgacaaaatataaagaagtaaacagttctggccaggcgtagtggctcacccctataatcccagcactttgggaggctgacatgggcggatcacgaggtcaggagatcaagaccatcctggctaactcggtgaaaccccatctctactaaaaatacaaaaaaaattagccgggtgtggtggcgggggcctgtagtcccagctactggggaggctgaggcaggaggcggagcttgcagtgagccgagatctcgccactgcactccagcctgggtgacagagcaagactccatctcaaaaaaaaaaaaaaaaaaaaaaaaagaagtaaacagttctaagagcaatggaggaaaaagcataaaattgactatataatataggattaagaaaagttaaatgataaaatagaaaacagaattttttggatagctcttaagtgataacaacaggatgtgagccgtggttgcaggacagtatcttaagggccaaaatagctccacattctctaagcccaccttgtcctgtgagcttcaacttgcattgtctgtcttccctctgtaatctctgcccctgaatcttcttcagctattcttctgagaatgaatcaacagtagttattttcataatgttgtctgtaaaatagggcaaactatttttgcatcttgcaaatttatctgcacttcagtacaaataccaaaaacatacagagcgaacttttttttttttttttgagacagagtctcactctgttgcccaggctggagtgcaatggcgtgatctcagctcactgcaacctccacctcctcagttcaagcaattctcctgcttcagcatcccgagtagctgagattacaggcgcccaccaccacacttggttaatttttttaatttttattagagacggtgtttcgccatgttgcccaaggctgatttcgaactccccagctcaggcagtccacccgccttggcctcccaaagtgatgggattacaggcgtgagccactgctcccagcacatagtgaacttttattccttaaccatggcacatgtattcctatgtaaaattgcatgttttgcacatgtaccccagaactgaaagtataataataaaaaaagagttaaaaaaatgcagctcttcaaatttggctccaagtgtgatttctctctccttattcttaaggcacctctcatattttgctctcaatgccagtaaaaattctagcagaggaaatgcttgttaaaaactagatgtattggccgggtatgatggctcatgcctgtaatcccaagcctttgagaggccgatgggggagaattgcttgagctcgggagttctcgaactcctgcagagattacagaaggaagacagaaaatgcaagttgaatctcacaggacaaggtgggcttagagaatgtggagctattttggtccttaagacactgtcctgcaaccatggctcacatcctgttgttatcacttaagattggacagattgagtcctcatctctccaaaaattaaacaaatcagctgggcatggtgctatacacctgtagtcccagccactcaggagactgaggtgggagaattgcttgagttcaagaaattgaggctgcagcgagctgtgatcattccattgcactccagcctggggaacagagtgagatcctgtctcagatagatagatagatagatagatagatagatagatagacagacagacagacagatggatttaatattagttatactgcagttttcttccttttcaactcatcactggagaacaagagtaagggttggaaatgaaatgctgagctatacatgataaaatttcagcatagagataatgatgaactccaagttaatacctaattaacataagaataacggagtcaaaatttagtctcttgatccctattctgaacccaaatctatacatgactgtgatgatcacttggaaacaggtttgtttgcctgtacatctgttgacttgatggtggcaaaaccgaaagcaaaagaggtaagtgatcccagaaagctgctctcataagaatggctactaagatttccttggataacaagcctgaattttgtattttatgactccatctcttatgattgtgcaaactggtctcaggagtgccatcctttccactccataataaaatggtcacagttcattagaccttttaaatgaaatgttgcttcccagctctcaattgagtgtttcctttacatacttgcttgacatacctggtattggtcattataataatacctaggatatggtttttgcaatgcctttttatatacttttttattgctccttgatgaatgctattctaattaataatcacattttgaggttgcatgagtacctatttcatgtctgccccgggagagttttcttatcaatatggagtccctaacacatggtcggtacttgataagtatgtgtgtattgatttcctgccgaatggcctctgatgggcttattaaccttacctaaggaaaaaagaccaatgattattggttacataggctgagttaaaaaaaaaaaggtaggtcttaggctgtaacattagataatcttactattctgcctccaaatctttgtgcaatatgatgggcttgtgtttacagtcattcagttaaccaactctgaataaataaagacataattatactcatggtattaggtggaacttcttggtaagaatagtgtccatttgtctttttttctctgcattgataagattggcttgtaattttgttatggtagagagagcaagaatgagaagaagcaacagagagagaaagagagagagagaaaggaaaaagagagagacagaaacagagagaccttgctcagtctataaactgaaaaatgcatgttgatcttataattttatgtttttctctagtagactaaatcttgaatggtcgaatcattctcatttcatttttggagcttttctgtcacataatttagtggtagcatgactatataatatcatataaaccaagacactttaagaataaaagaggcgcctctataattatccaagaatgaaaagcataaacccagactttatggtcacattgtcattgtttttctttcctttggttcataccccattagtgagccacctctgtctgactctgaacagatgcaggcaagggccttgctgagtttctggtgctcatggcctgtgtggctatgctaatcctttttggctttgcaccaagtgaaacatctttcagagacatgaaagatattggcatctcctgggaaaggctgtatctattttcctctgatacatatgtggacaccattgggaatctaatctgaatcaaacagcagctttgttttccaagtgtatattatcaatatactgtaatggacaaaaatgccgtaacatgacttagtgtagatcatgccacatttttctcttgagccaatcatcatagacttagcctttctttctcaatctcaatctgtgagtaattataccaataatatttccaaattaagcccctatttcatgccatgctctgtgccagacacttccccacattatttctaagcattaaaacaacctgcaagtgaagaagcatatcctcctgtaaaatctgaagaaaaaggaaaggagagaggctaagacactggcctagttagtaaatgtagattctgggttgcatcctgggtctgtctgactctaagccatgttgtttctgctaaaccctaatttctctttaataataccataaacgttctagaacatatcttgctctcagttatgatctgatagcagtcatttgctgtaaatacatggataaaggcactttgttttattttattttcatgtcacttagaccattgttaagtcataaattaggaaaactaaacagtcacaaaggtaataagaactcaaacttaggtcaatcagaaattcctgatgttgaaactgctatcataccatcagcttcttaaggattaaaacctgtttctggtgctttttctccatgaagatgaattaacaaggttttgttctattctaaagaatattattttagagtgtgggatgctttattatgattatgcactattagagttctcaattctataaatatatgctttaaaatatagcagcaaggtacagtttcagcaccttatcaaccaagtaaggaagtatgtacctaaattattactgcttcactgacaatttgcaactttaatttattcacaaagtttgaaggaattatatcccaactttatatttatggatattttaatacaaaaagtaatgttttgtgcttgttccaagaaaatcttttcatttctaacaatgaacacatactgagtaatgaaaatagcaaaatctcatagagaaaaacaaatatatctccttcaaaaattctctcaagagatgaacaagattaaaaaatatttttagtagccaagatgtggaagaagaaaatgtggtgtgtgtgtgtgtgtgtgtgtgtgcgctcacatgctcaggcatgcacatctacgcatatatacatgttatgatgtatgtgtgtatgtgtaaataatgaatagtatacagccttaaaaaataaggaagtcctgccatttgtgctaacatggatggacttggaggacattatgctaagtgaaataagccagacacaaaaaataaacacctagtgatcccacttatatgtagaatctaagttaaataatataggagcaagtagaatggtaattaccagaggctgaggggagagggaaatggggagatgctggtcaaacaacataaactttattatgcaagataagtggagatcctttatgcagcttagtgcctatagctaataatactatgttgcatacctgaaattgctaagagtacatcttatagtaagtgttcttaacacaaaaaatgataataaaaggaatggtaggaaatttggggaggtcatacatatgtctgtggccttgtataagtctgtgatggtggggatggtttaacaggtgtagacttattcccaaactcatggaattgtatacattaaatatggacagctatttgcatgtcaataatacctttataaagtgggttaaaatatttctgtaatgaactttatttctcatcaaagtaagatcatgggcatgtgtatgttgacaaaaatgtgaggttttttttttttcctttttttcaacaggtctgcatagagaatgctcaatgttatggctattgtagttagccaatacagtaggaaatgtgctcaggcaaacatttatctgctcaattctagtgatgcacatagaaactagggtggacacagaaagtcctatgtgccaagtttcctcaagataatcagcaccaatttgtggatggtgtacaagtctttgttgtattattctccattacttagtatgcccaaaatataacattaatacaagatagcatcatcaatttagcttagatggaaggtctcatttccatctaatgagcaacatttggccactccaaaatgtggaattgctctaaaaggattggtttcacaaagatctctactcatgatgtgccatggtggtaacatgatgtgccagaatctctactcatgatatgccactagttgcacatatgtaaggtgcaaacttttaggtgagcaactggatcacttagctttgttggaaatacttcctcttcatatggcacaaattaatttataacacacaagacatttattatcctgtttagctttctaagtagcaagacaggtaattttcccttatgtgattatactgtgctatttataaaactaataaaaattttaggcctttatcctactttagagacacaataatatgaatatacatagcaatttagaaaatgaatattaaataattttaaattttgttataaaaacattgtaatggaaagaacaatggaccatctctcagaagctctaattctggctctcgcactgcccgtttctagttgtgtgttcttgtaggaagctgcagacttgaagtctcattctccttatcagtaaaagatggatgaaaccacattgcctgagtgaccataaggacccaacgaaagaaagcacatgaaagttctctaaaagccgtcaagcactgtatacatataaactagtattcataaaatgtaacatttgacatacttttcctctgaatcttaagtaaaatgaaatttgcttttgataggaaaatatcgttacaattatttaaaataactaaatttcacaaatttttatgccaagaaaatttgatagggaactagaaacagatgaatgtaagtatcttaaatctaatctagcttttgtaaactgtttattctattaggatgtcagagtttatagacaaatggccaaatatatatttttaatttgcatgatttaatttttaaaggtactactgccagtaaatattcccccttaagttctctttctctctctcctatttttcttccctgacatcagatgtacacacaattaaggcaagattttttatagtttatgcatttctgacttccaaacttttctgaaccatcctctcctagaatttcttgccatgtaatcattttgaaatccatatacctaaatctatggtgtatatctggaattctgatctcaggttccttccctagctttcacaatctctaagatgccacagacattttatcttcaggttcttattacttcactaacccattccttttcatctgccagaattaggtttgcaggagcctttcctccaggcacatctccttcttgggagtctaaaacttctcctagtctttgaccaagacttacagaagatgccccaactgttgatgttcactgtcagcattacttcctgcacttcacttgatcatagacatcagtctcttctccagatagcctgagctgttgtagctggttctgcagtcatcataattctgttcccttttctctttgtccttcctttcatgttccatactgcctttactccctcaggtccacaaacctccacagaggtgttcatcttcttttaataagtacttctgtgaaccacttgtagcagaaattgtttgtaagaaatgatacattccctgtatcatgtttcctgctttccctatgtcagtctcacagacaggttctgttttcatgattctatctgggtatgattctccataacctcaggattccctgatccattactaagggtgcttctcagagcttgcttttcatctctattcctttttatctccacacatcttcctaaggaatatcatttactctcaccacttgtatagcccagtgcttactcatcatctactcacatattcccagaaaggactgaactaaaacagttaatattacattatagaatatctgcccaattttgtttcttcagagtcttctccaccttaggaaatcattgaatgagtcaagttggatactacagtgtgttcttggattcttctctttctctcacttttcacactcaatttcccctaaagtatctaaaaggctaaaaagccttttctgtctagacaccactgttgcctcttacttgggccttctgcagtagcctcctgactctctctgctgtttccactcaactttccatatagaaggaatagagctcttctaaaattgtaaatcagatcataccactcgtctgcttaaaaccttgaaatgccttacattttcacttaaacttagcattattaccaagcccaaagttaataatcaatatttatatctatttatttaatcctaccatcctatatggtaaatactactaatatagtcattgaatagacaaggaaactgaggcacagaaaatgcaggaaacctgtccaagttaatccaggcaataactactgactccaagattaaaacccaggtagttgctctcagagcctgtatggtaaactatcacaggttgcagttcaaaggccctatagagttggtcattgccaacccacccgttcaacctcatgatatccactagaatgtaagcttcataataataaggatgttgtctacttgtttcactactgtgccccagagcctggaacaatgtgtgtatgtgagaagcaaactctcctcttcttgtggactgcacatactggtcccagagaacccagagaacacttctaaattgtatcatagagagtgcctccttatctttaaggtcttacctaaactgtgattccctactctcagtgcctccctccacccaaaggcccccactggccaccttatttaaagcaagccctatgtgactattcttatagcattattcaattaatttccttcctaccatttagcccattttgaacttactgttaactaatatactcttttcccttttgacttacaccagaatgtaagctccatagaggcatagacatatttactcttgtaaacccagagtgtctcatagcaagcatttaagaaatacttgagtgaatcagctttccactttcaactttaagctctcttcaagatcagagataatctctgaaaaagcatggttattcctggtgcattcataaattcaataaatactaagtgatttatcatgaaactaaaactaccgtaggaactggagatgccgaactgaacaagttaaacgtgatcatggacctcagagagcataaagtctggaacaagaagaaataataagtataacaaaaaccacaataacaaattattgcaatgtaatatgatgggctaagttattatagaatcacacattattcttggtaccttaagccacagtgacaaaatctcagttgatataagtagttagaccttctgctttctaacagtatcctctctctgttttagcaactggatctgattagggtagcaagaatgacttgattgatacagatagcccagtggttctcaacagagggcaattttgtctcccacccaggagatacttagcaatgtctagagatatttagcaatgtctagagatatttattattgtcataattgggggactcctagtcagtagaagccagaaatgctgccaaacatcttgcaataaccaggatgtttctcttcacacacacacaacaaataattttccaccccaaacatcaatagtaccaatgttgagaaaccctgaagtaccctaacactggcctcacaatcagacttctgtaatctttcaccaaagacatcataaaagcaatagttaatattttctaagcctcttcagtaggcataattcattcagaaagtatttatttattatactattatactataggggcataagaaatgccatgcctcgttggaaatctgtgtaatatgggtgggcatgctggagagatgtgtcctgagatgtttatgtaaaaggttgtatactaatttacaaaaagttctccatcatagacataaaaaggactcagagtctcagcaccatgagaagggcaagaggcagaaaattttaatgacattgtttccattacattctcagtcatctatgagacaattgtgtggattacttgtaatgcatttttttcttctcctagtcagacttggaattgaccccttggtgtgcatagatactcatgactaccgggtagccatgtgggatgcataatttatacttttagctttcataatcttgaaattagtgaaccattacaatcttttttatgtccctaaaagctggttttcaaaagaggttaagcatcaagataagtttacaaggtaaggcctggcgtggtggctcacacctgtaatcccagcactttgggaggctaaggcaggtgtatcacttgagatcaggagttcaagacaagcctggccaacatggtaaaaccccatctatactaaatatacaaaaattagctgggtgtggtgccatgcatctgtaatcccagctacttgggaggctgaggcacgagaattgcttgaacccaggaggcggaggttgcagtgagccaagatcacaccactgcactccagcctgggcgacagtgtgagactccgtcttaaaaaaaaaaaaaaaaaaaaaaaagaaaaaaaaaaaaaaggctgtcaacctaagagagagagcagcaaagaaaactggtttatgtttgctcccaaacatacattccctttattatgatacccactttcctcatgttgcttaactctaattttttattttcagttatttcataaaaactataccagattattctaacaacagttattaagtattgttactataatattaattgtattttcttgacttgacttaacgtattatttacatttttccactaattttttaagcaacctggtgagatatgtttgccttgttacttaagtggacaatgaggcttacagaagtgatgttgctttctcagggtcacagagtttgtaaatggcagatttggattcaaacccaggtttgtctgattctgcatgcagtccatgcttctaatcttcaagttattactacactggtatgtgtggtgatttttttgcaaatggttgaacaatgtgattcattctatttttggtttccatttgaaaggtcatacattttaaaactttagaagaggagccttagacatcaaaatatattataaaagtaagatattttggtagcacacaaaaaaagtttaggatcatttctttgacaatggcaggtaataatcaaaaacatgtagcattattctgaatcctgttgacattcaccaattgtaatatcttatcatgatcttatatagcattccatatgcatatgttgaacacatttactctcctgagcagggactttatctcttgagaggagagacttagtttggtttaaatatgctattcctaaaaaccattgatcatcttgaaattagtaattactgttgttactgctacactgattatttaagattttgagatagaaggtttcaattttttaatgtagttttgttttgtgtttgcatcatttttctacacacaaagtgtttagatggcaaagaaaactgaagcatagaatttttaaaaataaagttaatagttaaattgcaccatcatctctggttttatttacttgcactctcacgttttacttcccaccccccccaatttttatgcttcatatgtctaaaattgacaagctacaaaaaggtaaacaacaagaagtgtatttttctccaatatcagaatcttaaagctcactccccagtcacccatttgtgaatcttatctttcgagacatattatttgaatataggtacacagggtacccatatactttgaataccttgtgtacctatagtgtcgatatagatatagtatagatacagatatacacacacatatatacgtgtctatatttttaaacatacatacagttgtatatgtgtggtcccttctttatggctgtatatgaaggtatattaaatatatgtgtgtatacatacatacatacatatatgtatacacacacaaacatatatgcatgtctgtgtatataatatgtataagtttaataagtgtgtgtatatatatatatacacacacacacaccctgtgctgtactttagttttctttcactcaatcacatctctttaaacttactgtacactaacaaatagagatttacctcatttacctcattattttaaggactgccaagtggagtcactgaaaagatactgaggtttatccttagaaaatcagacttgggaagcattttaaccgttggaaataaaattttaattcctttctcttatattttcatttgtttaatttaactttaaagcccacaccagtcatgttccttcattacttctcacagtctcaaactcaatttcctttgttctttgttaccatcatttttctctgcctctccatatcacaatgaatgggtttccctgcatgtcaaaactcactgaaataatgttgagaaagctttcaggctttaccagtcatgttgaactcatgactcatatctctggaaataactccgtgtgtctcagtggggaccatgtcttgattatatatttcctaataaaggcaaaagaggtagaagattgttttgctaccctcactaatcttcagtctcaaaagaaataagtaaaatccattattattttgcgtatataattgtttagagactgtatataaccaataaaccaaaattaagaatgttaattttccttttgtttttccaaatatttattgaaggcccttcatttcctaggcattatgccatgtgtttaaaattcactaagaaaagtcccagacccttgtgttcgttaaagctgttaaagaaaacaagcgaagtgtttaagacaaagtgttgaataattaaggtgtacactggatacagtggaaatccagaagaggttatctaccatagctaaataggagtcagagtgagaaaggcttcaccaaggaggtaatgcttgattttaattttaatacgggaagatattaagccagctagagaagtggagtggttgccagaggtagagaagtgggaaaaggtccaggaagaaggaataagtcactccaaggcaaaaatcagcataatgtatttgggaaactgtaagtagtttggtaaaactggggtgtactgtgtatggatggttgcaaagaaacctaagggacagtcatgaaggctgatactgaggagctttgagtaactgaagttttgaggcagggagtgatataagtgaattttaactctggcagctgcacagcagatggagttgagaaagaagagagtggtcccatttcaaaagctactgaaatagtccaggcatgagctgatgagatacagacctaagcactggcaggaataatggaaagaaaataatagtttaagatttctctagaaattaaaaagacaggactttattcactcctgagtcattcaacaagaagaaaatcctatgaagtagagattttaattaccagtagatttgaatcagaatctcatgctttgtaacacttgagctataaaatttttgattttttaatttttgtgttattttatgcaccagtattcctggtgggtaaaatataaagatttatttaaaatataaagcatataataaatgttattgaattcaccacccaacccaagaaccagatcatcaccaataagtgagtctgtttacttcttccctattttaatctcgggttctcaaagcttaataagacttaaaaggcctcatgtgccttcaaaattgttaggggtttcttgtctccactggctccaaacaatatcagatgttcaaaactgtttcctacctttgttctttctgtattttcccttacatataaatctctagtcttcagagagagctaagaataaaaaaatcactcctctcaatatattgtcttctactatttaaaaatgagacataatagggatgaaagaaaattagatttcctagatgttttgtaggttctgtttgcacatctccgggaatgaagatcttgtatcctgtcgttttccatgctatttaatacaaccaaaatacatcttcctacaactcttttcctttatcagtcctgtggaaccacacagaacatgttcactttttttctgacagctcatctggtatgtgaagattattatgaccttctaagttttctcttttctaactaaatattcgaatattttcagtatatcttcttggttttcaatcattttgccatcctgatcctttttccctgaagcactatattatatatattggttaaaagcttaaatgacactgggcataatatgaatgcgtgaatttaattgagggtatgtcagaaatgttgcacattaaacatctaagaatagtcttctctttcattaaaacatatactctcatttatttattaacatgtatctaggtcaactatttgttttcctacttttattagagtcaacagtaaaaggatatattaacttaagtcttagatataaaatttaagtatttttctcttaaatattccctatgaaaaaggcaacaggacaaacatgatgatcaagatcctggaaatttggctacagtgtgagaaggaagacagttgtttacagtagcaactgtaacgtctggagggagtttatacccaatctaaagagtccagaatgttgccatatggcaatgtggacccaacattgttacaacttctaccttcaagccagctggaagtctgtttttgtttttttggttttttaatgtgaaattttttgatttgtaaatttggtagccaattgaaataaagaaggaaggaaaagaggagagagagagaaactctgtgtgttaatattgtgctagccaaaaaatacaaatacaaaatacaaaaaaaaaattcaagaaaaatatttctgtaggacagacatagcaattttgtaactcttgcttaccaatccctgctacagatgttatttaagaatagaagctccttgggcagaagtgtggagcaaaagaggcacagctgggctaaggaagccattcgagggctgagccagcaccaggagccaggacaatatctagccaaccaaggacacatctcctcaggcgtctaagggcaggctgtgacctgaggtaggcataggctgtcagcaaggtaggtcatacagggtaggcaggctttgtccagaatgccggtggagcaagcctggaaggaccacagggccacatggttctggtgatgggcatggcttagatgtagggaactcagaggccagccagctaggtgggaaatgtgaaactgaagccagttaaatggcaggaggtgggctacaggcaagaaggttagacagaaagctgatactaaaagaatggcagacagccaagactgctgaatttttagcctagaatacatttcattctttatgcccagaagcagtattggctcaagagctaaaatgaggctgggaattggcaaggataatataaagataatagaggccacatagagaataaacccttaatctgatttagcaatcagcaaaagattgctaaagtggtgataaattatgagataaggatatattaactgaagagctcatactgttccagtaggttggacccaaatcccttttgttaaagtagagcaatgatgagactattaaaaataatatagtcatgtgtcccttaagtgaatgcatcattctgagaatatgttctgagaaatgcatttttggtgaattcatcattgtgtggttatcatagagtgtatttatgcaaatatagatgttacaacctactacatacataggctatatggtatagcctattgctcctagggctatacacctgtatagcaagttactgtactgaatactctaggcaacagtaagacaatggaaagtgtctaaacatagaaaagttaatttgttgccctaaaacattacaacaatcatatcactaggcaataaaaatgtttcagctgcatcataattttaccagaccactgaccatatatgcagtccatcattgactgaaacatcatctaaaacatcaattcagccaagggtagaaattgattggcccaaggaggtccgtttagcaagacacattggaatgaaccttgaagagagaagtagaaattacagcaggtgattatttttcccatcatatgaagttcagaagttcagagcaagcagtgtgggctctgtcacactttagccggacatgaagtctatgtgagctccagattagagtatgtatgataactttacatctttgtcactcataaaagaggagagcaacactttgttagaagatcgaacaaaagcaattttttgagaataggagctgctttattttaagttaaagttcttttcttctgtgctgctaatgagaacatgtggctgccctcttgggattttacaacatgaaatcaaaaccatacagttccactctgaatattctacctttaaaatatggtgaagaatattcataataatcattacaggtgccattataataggtattgattattgtggagaaattggaaacaaaagcaaatatttttaaagcttctacaatattagattgcttagtagtatgattataaaacaaatttttagccaattattttgttaacaatagcttacctcgaataatagatcttacctcaaaagtagaactacttcctactacagctaagtttggctatcaagtcaagtacactgacggaattttgaagctttttaaaaattcctataatggctcatggaatattgtgatagcttttgggattcctgtgtcttcacaatccatgccatgactatatgcaagcaaacatgtctaaaggacctgcagttggtattgatcttagcactaccaactgttgtgtgggtattttccagcatgaacaagtagagataattgccaatgatcagggaagcggagccactccaagctatgtcatcttcactggtagtgaatgattgatcagtgatgccacaaagaatcaaattgcaatgaatccctaacaacatggtttttgatgccaaatatctgactggatggagatttgaggatactgttgtccagtctaatatgaagcatcagcccttcatagtggtgaataagcacaacgtccaagtagaatacaagggagagacaaaaagcttctatccagaggaagtgttttttatggttctgataaagatgaaggaaattgcagaaacctaccttggaaagactgttaccaatgctgtggtcacagtgccagcttactttaatgactctcagcatcaggctaccaaagatgctggaacaattgttagtctcaatgtacttagaattatcagtaagccaactgctgctgctactgcttatagacaaaaaggttggagctgaaagaaacatgctgatctttgacctgggagatggcacttttgatgtgtcaaccctcattgtttagaatggaatctctgacgttaggtctacagccatagccacccacttgggttgagaagactttgataactgaatggttaaccattttattactgagttcacacacaagcacaagcacaagaaggacatcagtgagaacaatagagctgtctgatgcctccatacttcttgtgaatgtgctaagcatattctctcttccagcacccaggccagtattgagatctattttctctttgcaggaattgacttcaatacctccattttccatgccttatttgaagaattgaatgcttacctgttccatggcactctagactccgtagagaaggcccttggaaatgccaaactagacaagtcacagatccatgatattgtcctggttcatggttctatttgtatttccaagattttgtagcttctccagacttctttaatgaaaatgagctgaatgagtatcaagcctgatgaggctgttgtttatggtacagctgtccaggcagccatcctatctggaagcaaatctgaaaatgttcaagatttgctgctcttggatgtcaactcctctttttcttggtattgaaactgctggtagagtcatgactgtcctcattaagcataatcccaccattcctatcaagcagacatagacctcattacctactttgacaaccagcgtggtgtgcttatttagatttatcaaggagagagtgccatgaccaaggacaacaacctgcttgtcaagtttgaactcacagtcattcctcctgcatcccatggtgttcctttgatttaagtcacttttgatattgatgataatggcatcctcaatgtctctcttgtggcccagagtaagtaaaggagaacaaagttattatcactaatgacaagggccatttgagcaaggaagacattgaatgtatggtccaggaagctgagaaatacagagctgaagatgagaagcagaaggacaagatgtcatccaagaattcagttgaaagctatgcattcgatatgaaagcagctgttgaagatgagaaacttcaaggcaagattaacgttgaggacaaacagaagattcttgataagggtattaaaattatcaactggctggataagaatcagattcagaagaaggaagaatttcaacatcaaaatctggagaaagtctgcaaccacataattaccaacctgtaccagagtacaggaggcacaccagaaggaatgcctgggggattccctgatggtggagctccctctgctggagcttccccagggcccccattgaagaggctgactaagtcagctcaagtatagatgtagcattgttccacaaagttaaaacattgaaggactcaaatttgtagcaaattctgtggccatcttaaagttgagctgcagtagttaactactggccaatctcaatactcgaatatggaacatgtgcacaggggaggtacataactttgcactttataagtactgtattataagtggaaaaggtaatgtcttaaacaattgtatttaaaattggcaccaaaaaattctataataatatggttttcacatagccaaactagcagtcagtatctactgaggagatggggatcttcagagtactttgaaactcacaagtgtgcatatgcagtgattatgtatttaaaataaattgtgactatttggtatctgtttcaattggtggaacatttattctcaatcactcaaacatttattctccaaagtaagagtcgtgaccttttgttcataatttttcttttccaactggaaaactgaaacctcgctttttggaaatgttgcttttagctaacaaagaaatagaatattccaatttgattatgttttaggaaattattttaaagtaaggcatcaaaatcaatctctttttaaagggttttcatttttattattgttgtaggaattaattacataatatcaaaagataaatgagaatataaattcaagatcctcaaagcctttcctttgcaattgtttctaagcaaaaattatccagacagtttctgttattaaatgtgtagggagctcctaggctatttgatcaagtcccaaatttccactttccaaagacagagaatccatggtcttcaccttaatagctgctttagtgagtgttcagtgggactggaagggccaaggctcagaaaatagggcagagtcaaaatcccatatgggtgatcttgaagatttccctcaatcagaacacaggagatggtggaaaggaggagcgagccagaggaaagggagccacttctaaagacacattaataatgtatctggtactcattcttcattctgtcttctgtaagagtatggaagtatgttatggccttacttaacacattgatctactgttaatgctatcttttcaccatagcgcattgctagcatttcagtgtatctattcaaaaaaataaatccttaattacaacagacaaacttttttgtgtggataaaagcctagtgattgccttacccataaagagctagctagttatctctccagactatttgtttcctttgatcattgtcacaacttgtctaatagaagtagtttgagttcatcatttgaaatagaaaggcaataaccctccagagtaggttgtgattacaagacataatattgaatttactaggaaaaagaagcagaccatgagacaaagggatttttaaaagcccactaagggaccagagttctaagacaggccaaattaatctatgctatttgaactgaaatatatgaatttatacatagtaagtgctactttgtatctggcttctttcactcaaaattaggtttgccagagtcatctgtgttgttgcatggagcgatggtttgctcattctcatgatatattcattcattctactggttgatatttgggccatttctaattcagggttattgctactattggggctattgcatactatcactactatgaaaattgttgaacatgtcttttggtgaacatatgtacatttatttgacataccaaggagtagaaatcatacccatagggtatatatatatatgtgtgtgtgtgtgtatatatatatatatatatatatgtgtgtgtgtgtatatatatatatgtgtatatatatatatatatatatgtgtgtatatatatatatatatatatatatatatatatatatgccaattcagctatattggatactgccaaactattttccaaagtagttgaatcaattgtatacttttactaactgcatatgaaagtaagtattactttatattcaggaaaaagtaaatattaaacttcagagtggcaaacttcagctttacattgctgtcttctttttattaagtcgttcaatctagggtgtctagagattgattgtaatgacttgtgggtggccttagatttctatgcttaaagggtttaagaagtgtttcttctataaatatatctttccaagcaaaaaaaaaaattcacaagtatttccatgtttaccaatgacaaaacatctaatgacttttgatataaataatagtactttagaacgcagaaaaatcttcctaaaactccaagtggagcaagatggctgactccagtttcctgctacttatcccccacaaaagggactaaataacaaatatatggttatttgctggatacaaaatcaacacacaaaaatcagtagcatatctaaaaactaatattacactgtcaagtaaaaaaaaattatttacaatagctgcataaaagtaaggtatctaggaataaacttaaccaacaaaataaaagatatttacactaaaaactataaaccattaatgaaagaaattgaaggcacaattaagtggaaagaaaccccatgttcataggttggaagaaataatattgttaaaatgtccatactacctaaaggaaagtacagattcaatataattcttatcaaaataccaatgaagctcttcagagaaatggaaaaaaaatcttaatttttttaatggaactaaagacaccaaataaatagccaaagcaatcgtgagaaaaaaagaacaaagctggagtcattccactgcctgacttcaaaatatagtacaaagctatagtaaccaaacgtattaggcccttctctcaattgctatcaagaaatatctgagatggggtaatttataaagaaaaaaggtttaagtggctcacagttctgcaggctgtaagccaattacaaagaagcatgatgctggcatttgcttggcttctggggaggcctcaggaaacttacaatcatggtggaaggaaaagggggaaccagcacttcacatggctggtgcaggaggaagagagagggaagggcagtgctacacacatttaaacaaccagatcttatgagaacccactcactatcatgagaacagcaccaaggggctggtgctaaaccattaaagagaaaccacccacacaacccagtcacctcccaccagcctccacctccaacactggggattacaactgaacatgagatttgggtggagacacatatccaaaccattcacatcaaaacaactggtgctggcataaaaacagataaataaatcaatggaacataataaagaggccaaacatagttcacacagctatgtctaactgatttttgacaaaggtgccaagaacacagttagggaagagatagtatcttcaataaatgttgctgggaaaatttgatatccacatgcagaagaatgaggctacaccactacctctcaccatatacaaaatcaacacaaattctagactttaaggagaatattaaagacttaaatgtaaaacctgaaatgatgaaactacaagaagggaaaatgctttatgtcattggcctgggcaagaatttttaaaccaagacctcaaatgtgcaggcagcaaaaacaaaaacagacaaatgagattacatcaaactaaaaagcttttgcacagcaaaggaaacaacagagtaaggagacaatgtagacaatgggagaaaaatatttgcaaactatacatctgacagtgggttaatatccagaatatgtaagtaatttaaacaactcaacagcaaaaaaactaaattaccccattaaaaaatggacaaatgatattaatagacatttctaaaagaagacataccaatggccagtgaatacatgaaaaaaaaagttcaacatcactaatcatcaaggaaatgcaaatcaataccacaatgagatactatctcattccatttagaatggctatcattaaaaagacaaaagaaaagtgttggcaaagatatggagaaaaggcaacatttgcacactgttggtggtattgtaaattagtatgtctattatggataacagtatggagattcctcaaaaaattaaaactagaactatcatatgacccagcaatcctactacttaatatatatccaaaggaaatataatcagtatgttgaagatatatctacactcccatgtttattgtagcactatttataatagtcaagatgtagaatcaacctgtgtccaacaatggattaatggttaaagaaaatgtggtgtatatataaacaatgtgatattatctagccataaaaaagaatgaaatccttcattttgccaggtgatggttgaatcaggaggatattgtgttaagtgaaataagcaagctacagaaagacaaatactgcatgatctcactcatacgtggaaactaaaagaaaagatgttatcaaacataccagagagtagatcagtgattaccagagactggagagggaagggagatgaagggggagaggctggttaataggcagaaattacaattagataggaaaaatatgttcttgtgttctattatacagtagagttaaccatcactagatggttaacagtaagatattatacattatgaaatatcagaagataggctttttaaaatattttctccacaaagaaatgataaatgcgtttatcattaaggtaatggatactaaatacactgatttcatcattatacatacatattgaaacatcaaattgtaccccatgaatatctacaattatagtgtgctaattaaaaaaaaagcattttcatttgttttttgttttgttttgttttgttttgttttttgagacagagtttcattctttttgcccaggctggagtgcaatggcgcgatcttggctcactgcaacctccacctcctgggtgcaagtgattctcctgcctcagcttccccagtagctgggattacaggtgcctgccaccatgcccagctaatttttgtatttttagtagagacggggtttcaccacgttggcctggctagtcatgaactcctgaccttaagtgatccgcccacctcggcctcccaaaatgttgggattacaggcatgagccactgtgccaggccttcatatgtttttatctcatggcagtactgcttgccttgtttccacatgatatatctgagatccaaagaagttaaaaggttaaagcatttgtataaatagcatcgttccatatcagatcttggactatgatctagatgtggagactgccagccatgatatcattcttcatggatacagatgtagaattgtgagccaaactctttaaagcatacgtgagttgtgattgtatcaactgagctttatttattccaggtagacaataccactgctaatttgcatggttgctttatgttaattaatgcatttgtttccttttgtaaaaaattagaaattgagtcatagaaagattaaatgcctggcttaacattatcagaaaatgacgttccttttatgaacttccagtcaaagaggtctccaacttctataacatcaagcattttaacagcatatgtgtattaggccattcttacattgctataaagaaatacctacgactgggtaatttacaaagaaaataaatttaactggctcctgattctgtagggtatagaggaagcatggtgctcggcatctgctcagcttctgatgaggcctcagggagcttacaatctggcagtaggcaaagtgggagtttgcatgtcacatggaaaagcaggaatgagagcgagtaggggaatgagagcgagtaggggtaagataatacacaattttattttatttcattttttgctttttacaactttgacttttaaattgagaagtaattttttaacctcaagtttaagggaacatgtgcaggtttgttacacaggtaaacccgtgtcatggggggttgttgtacagattattttgttacccaagtattaaccacaacaaccatggttatttttcctgatcccctccctcctcccaccctccatactcctgaagggtgctgtttccctttatgtgtatatgtgttctcatcactgttccccgtgtgtgttgttttcttctatacgtacgtacatgtgttctcatcatcttgctcccacttataagtgagaacatgtgttatttggttttctgttcctgcattactttgctaaggataatggtctctaactccgttcatgttcctgcaaagtacatgatcccattctttttatggctgcatagtattccatggtgtatatgtaccacattttctttattagtctatcatttataggcacttaggattgattccatgtctttagcattgttaatagtgccgcagtgaacacatgcatgtgtctttatggtagaatgatttgtattcctttgggtatatacccagtaatgggattgctgggtagaacggtagctctgctttcaggtctctgatgaatcaccacactgttttccacaatggttaaagctaatttacactcccaccaatactgtgtaatgtttctttttctcctcaacctggccagcacctctcattttttgatgttttaataatagccattctgactggtatgagatggtatctccttgtggttttgatttgcatttctctaatgatcagtgatgttgttgagcttttttcatatgcttattggctatatgtatgtcttcttttaaaaagtggctgttcatgttctttgcccgctttttaatggggttttttgtttttttattgtaaatttgtttaagttccttatagatgctggatattagacctttgtcagatgcataaattgaaattatctcctattctgtgggttgtccggtgactctgttggtagtttcctttgctgtgcagagttctttagtttaattgtatcccatttatcagttcttgctttggttgccattgcttttggcatcttcattatgaaatctttgcctgttcatatgtccagaatggtgttgcctaggttaccttccaaggtttttatagttttgtgttttacatttaagtatttaatccatcttgagttgatttgtgtatatgttgtaaggaagtggtccagtttcaatcttcttcatatggctagccagttatcccagcaccatttattgatgtgtctcttacccaattgcaaagttgcttccacattttcaggtatctttatagcaagaccccactccttggtaccaattttctgtattaggctgttcttgcattgctataaataaatacctgagactgggtaatttataaagaaaagaaatttaattggctcatggttctgcaggcttcacaggaagcatagtaccagtatctgcttctgaggaggcctctgtaaacttataattatggcagaaggcaaagcaggaggttgtacatcacatggtgaaagcaggagcaagagagaatgggggacgggaggtgccacacactttaaaagaccagatcttgcatgaactcggagcaagagctcactgtcacaaagacagcaccaagccataagggggtccgcccccatgatccaaacacctcccactaggccccatctccagcattggggattgaaattcaacatgagatttgggcagggacaaacatccaaactatatcaacatatggtggcaacccattatgacagattattatattaaatgagactgagtatctaaagagtgagagttgcattaatgactaaaattctggtataacaagggtcagctacctttctcagaactggacagatttgccactgtgcatttgttggttaaaacaccagtatctgtatacaagtttctttaatgaaatgtaaaattacagtaatttttaaaatatgaattatgcttgaaaattttattcagccattaaaatgatgtttataagctatttgaaataaccagctttaaaagtagactaagaaattgcatatgtcttatgatcacagctatgtacaaatacatacaaaaagactgaaagtatgtatataaaaataatgatggctctcgtgtgattttagatcaggggtgtattttgacaacttttaaaatattttccaaattttgtaaagtaagtatttattactttttttcacaaagaatgaaaaattattagaaagtttgactactagtgagagagacaaatggatagaatttttcagcagtaaacagaagatacacactgtattccaataacggggaaaaataaatagcaaagttttaggtctaacaatatcattaattgtatgaaagcagaaattcaacaggtcatatcttttaggacactaaaatggcagtagaaattataaattgtaatcaacaagtaatatctagccacacacaaattttgtttcttttaattaatttataaaataaataaaatactcaacaaattacctttaagaggtcacaatatttattactttaaaatgaaaaaatgtaaatagaaataatattgtactggagaaatcatttaaaatattgataagtagaggtgtgttcaaccaaccagtattaattaataacaacatgaacacatttgaatatatactattgataaaaattttatgattatatgatatttaggcctgaagcagtctcaaaaggattactttccatcatggtgctaagagtactgtaaacttttatgttaagtgtgctaacttacaggatgaattactaaggacattagcaccgatgtccttactaatgaaggacacattcaaaatagtacaggatctgctcccttggttaataccatgtattttccatcttttctgaatctctatgaaggaataaaacttgcagttttatttgtttcttcctatgagttttatgtaactttatgatttcacaaaatatttttatgtgccctagagaaataatacagtatttcttaaaagaaatcatgtgtttgtgtgggtctgcctgtccattccctttagatctagttgaaacatcatcacaccaagtttgtttcaaagcatgacaactaatgcaggaacattttgtaagctcatagtgtctgaaaaagaaaataggaactctgtagttcagcatcattaagaaccacatggatattttgtggggattatgggtgtcatatttctgtgataggttatacatttggaatgtgcatgctgatttgttgtgatccactaaggtactgcagccccttacaggtacacttttaagttttgtaggtcagaaaataaaactcaaaaattacactttcaagactggtaactttgccaaatgtcattactgtgaggcccaaaatgccacttttggtgagcaaattggggcatgcttgacacaagtcctttgccttctgatagttagtgtgggatagaagatccaatgaacagcatgaacttcagaaagcaagtactgacatgctcaaatcattctttcacacatccattcagcaaatagttattgactgtgtgccaggtgctaatctcagtgctgggaacgtggctgttgtgttagcctgttctcttgctgctatgaagatataccccagactgagtaatttataaagaaaagaggcttaattgacttgcagttcagcacggctggggaagcctcaggaaacttacagtcatggaagaaggagaagcaaacacgtcctccttcacatggtggcacgaagaagtgtcaagcaaacggagaaagccccttataaaactaccagatcttatgagaactcactcagtatcatgagaacatcatgggggtaaccgcccccatgattcagttacctcctactgtgtcccttccatgatacatggggattatgaggttacaattccagatgagatttgagtgggaaaacaaacccaaaccatattagctgtgaacaaaacaggcaaaattcatcccctcacaatgcttgcattcatcagcattcatcagcattgtcattgtagatacatctgagaagtttttaatttctttgaggacatatctatgccaggcactaggtgcccttgagccagcccaacattattcaaaatttaattcggagacacctgcatcagaatcacttggagacacattttaaaaatcagaattggactcttttaagaaaaagtctgaaaatctgcatttttgacaagcaccccagctgcatcttcacatgaaagtttaaaagccactgttccagcattaacgtttaatatttactataaggaaaaaataatagcagaatagttgaagccaaagtaatttgcaaaccttgtgaccataatcaaaattgttgactttccataaaagctgtggtcttcccattctaacactatattcagtaagaaacagctgcagactgactattaatgatttccagaacacatattgaaaaattaaataaaaagtgcttcacatgttttgatcctctactaactttcatcatttctcttcttcctgtaatttttgtagatatttttatgtcgactttttttccttcaccacagagtatttaaaacttttcctatcagttttgtgagggtgagtaagagggcgagagttatttaagcttctaatcagtgttctcttgctaaaattggaggtaaataaataattaaaattcacatatggaatacctataattaaaactatacatacagcaatagacacaagtttcctttgaaagcaacagataagagaatcacagctgttgttaaaagctgttttgcaaagaaatatgaaggaagcttgactgataatatttaatgcccttggaacatctgtaaaatggccttctttcagtttttggtaatttttgaaaactgaagaaattattacaaaccatttgctagcctaagcagcactagttttataaaattcttacttctgtgtacatcatctctgtagccccagtcaaatcaatggcatgttacataaaagcaactactgataggctaagtgcagcggctcacacctgtaatcagtcccagcattttaggaggctgaggcgggcagatcacttgaaatcaggagttcgagaccagcctggccaaagtggtgaaaccctgcctctactaaaaatacaaaaattagctgggtgtggtggtgcacacctgtggtcctggctacttgggaggctgagacacgagaattgcttgagtctggaaggcggaggttgcagtgaggcagtgagcagagatcacactactgcactctagcctggggacctgggcaacacagcaagactctaaaataaaatttagagtcctatttttcttgccccaacctggaaaattaccattcttgagaaaaaaaaaacatacgacataattcaccaactgcttaaaactacataaatttgttgcctttgtatacccttctcctagccattctgacctctgatgttttctcaaaacatcattctctctcagcctttaagttttgcaagttgaatcttacctgcttataaataccttctcctattacctctcttcccatttttttcacctttgatcctttaaatctcagcgtataatccccaatctgggaagccttttttcattgctccaacaggtagtccctttttaatttacagctccttgaaggcaggattctacttcagcatgcatcacactgtgcttcctcctgatgtcacctctgcaagtgccacagctggtcttgatcatcgtggagcccccattgtgagcactgctgccaagcctctgttgggtcaaaatgctagagtttagagtttgcaaactattggttcttggcaagctcttagttttatttacttggttcattgttcatttagtttttgtttttcgtttttttgtttgttttattttttttctgtaatcattacgtaaacattaggaaattgcacataccatagaaatttggatttctggctgtttttgtttgtttgtttgtttgtttgtttgagacagagtctcacactgttgcccaggctggatgcaatgccacaatcttggctcactgcaacctccacctctcagtttcaagtgattctccagcctcagccttctgagtagctgggactacaggtgcacgccaccacacccagctaattttcatacttttagtagagacagggtttcatcatattggtcaggctggtcttgaactcctgacctcaggtgatccacccacctcagcctcccaaagtgctgggattacaggcatgagccaccgcgtctggccctggctgtttttaaaaatcacaagatatgctaacatcagtcccagtagacaagaatttaaggaatagctcttcctttaacataagacaaatagcttttcacttaatctccttcaactctttgcccctggcctctggagtattagaatgtgtgtgtcccacttgctaatttaaatttcacatgtcttggaatggaggacaaaacattatgatagctaatccaatattatcttaaactatctcagtgaaccatcccatgatcttattttctcccattcagaaagactcagtgccttcttaaatgccatgtttttgtgtgtctatccatccagcgttgtgattattcatttgcgattattcatatgtgtctagacattattaaatcattgggttgagagtgtgtcttcttcaattctggtggttatgtagcacatagtggatgttcattaatagtaatatgttaattaactttgacatggaggtgtttatatgttgttgctgtgtgactctcagatgaaattcttttctattcaatattatattgtaagaggagaaattaatgttattgttaggagtgtgagataattacaatagaactactaagggagttaaagatcttcctaggaaggtagagtgttagatagagactggcaaaccctgtaccactaaaactttaacttgcatccagatcacctggggattttgttaaactacagcttctgattcactaggtttggggtggggcctgagagtcttcatttctaacacactcttcgatgatgaccatattgacacctcgaacagcaactccaacaggtttgaatcttcagtaggaatttggtattggttaagtggtagaccgctactccctgggacatactgtaatctgaagatgaggtctgtaggaggcatttcctagagttaaccttggttttaattcttcagtatgccaagaaaactgaatgctggattctggatagatagcttgtaatgggccagcagattttctttgtatagtaaacgtgggacctttacatatttaggaagcccccatttggggaaaaaatgtgcacataaaagaaggccctttgatttcagttgaagggcaagccatctggccctctttttgtgcagtaatcaggctaatagtgctagtggctttgttggagaaagcatagaatggtactttaaatctgttcaaggccctatttttagagtctggcagcacaggaatgaagtgtttatttcatgtttaatgcaaccttccacttcaaactagaaacgtttcttttcctctactgagtttctatcaagtctcccaagaaacactgccagctttgcatatccctatcctctaagatgattaactgtttaaaattgaaaagccttgaaaatgcaaatcctgccacaggctcctcgtggggtaaaaagacaactcaaataaaatgtttccagatggtttaggcattatgttctttatatcctcaaagcaagggagagatcctaagctggacgagtcggtaaagagtcatattgaggaatatttagcagcttctttttcagaagctgaagaaggccactgcatagttcctggagtggcatacattagtgagattctattaagcagctgttcggctctagtaagagctgcctcagtagaagggtaggatggcttatgtagtcttgttttttaatcattgtacatttgtaatctattttgcaatctcaaaacattttcttaacctgacagtttagcatttgagagcagctgtatctgctaatccaaatcaatagatcttatggtatgaggagtgcagttatagctttattagtaatactgaatttttacagaaagaactgtcagatttcttatcatagtatacactacctggagtaatttttttcccctgagcaatttagttacttgtttttctgacagtcacttaaagtatatcctccaccttttaaagagagacgttcaagttactgcttatttctaacttgcagtcacaaaatccataaaaatttggttgcttcaaaatagaatgagagaggagtatggattttgagcaggtgtcaggctgtttatttggtttcccccattttgtgcaaggcatttcatcatctaggccaccttaatgccaaggtacacttgtcatctgttgaatacacacatttagtatttaaatagcaatttgcattttcaaagtgttttgtctactattaattagcatttcttcgcagcatacctgtgagatgggtcaatatcaccattttacagatcagaaaagtggaatgacaaaggctgagtgatttgaatgaaggactataacaagtcaaaggcagccaaggatggatttgtggcaccagcctgggagttcaaacatatcatgctctctgagcatcaacacccttccactcagtgctcaaagagggcttaatattagtaaagacatagatggttttgcttaagcagcagataaacaaattactggggtttaattgattaatacatggactagattgactatgggcaagcaagctacatcttacagacagctactggctgaaaccataggatcaggctttttgacacccatctctatgacaacagtatggaaacttttttaacagcaagaaaacactttttattgaatatctattctgtgtgaagactctcttagaatctacaaatatcattgttatggcagctgtaaggatatactgtcattcctaatttgtagattaagaaactggggttaaattccttttctaaatcacttggctggtttgaggtgaggctttgattcaaacacaagtttacgaactacttacttgtggtccccaaatgtgcacatgttgaggttaagtatcagtctggaccagagagccacacagagttgacttctctctcccattgttatcaatgactcaggtaaatttacagacagcaagcacatcatgttttaaaacctgtgaagattaatagaataaatgttagttaagggaataatgatctactgtatttttaaaaggccaaaacaatgagccaaatctggtgctcagatactcaggccatacctggagtgctgttatgtgtttacttttggttattataccttaataggactgcaattcagtagaaacatatttaaaggagagagactagggtgctaataggaactatttaggctgcatagcagcagacctaagtgacccaagctatctataacatgaagacatgtcatatggaagaaggaataaaacctgagtttggcaatgttagatgttagaattaataccagtcgctaagatttaaaggaccaaagattttcgtttagtagagaaaaattttctatgggtcacatctgtctaaaaaagagtcaaccgaacagagaggcactgaatcccaatcatcatgtcacctgaaagggctcccgatccagaccccaaaagagggttcctggatttcgagcaagaaagaattcgaggtgaatccatagggtaaagtgaaagcaagtttatttaaaaagtaaagaaataactgagcagtggcatgcgccactggttgcccatttttatggttatttcttgactatatgctaaacaaggggtggattattcatgagttttccaagaaaggggtgggaaattcccagaactgaggatttttcccctttttagaccatatagggtaacttctggatgttgccacggcatctataaattgccatggcatctataagttgtcatggcatttataaattgtcatgtgtcttttagcatgctattgcattataattgcattttaaaagcagtggggacgaccagaggtcactcttgttgccatcttggttttgatgggtttcgtccagcttctctactgcaacctgttttatcagcaaggtctttgttacatgtatgttgtgctgatttcctatctcatcctgtgacttagaatggctaactcactgggaatgcagttcagcaggtctcagccttattttatccagcccctattcaagatggagtcgctctggttcacaaacacctctgacaatcaaagttgtctggctggtgtggtgagtggcaggagcatgcctttgaagccagacatgccagagtttgaatttcaactctaccattgcactgctctgaatgaagaacaatggtagaggtgctgtatcctgttcttaaagaagcaagtaacatctagctataccctacgttaagtttcctagagtacttcttagccaacaagtggtacccggcaaatacttaatgtcaatttcccagtttaaagagatcagataaaaggcatttatcatcaaatgtgggtctagacaagatgtgttttaaagtgcccaatattatgctctggacagcctttgattctaagtcaggatcagccattagtcaagggagaatgaattttctaagtggtgaccttttataaaggaaagtatgggtgagctgaaaacttattctagagtttttgcagcaagtttctgaaaagcattacttaagtatgaacagacaaaaagaaagttgtcatcaagggaatttccattttttttatttgtttgtttatttatttattttagagacaggatctccatctgttggccaagctggagtgcagtgctatgatcacagctcactgcagcctcgacctcctagggctcaggcgatcttttcacttcagcctcccaagtagctggaactgcaggcatgtgctaccacgtcctgctaatttttctattttttgtagagacgcagtttcaccatgttgcccagtctgtctcgaactgctgagtgcaagcgatctgcctgcctcagcctcccaaagtgctgggattacaggcgtgaaccatggcaccaagcagaattttggtttactaaaaaacattaaaacatttatttcttaattctgcattaagatttgtctttttttttttttttttttttgagacaggatctactctgttgcccaggctagagtgcagtggcacaatcatggctcactgtagcctggacctcccagggctcaggtgatcctcccaccccagcctcccaactagccaggactacaggcgtgcgccaccacactctgctattttttctattttttgtagtgacagggtttcaccatgttgcccaggctggtctcaaaatcctgggctcaagggatctgcctattttagcttcccaaagtgctgggattacaggcttgagccactgtacctggccgcaattctgcattaagatttttaaaagcatgttttatgtagtacttgaatcactttaaatttagttttaagcacttttcttttacttattgtgcagcctcttcttactgctttttttcatttttccaattgaggctgtataaataagtgaagtaaaagtttgaatgcaatatctagtcgttgcattttctctgtaatatgcaaattaagtctaatacctttaagcaaattagcatatatcaattattcttatcttagatacacatgactagaggtatgattggtgagattaggatattggtaataatttaaagggcaagagcaaggatcagcatcagtgatcactgtaaattagccaagaaatgcatccaaggcaatcagttactgacagtacttaccatggaacagtttcttggtagaagtgcatacctaatgtgacaaagaatatttctaactaaaaatccctaatagtagcatttttttttgaagaaaatcaaaggcaacacagtggtttgaatggagtttgaaggtgtcacccaggttacagaaaaagaaagcatatgttactggagatactctgttttgagactgttagcacgatttaaagattattccatctgagaagacgatttctgtcaaattttgcattccagtttggatctaaatctggagcagattgagtatttgcattctatttttattcatagaaagattatgtaaattggaaccacagatttacccatttcaaccaagcggagttaaattgagaacaagcaagttccttgtccatctgactcccaatacttgccttacttagaaatcataacataggaagcttctcatctcctcactaccaaatcctcagtcctgctttcctccttgcccactatcttttcaatcccccttactataacatgggatggccctttctcctatcaaaggcccattcattttctgatgctttggacctcatttctttctcagagacctatctccttccctttttaaatccatccctttgcccattacttctttatttcctttgaaatccactaaacagtttactgagcacctactctgtgctttcctggtgtcctcggcatttggagatgctttctgcatcagagccaaagaattttgattcttttattctcacagaggggaagagtctttctccccaattaaatgcaatgtcctaacattagccagaagggacctatgctgctttcaactctttgcctaactctaggtttaggacagttctaatttagatggtgttacctacttgccaaatgagggttcagtggaggatgaggggtgtgtgaccagtaaaggggtttcactacaactacagataatcctttggagggaataccagggaatggctccagaaagtgatgtaaaatactgatcatttttatttatttatttatttttttttttttatttttttttttttgagacggagtctcactttgtcgcccaggctggagtgcagtggcgcgatctcggctcactgcaagctccacctcccgggttcaagccattctcctgcctcagcctccctggtagctgggactacaggcacctaccaccacgcccatctaattttttgtatttttagttgagactgggtttcatcatgttagccaggatggtctcgatctcctgacctcatgatccacccgcctctgcttcctaaagtgctgggattacaggcgtgagccaccacgaccagccgataggtaattgttttaatagcacttgttgaatgattaatcctttgaccacttattagaaatgttaccttttaattttttaaacttctggaatgtgtagtgctctttctggattgttcgttctattctactgatctatttatctatcctagtactattaccactcccttacattactcaaataaattggatgtccttcttttcaagatttttttaccagttttgtgcaaacaccataagttttatgaaaagcctatcaagttctaaagttttaaaggttaatatactttctggaattgcattctatttaaaaagggattatgtttagttaatgtagacattaactttaaggaattatattctcattcagaattgtggttacattttgcaatttattcagagtttgctcttatgttagcatagctattttacaaggtatatcagtcagtcctacaaccattataaacttgttataataaagaatgtttattctatcttatcactactttaatgtttgacttcttcacttcaaaaatagttgaaaacttagaactggccaggtacagtgggtcacacctgtaatcctagcactctgggaggctgaggctggtggattgcttgagtccaagagttcgagactagcctgggaaacatagtgaaaccctgtctctactgaaaatataaaaaattagtcagatgtggtggtgtgcacctgtaattcaagctactagggaggctgaggtgggagaatcacctgagcctgggagtttgaggctgcagtgagccaagattgtgccatttcactgcagcctgggcaaccagagtgagaccctgtctcaaaaaaaaaaaaaaaaaaaagaaagaaagaaagaaaaagttaagactatccttgtatagtgttttaatttaattatttggtcaattaattttacccctcaataaaccgtttacctattgacatttttgtgatataaaaaagtcattcctcgatttgttggaatatttattttaaaaatgtacacttaaccagagatccatttgtgtctactgcacatttaaataatgtatgatatataaatatattttaatgttttcacataactgtcctcttttgaccttcatacaagcattgtacatttgaaaaagcaatgatttttctccccatttaaaaaaatgagaagactgacatagacaaatagtgtgctttgcccactatcacaaagctggtcgatggactctcagtacaatgaccttccttatgaaatcagctgcttcctaatattcctttctgtaaagccatacagcaaactccctagattcctatatttatttatttattgacttatttaagaaacggggtcttgttctgtcacccaggatggagtacagtgggatgatcatggctcactccagcctggaacttctgggctcaagagattctcccgcctcagtctcctgtgtagctaggactacaggtgcctgccaccacacctggctcatatcttttttttaaaaatgttatttctcattatgctctctccaactagaagcattggagcagaactgtgaggaaggacaccctaagaagtgaatcttgaaggatggtagaaaggccacataccaattgtactgtggctggcacaatgcaaatggaataaattacatagccgcaatcaactcagatctaaactcaggtgatgtgaatgtagcaatattgtgctttctctgtgtaattgcaattacctccaagtttatttgtcaccaaacaagcactttttcaatcagtgcaacttgtgcaaatcagcactctgggatgtgaatgatttaattcactcatcatgcacttcgtgatgcccagccctaccccacccatgaagaaaataaataaagtttaaggagagattacatggaaagcagacatgtggggcacaaaagtaatgtctaagttagttatcattcttaaaaaaagttaaacatgagaagagtagaataaagctattagtgagatacatagttttatttaacaaaagaaacacagtattgattaaaataagaatgaaatgaaacatattttattaaccaagaataaagcacattttattcttggttaattttccttctttttagagaaattaatagacatatatatagtaattgtttgttttggcaaagaagacatttaagcagaaagaggatgccttcacatttcatttctttacacaaatgacatatgccagacccatggaattcactcccaactattaatgacactttcccttcaacttctggacctttcttaacttgaggtttcaaagagttgctcccatttcttctaaattattctctgaggaaaaaaaaatctatttttctcgagaaaacctattttttcttcctcattaaaagtatggtcatttattaaattttgccatactgaattatctcaatactaatcacagtgagtgaaatgaaaaaattgttattacctttgccaaaataaacttaacagtttaactgtggatgggggaggattgaaaataataactaagctagctaactaacatataaatgtctaattgatagaggaataaattagaaagtaaagcattatagtaaacaccaaactatgtgatatattgagctctgtgataccttgcaaagaagagtcagggtgtcctggagttgacagaggatgcatctatatgataggcatctagcaagatttaaggaatgagtagcattcagattaacagagctatgcaagaaggtgaaaactcaggtgataacagcgatttttcccatttgacagaattttctcttcaagtgaacgactacttggaaacctaatatgtaacagcttaaagcagaactgccgtgattgaagggaggagaaaaatgggctccagagccctgttaatatgtccttctggtttttcctgggcctctctctgatttagaatgttaaaaactctctatctgtatttcatttgatctatatcttccttgaggattaatatcgatgccctataataaagatacttgtaataattcaaacttgagccagggtccaggtaataagaggggaagaaacaacaggataattagggagcagttgtaaaaaagaaataaaattgattgactaggacgcgggaagaggaagaaaggaggagtctacaacattgtaggagtaagaagtctatatatcaggaaggaaaacagttgtacaaggtagagaattgagatgtcaggagaggaaactatatttgtttctttgttttagtatatatatgttttattcaatttcatttccccctctttcaatatatcactgtattgagatggctctaaagtaggaacataaagaccagatttattctggttggatccataagactccatcttttctgaaaatctagaatccattcataggcatgtgatgtgcattgagtctctcttctcagacagctctgccctgcaccatttacaggatgtcaggcactggagatagaatggtgaaaaaaagacacagtcctatccttcagaaaattcccgagtttgttaagaagccagatgtatctagatcaataaacaaatgtaaaattataatttgattaaatagtgaggaaaaaatggcacctagtaccaggagacatataccagtcctgatttagtcagagaaagtgtccatgaggtagctgagtaagagttaaataggaaaagaaatggtattgacagatgggagaacaccctaagtagaaaaaaaagacatatgcaaaggcactaggagagaaagaagccagtattggtggagtatagagggtgaaaggtagcagagaaagctggagaggaatgcaaggaccagaccataagagctttttattctacagtcatctattccatggtcagtggatggcattgacagaagggagagtcatatgattacatcccgtcttggaaagatgcctcatgttgcatcatggagaactgattggagagtggccagatgagatgtaggcagaccggtagctattgcagacaaagttcttgggattttggaccaggatggttgcccagaagatatgaagaagagaagcaagattcaagagatcggtaaaatagattggaattagtaatgaggcttaaaggagagcaatgatataataatgatttataatgatatattagggctaactcttgacatgacatcattattgcaaaatcactttcccaatttgtcttttaattttatctttgttgcttttgatataggaagcttttaatgttaatgtactattaaaatccattatcgtgtcctttattttcttgtttatagttttgtttttgctttaaaagaacttctccatgtttagaaaaggtaaatatttacctacattcttttcccattagtttatggtatttttttttcttataggagagggtccgagtaggatttagatcttttatatatttgagatacatgcacatatctatgtgcacacatatatctgaacacatatacaggtatatatgtatatgtatttactgtatttagtgtaagatatgaggtaggtatggatctaaatttattttttccttataaatggctaagggccctataaatcatatatgaaatatgattctgagtcatttgcctttttgtgaaatattttctcaatgaatatgccattgagattagccatacaatatataaagaattggagatggtattcacgtgaatattttgattacactgatctgttttaaacaattctgtaaacagtatgtaaaataaatttaaatgtccattagtattaggagcaatagtagtgaaaacagagccatgaaaacaaatccaaaacctagtgagatttggagtgtttagctttgcttctttataaaatatagttatttagctcattgattgtactaattatagttttattcctcaaatctcagcagttttgccttagcatcttatatctgctttatagaattaaaaataattcatttattttattttatctgttcagagagaaaaattttaaaactccatttaaaccattttaaaagataactgtgcagacttgaaacccaaattgttctttactcttttaccaaagctattatggtgacagtgagtcactaggacacttactgggtctcatgaaatcattttattaaacttacccttttccgttatgtaaattactctttttgtggtgacaactttatacataagaaagaaaggtaagttatacttagtctccagtaaggatatatcaatgtaattagatcaaagtgactcaagtccttgtatcttcatttccggaaaacttgactttaaaaagattaggctttacttgatttttgttagcactatcttataaatacctacttgttatttagcactgtgattaccatccattcccacagcagtgttgtgcccatgcagaagtccacagcactataattaggatattttttcctaagaaaaatattataatagacatcttgccatgcttatgttattttaattggatgtttagctctagggatcttcataatttatcataaagctttaatgttaataaaatcagctggaaggaaacactactaatctccttgattgcaccacaaggagtaggatcttaatttgagcctttccttctttttttaagctaatggagaaagagttttaagtggatcatgggatctaagcaatgtaacacaatgcttcattaagtattgcccatgatccacatcaaagaaaaattactaaaggtggaggtaaacaggccaggaagacttattcaagactactacaataggggagagagattgaactcaattcccactgaaacaaaaggaaggagagttttttggcttgtttgttttccttttttttcccctgctccttttttattgtgtaaatttaaggtatacaactgatgtttttatatacatacacaaagcaaagtgattactacctggagagtttttaagtgctggggtgagccagtggaaaagtactggaagacattagaggggaagttggctggtatgatcaggccttccgtgtttgctaattggtgtttatcaaagttaggcttctaccctcccacagagactaagagatggagggctgtctttgttgatgattacattttgaaaggatagctaatagtaccttgagaaagccatttctagattgtaaaactggcaggcaagaagctggaagatttacatctcaatagggcagaaaggaatttacaactgcaagttttataaagtaaatcttctaagaaaaaggagatctggaatctatagtcaggaagaaacctaagttatttcaagctgagggaaatgttaaggccatcttggccacgcattgatgggtattggattttacttgatctggaaactgatctaaaagtataagccctttcttactttacaatatataatacaatcttaaaacttttaagtattatgtacaactaaaggttactcattagaaaactaataaattagatattcaggtgcagaagggatgtctttgaaatgtgctttagagtgcaagagatttcactgtttaaagtttactaaataataataatagcaacacctattgagtatttaccctgtgtcagatactaatttatgcatgtttcaaataatgtagaaaaaaatctaggagctctccttttcctagaagaaaatttaatccaatatcagactgggaatggaagagcaggtctcaaaaccaaacctgtgactccagaaagggaatcctggcctggaatagacacacatgcacacacactgatagaataacagataaatatgctgaagaggttcttttttctttcctttaagtagttgaaaggtccccaaaacccaggtctaactccaccactttaaaatttcctacagaagccctagttttgtgctatttcttgaatgaaagactaccttgtttccatgcagctggcaaacgccttcattgggctttgctgtcattctcatttactgtggtctctcagcagcacttcatttatttgtgcagaaattattaatgtgatggagtgcagcctgacttagaatcagtttagactcctacagtcgtttcacatcccagtgccacaaagcaggaatgatgatggcagtcttcgccctttctccctgcttggatgactgcatcaattacgaaaatagtaaagagatggaggactcccatcagtcatgctacaatagtactggcctatgagtcactacttaaataagatataaaagctctaagatatgtgccaaatcttttgcagcacagatgtgtaaagtcttaagttacgttttattttttaacttaaagaaacatttagaagcttgggaaatactgcagaattctgagaattgtcttttagacaaagttcttccagtaaatattttgctctctgttttggttatcagctagttttggagggcatatattactttattaaaaattaattataaatatattcttaaatattaggcctaggctacactctaggagctggtcatctagaaaggcatgctatcaaataaagcagcaagtacaatatagaataattagtacaatgagcactggccaaaattacacagctgtctatgaatgtgtatagttagtgcttgtctccgtcactaaatagttagctccatgaggccaaggaccatttttgttgttgttgttgctctatctatagtaactgatgcattttagaaactcaggaaatatttgtaaatgaatgaataaatatagctgcgagtaggagagggagccaaactgttagggaggatggaatcaagaaatgtttgttcaggcaaaattactgaaatgatcatattgtcatagagtatagtatgacatctttctcatggtttccattttttttgtcaattagatttcactaaccttcttcagcatctactgtatacacggcagtgaactatgttctcctctgtaccttattactctgcaacatactgagagctgagatccatttcatacataatgaatataaatttttcactcttaaatattgacaatgtgatacctaatttccatttctgagtatatctgaatatagaccaaatgacataagaaactccgtaaaaaacaattaacactgaacactgcacaatggccctcctatttgttggaaggtggtcacattttacctccttatacagcattccaaatttccctgaagattactacagaagcataaatgatgatcactggaaattatcatgtagccgaagctgacactcacagaagtatatgttatccttcaaacaaaaaaatcctaagtttgtcctaactttatctgacccattttttaatgctctctaacattagtgaatgatataatgtttatgcagaattagataagcttatgttaagcttttcacaaggctaaacagttggttgcttgaattttgggagcacagaaaaaaaaaaaacagtaattacaaccaatccaacctttggcttttgctttagcacattagttaaataagaatctacttggtatttgaaagcgttcaaaactggaatgaaacatatgaattagaaagaaggtaatttcctcttttttatctgaaagggaggtatgattttatgcgtgatcagtgacatcatacactcatatttcctctgtggatacaatacattcatgaattgggttaatgtcttctgaaattttgtagcaactaccatctttcttttatttttaaatttttaaataaaatattttattttagattcaagaggtacgtgtgcatattagttacatgggtatgttgtgtactagtagggacagggcttctagtgtacctgttacccaaatagtgaatactgtatccgaaagataatttttctacccttgccccctttccacctccccgattttggagtccctagtatctattatttccgtctttatatccatgtgttcccattgtttagttctcacttataagaaagaacatgtggtatttggtttcttgtttctgagttagttcacttaggataatggcctccagctgcacccagtgttgctgcaaaggacatgatttcattcttttttataattgcatagtattccatggtgtgtatataccacattttctttatccagtcaactgttgatggacacttaggttgattccatgactttgctattgttaacaatgctgtgattaacatacaggcacaggtatctttgtatataattatttattttcctttggatagacacccagtagtaggattgctgggtataatggtagttctgtttttagttctttactattttagttccatactgttttccatggaggttgaactaatttacattcccaccaacagtgtatgagcattccattttatctgcattcatgccaacatgttgttttttgactttttaataatagctattctgactggtgtaagatgatatctcattgtagttttaatttgcatttctctgatgattagtgatgttgaccattgtttcatgtgtttgttggctgtttgtatttcttcttttgagaaatgtttgttcatatcctttgcccagttttaatcaagtttttttttttcttgttgagtcgtttgagtaactattactttacattttgtttttcagaggtcttgaaagcctagtttggaaatgataacttccctttttctattgttagttatgctctgaacccatcatttacaaggaaatgcaatcactagtgaagggagtcgttatgttggtattacatgaataaagggtgtgtgcgtgtttgcaaaatggcaacttgcaaacgtaatattcttctttacctcctctttgtaataaatagtgagtacttaaaatgtttagggaaaaaataaatgtaaaattctacttgaaagtttaccaaatttttaaaaagtatacagaggaagagaaatgtatagattttaacaatcatctagcgttatcttaactgtatctcaggaaatatctatatagtcactctgaatatgtgtatgtcaggctaaatcaggcagatagatgagcagttaagttcagttatcattagattttttttcttattagagtgatattttagttctaaaagggtagttttaattaaggcataagggtttatttaaactaacaaatgattatgtgtcattataccatgataaacaaacctgatgaacttagtgatttctttaagatttttaatctctttggtatttgtccaagacatcaggtgtccagaatatactctgctgagaaatctatatcaatgattgagagttaatatctatgagctattttccatgttgtctgaaagtgtttttaagttgtatagaatatatctttctgagaaatctttatcacatataagagttgctatctgcaagctattttctgtgttgtctgacaggttttctaaaaactaaaatagctaaaaaaaatgaaacaggaaaaatgtgtcagttttaatggtgcagattacccatatcagattgttacttggatttcaaccaagactgaactaactaattaaacagaaggaaaaccttcttcaaaatcatacagagcattagtacagagctgaaattgcaacttcacttatcaggttgtttttgacaggatgctttgtggtgcaagtgacagaaccacagctaaactaactggaaaaaagaagaaactatagtcctaggaagccagaaagtctgagtgtgctttggccttaggcatagctcagtgctgtgttcagtgctctcaatagcactcagtttttcttatgtcacttctctgccctgtctgggtggtgaggtctgcttttctttctctaggattatagtgtgcaaaatatcagcctgtggtcaaaggcaaccatttttttttccttttacaagagagatcttgcccatgaataaagctaatccggaaggaaacatttataacgaagtatattaattggccagagtgtgatatgcattcacttttaggaaaagatgaaagttgtgtaaaataaaaactgaagaaaaagaatagtttattatttaactcttttttttcttttcttttcttttcttttttttttttttgagacagttgagacaggggctcactttgccacccaggctggagtgcaatggcaccatctcaactcactgcagcctcgaactcccaggctcaaaccatcctcccacttcagcctcccaagtagctgggactacaggtgtgtgctaccatgcccagctaatttttctatgttttgtagagatggggtttcgccatgttgcccaggctggtctcaatattttggactcaagcaacctgcctgtctcatcctctcaaagtgctgggattacaggtgtgagccactgtgcctggccacatgtaactcttttgaagtgtacaattcagtagtatcagctatattaatgtgctacgcaatgtttctgtagaactttttaatcttgcaaaactgaaactccgtgcctgaacagcaactccccattttcttctcactccagtccctggcaactgccattctattttctatttctataaatttgactactttagatatttcttataagtggaatcatagagtatttgtcgttttgtgactggcttatttcacttagtataatgtcctcaagtttcatccatattgtagcaagtgataggatttcaaaaggaaaagaaattttaagatttttaaaacttactttaaaaggatatccacaaacttaaaatgctttcagaaaacttatatttatgacaacctaaatttataacaaacatggagaaatttgatgggactgaaagtaacttgaaaatgcactgctcgcttattatctttcaaattcaaatgtattcaaaatactggactcaccaagaaaaaaggcagcaacaaaaattacgtctatagcctttggactacacgttttcaacactgctactaatacatttggggagggatttccttcaaaacaaaaaagagagagagacaagagacaaaatattttattttttgcatcataattttttaaatttaaccttttgtttggaaataattatcaattcacatacagttgtaaaaaaaaatacccagagattccatgtgtcctttatccagtttctctcactgataacatctcgcaaaactatattcacaaccaggatatggatataatccactgatgttattcagattttcttagttttgcaagtactctgtgtatgggtgtttgtgtgcatgtatacacacatggatttagtttcatgcaattttatcacgttgtatagtgagtttaaaggcagagtttatagatcagatgtatctattatcaaggtgttattatttttagaaatcttagtagcaaaatgttcttattttatatgaaaaatatgcatacaggatatgaagaagagtgtaccttattattcttataccagatcattgctttaaacaatttattcaagctgtatacgctctttaacatgttttcattctttccataattatagaatgaaatatgtatgtttattttccctcaagttatttattttctttaatattgagaatcaggcttttttttttattttaccattattaccagagaagtagggcacattttaagaatcttacttttaatatctgcagacaataattgagggcaaacaattgtgttaatttgaaaattcactattttacttagaatttttatattcactagtcttataaaggaaagattattagtcattttcattaaggacaataagactctccatttagttacataactaaatcatcaacaataaaatgggtttaatatttgcaaagcaaattactgaacccataggtacatattcaccattatattgcacaccacttaaatgattttttattttcttacatgccttcataatttttctaatttgcagagtcttcacttcctggtaaaggaatgcctcattctcccaaatcctccttaatctcatatctaagaagagatacaaacagatttttccaagttagaggatcctttctcgttaaaaaaaaaaaagtagtagcataatgaaaacaaaataactttcagattgaagtaacttctttacataagtaaattaaggagacttttttccttcatagagaagaccaaagattttcacagacagctttacccatgatagtatggcctcttatttctctttcaacagagataatttagtttcttagttctcaaattatgatctgaagtcaaatgatagctattgtaaacatatttgaatcattttctaaggcaaatttaatcaagagcattttcatgtactcatttattcaatacctacattaataataatataaaaacaaatttcaacaactacaaagataacaactacaacaataactaattatatacaataataataactaagcagttacaatatgccacattcttttctacatatttcaaatacaaatactcatttaacactaacagccaccctatgaggtatatactatttatggtatttcttattttacaaatagttaaactgaggcacaaaaagttaaaggatttgtccaaggtcacatgtttattaagttttagagcctggctccatccatggcatctggctccagaatctaagcacttcgttgcaatgcacatgcacccccctgaattacaatgagacatacatggaaaagagacacacatggaaaagatataatagtggggtgttaagtctcccactattattgtatgggaatctaagtctctccgtaggtctctaagaacttgctttatgaatgtgggtgctcctgtattgggtgcatatatattttggatagttagctcttcttgtttcagtgatcccattaccagtatgtaaagcccttcagcaaagtctcagcatacaaaatcaatgtgcaaaaatcacaagcatttctatacaccaataatagacaatcagagagccaaatcatcagtgaactaccattcacaattgctactaagagaataaaatacctaggaatacaacttacaagggatgcgaaggacctcttcaaggagaactacaaaccactgctcaaggaaataagagaggacacaaacaaatggaaaaacattccatgctcatggataggaagaatcaatatggtgaaaatggtcatactgcccaaagtaatttatagattcaatgctatccccatcaagctaccattgactttcttcacagaattagaaaaaactatgttaaatttcatatggaatcaaaacagagcctgtatagccaagacaattctaagcaaaagaacaaagctggaggcatcatgctacctgacttcaaactatactacaaggctacagtaatccaaacagtatggtactggtaccaaaacagatatatagaccaatggaacagaatagaggcctcagaaacaatgccacacatctacaaccatctgatctttgacaaacctgacaaaaacaagcaacagggaaaggattccctattttgtaaatggtgttgggaaaactggctacccatatgcagaaaactgaaactggaccccttccttacaccttataaattaactgaagatgggttaaagatttaaatgtaagacctaaaaccatagaaaccctagaagaaaacctaggccataccattcaggacataggcacgggcaaagacttcataattaaacaccaaaagcaatggcaacaaaagccaaaattgacaaatgggatctaattaaactaaagagcttctgcacagtaaaagaaactatcatcagagtgaacaggcaacctacagaatgggagaaaattattgcaatctatccagctgacaaagggctaatatccagaatccataggaacttaaacaaatttacaagaaaaaaacaagcaccccatcaaaaagtgggcgaaggatatgaacagacatttctcaaaagaagacatttatgcagccaacaaatatatgaaaaaaaaagcccatcatcactggtcattagagaaatgcaaatcaaaaccacaatgagatatcatctcacgtcagttagaatggtgatcaataaaaagtcaggaaacaacagaggctggagaggatgtggagaaataagaatgcttttacactattggtgggagtgtaaattagttcaaccattgtggaagacagtgtggtgattcctcaaggttctagaaccatttgacccagcaatcccattactgggtatatacccaaaggattttaaatcattctactataaagacacatgcacacgtatgtttattgcagtactattcacaatagcagagacttggaaccaacccaaatgcccatcagtgatagactagataaagaaaatgtcacacatatacaccatggaatactatgcagccataaaaaaggatgagttcatgtcctttgcaggacatggatgaagctggaaaccatcattttcagcaaactgacacaggaacagaaaaccaaacattgcatgttctcactaatagtgggagttgaacaatgagaacacatggacacagggaggggaacatcacacaccagggcctgttgaggagtgggatactaggggagggatagcattaggataaatacctaatgtaggtgatgggttgatgagtgcagcaaaccaccatggcacgtgtatacctatgtaacatgtatctgcacatgtatcccagaacttaaagtataaaaaacagattgaatttaaatacttgttattttgattaccacatctctaataacttccttgtgttttttcttcatctttcagttttagtcattttctattgacttagttaactttcctttcctacacaatcacacatgtgtatcctgtccttgactccctatacttcatatggggcatataataatttttcatacatatatatatgaatatatatatatatgagtgtgtgtatatatatgtgtgtgtgtgtgtatatatatatatatgttttgtattcttcactaactgcttctccagattcactgggttttctgtcaatttatttttctgaacaatcccttctttttgccttctgacctgctgaaatatctattggttgccctttatgttcctgtttgcaccatgttttctgtttcctgattttctctctgcttgggaataacaaatctattaatagttctctgagaaatgagcttgaaagatagttctttgaggtacagcaatgaccttattttctcctaacacttcattgatatcttgtttagctatagaattctaggtttgaagccattttcatcatattttgaaatgactatttgattactttttgtacttccagttttcattgagaagtctatagacatgctgctttttgagccttttatcactgtcctcccaggaggcatctaacatatcctctgcctcaaggctctaaaatttcacagtggtgtgcttcatatgggtctaatttcatcggatttagcttttatagaataagccctttgaatttggaaactcaagcccttcatctgttgcattttgtggaaattttcttgaattattttgttgataattttttcctctctgttcctctgctcactcattctggaactactgttatttggatattggatctcctgaactgttccttaattccttaaacttttcccacaaattttctttttttgtctttttgcttaactttctagattttattacctttattttccaactcttcttttgcattttaaaatttctgttatattttaattttggtgcattttatattttggtttttctacatatgtacttgatatgtgtgattatgtgtggatagatggatataataaaacatataaacatggataaatatggatatagttgtggtctttttttagtattatatgtatatatatgtgtgtgtgtatatatatatatttatatatatatgtatatatttatatttatatatatatatatatatatatatatttttttttttttttttcctgagacggagtctcactctgtcacccaggctggagtgcagtggcaggatctcagctcactgcaagctccgcctctcgggttcacgccattcttcctcagcctccctagtagctggaactacaggcacccaccaccacgcctggctaattttttgtatttctagtagagagggggtttcaccgtgttagccaggatggtctccatctcctgacctcgtgatccgcccgtctcggcctccgaaagtgctgggattacaggcgtgagccacagcacccggccgtggtctggttttatgttctcagtatcttccctcacttttctgaagatagtaattcattatacatttttttgtcttcttctacctgaatattctctatttctatagagatggcttctatccttaataaactgctcaagattgagcataagggatgaaaatctgatgagaaacgttgaaaaagtgacttggttttgtcaacaatgacaaggatatccctaaattcagagatgatggaaaataaatattgaatttgttaacattacttttttgctcagagagggtcagttgtctggctgcacaatctgactgattattttcactcaaccaacttttactcctatttctggaggttccagtaagggtttctaaggttcaatttaagtttattcttggttttgcccattgcaagtctacaattcagttttctacaatttgctagatctattaccacttatctgtgtgcagtcaacttccacaattatagtgtcctccacttttattccctatgtttttgtgtatccctttaaagattcactttattactgtcctcattgagttcaataaatagtaaatgtggaaattactgttaaatctaccatttttattcagaagttgacttgaactttttatctaccttccaaaggattttgttcttttattgaacattccgggttgattttatctggcacacgcagtaagaccatttaatatagatactatactccttttatttcaataacagtttcttaaattgtatctttatgtcttctgttttattttttttccagtcactctaagcatgtttttggcttttcttagcctaccctcctatcaatatgatttctctcttgtctgtcattaactctttatttctatttcactttcctaatttctgccgttctatcccttaataatagctttccacagtgcctatttttttctgattttattttcatgcctgtgatagagtttattttttaatcatttctttatttctttgttctttgagctgacatttcatcttactatcatatccctgagctcttacatttccctttgttgtttatgaagatagaggcaaattcttcatatgttttcaaaaccaggtgcctaatgtttttctcaatttcatggctttttttctgggggcaaaaggaagtggtagtttttcatctaattttttttttttatactttgtgtcagtgttacactatttttcttttttagataaatgactcatctctgaaaaaaattacatttttcctggacaagcaattcagcatagatttattttggtaggagtgtttgctataattcttggcttgctgatttccacaaagaaaagacatagattttctctgctgcttcagattaaacgtgcttcatgaaactagggtttaagtgtttaattctttctgtacctgtgtcttttctacttctctgaaaccaaatgttgccatcagggtttattccgcctgtccagctcacctgagttcctgaacttagagttgtaaatgcagagtaagttttatgccctacattttcaggcagtgtattttcttggtgctttctgagatctcttacccttgaaccctttgggcactgacactgatctgcttagcctctcatttccccctgtttccaaatgatcctgcccaacctcagaagcttttggaaattctaaacatattttggtgactaaaggtattttggtgactatgtattattccatctcttcatttttaaagctagagttagaggtattttatttttattccctattgttttctaaatagcctcatcagtgtataatttacattccacaaaattttcttcatatatatattacattttactgatatttggtaaatttatacagttatacaatcattaccacaatctagttttacaaattttccattgctccaaaagttaccttgtgcctattagtaatcaactcctgttttgtttttgttttttgttttttgtttttttaatattttaaagtttctcagttaagactgggcacggtgccttatgcctgtaatcccagaccttgggaggctgaggtgggaggatcacttgagccaaagagtccaagaccagcctaggcaacatagtgagacccatctctacaaaagaaattgaaaaattagccgggtgcggtggcatgcacctataagtcctagctactcaggaggctgaggtgggaggattgcttgagcccaggagcactgcagtgagcagagatcaggccactgcattccagcctcggcgacagagtgagaccccatctcaagaaaacaaaaaacaaaaaagtttctcatttatatagctatgatcatttcagaaatgacctatgctatgttttcattattaataattctaagaaaggtaatgaaagtttaatgcggtagaagagtaaataattcaacataaaactacctcttggcatttattcttcttctgttaggttttttgagaagattttcctagaggctctcagataatctttctcagagggtgagatcatgtgtgatacgcttaaagcactggggtcagtcggggcacactggtgttcattgctgctgtgattttgttgttgtgaaatgatttttctttgccgtgtaatgttctggaggttccatgaaatccactgataattctttaaaggagaggaagccagcttaaactaaaggttcttaattatttcaagcaaattaatataatttttaaaataaattttacacatatttttcttagaacaatttcgctatgttcaaaatgtatcatgatctatagaaaaactgaaaatcatgagaattctagttttaattttattctcatcattctcaatagacacttgggtgaataactctgggaaaatctctctgatatcttctctctctctctgtctctctctccaggcccacatatccacacatttatgaacatacatgtcagaaaagcatatctaattctatgtgcatatatatgcatactttcaaaataaagtccttcattaattggagtatagcagataaatatatcttaagcagcagttcagtgaatgttcacatattaaatgcacacatatgaccaccacctggataaataaaagaacattaccagcactccagaagcttccctcttcttgattcttgatcattattccaacagcaaaccatataggttagctttacctgtttctgaatttcacataaatggaataatacaaaatgtatatggcttctttcattttttgtgagattcatccatgttgttgcaagtagtatttcaagtatttaattgatgtattgtttttcattacatgaatatactacatttattctgttcttgatgtaaatttaggttattttcagttttggagtatgaataatgcagctacgaaaattattctatatatatttaggtgtatgtatgtatatatatatatgtatttctattgggcatatatctaagagagaattactgactcatagggaatatgtatgttcattttagttgatacgggttttctcagtgatagaaccaagttatattctcactagcagtgtatgagagttccaaattttccactgccttcacaatgcacagtattatctatctgtttttttgtggatccatcacgttatcccatagtaattttaagttgctttaccttgatgatgaataaagtagagaatgtttttatatgtctattgagtatttgcatactcttttgtgaagtactcattcaggttttctttgtcacttttctgctaggtttgtccttccttttttccttatttgtataagtttattatatgttctgggaattggttctttttcataaaatctattgaattttttttctcctgctctgtaattgccctttattattttcctaatggtgtttttaaagaacaaggttcttaactttaacataatgtaatgtattagtctgttttaatggttagtgccttatgccctatttataaaatcttcacatacccaaaagtcttgcagatattttcatgtaagttctagaaactttttaaagcctttttctaaaataaacctttatgtttacatcaacaggtcatccattgtaggatgtaggggatccgtttttacttttttcccttatatgaatatcctactgatctggcactaattacttaaaagaccaccctttctccaaactgtaagctctattttatatttctattactttgctaatttttttcaagtctcttcttcctacgtttttcacaaatctctttttatgcttcttgcaatatgtctatcaatgattttatttttttctcccttttttccttagccctgccagtttactttttatcttttttaagcttatttgtctattaattgagttttttttttgaagaggctgtttttttaaatttatgtacaatttgtacctgcttctgatgagtattcttaagtttgcaatatttctttcttcttattcatcagtatatttgcagacatggtgctgctggccttttttcttctttttcacctccttctcctcatcccctcttttcttccttctttttattgttcataatcacgtatctcgagtgggtataatggaggtgtcttaatcgactggcagaaaaggaagaatcagctggcggtttgaactttgtcctcataactacatattttttttcatttttgtttctgcctgaactagtgaatttgttctagactagcagaaagtctttttgtttcataaggatgtcaagcatgtctattttgggtatgatactttacatcaggagtgtagatcagtatagtttccgtttcaccttatcttaccaagaacttactcggtaaaaatagtatatcaggatgctaaatgaaatttacgactcccctggcaaataacttcttattgccattccaaacaacaggtcattggttttcctccttagggtgaatccttattttggaagactcatgctgtgtccattctgtctctctccttctccgtgatctgttatggggttatggacacagtcaattgttgttttatgtatagctagaggttcatttgcaatatttgagcctatgaacctgacatttgtgctctcactcatatatagaaatcaaaaagttgatttcataggactagagtgtggaatgttggttaccaggggctaagccagctggagagaggggttggggagatttttgtcaaatgataccacatttcagttagataggaggaataaattcaagtgatctattgaatacatgatgactatagttaataactatattatatactttaaaatgctaaaaaaagatgataaatgttctcaccacaataataactatgtgaggtaatgaatacatcaattagctagatttactcatcccactatatgtatattctctatatattatatatatatacttcaaaacatgtggtacatgataagtacatggaatttcatctaccaattacaaataataaaactattttaattttaaataatataaatattacaaaccatttttgttatgaaataccataccaaaaatgtattaacattttcatttagatgctttagtttatcgctggttttctttttagataaatcttttaaaattaaccctgatttttttaattttacttttcagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatgattacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactgacaaggttttgttgtttccttttattcacacttgatatgtttctgttcatattcaccaaaacatgcttgctgagcagcttgaaaagttaacaagggattatggtatgctgtttgttttattatactggaaaacctagccttcataagtgattaaactgagcaatttctttactcaataatttaccatctgggagaaacatccttcctcaatctcttcagctttgggatcaagctgacccaagaacagttcaaaaattgcctttaatatgggttggtaggtatctcaaaagtcactggagaaattattaatatgacatcaattttataattattaaaaatacgtcaggaaatatctcatttagttttacatatcattctttctttgacctggatcagtggtgtccagtttctagaaaagcataattggattaaagaagtgtaagagaaaatgaacatccatccaatggagtgtcattaaggcatattataaaatcttattttgtaaataggtaatacatttgcatggttccaaaatcaaacaaaatttttaaatgcctaaagctgttggcctcactccccatccacccatatctgtcacctgactacacatgaccattgtttgggctgtgtgagtgttttgtgcatgtctttctagagtttctgaagcacacattttacttttttaaccctctatacacaaaatgcagcatattatacatattgttgtgcactttgatgttctgtttctacttaatggaaaaataatttgcatcaaaattgatttgaaagtgattgttgtaaattgttgccattatttttaactgaatgccatgaggccacatatcatttgccttggtgatgtattccttacatgttgacagcctcttttactgaagacattttgggatccttaacaaatatcattgcttaatattaggacaaacaggatggcagtatccttgactataacttgtaatcctaatactgtcaaattcattagaaaataattaatggcatctttagatgttaaaatgctcatcttgacagggcaaacaattcaaaattgatctctgctctaatattgtctctggctttcacaaaccctcactctaataacttactttcccatattacaagacctcgctgtcttgcaggttttattttcctgaacagtaaatatattagcattcagcaaacatagtcatttgggaagatctattaccaaataataagtattaagtattttgttaatgaagaaaggaaatcagggactgatctttaactcagacaaatgaaatacgaaggagcttcacagaggtaataaatgtaaaggcctagtttaaaacattccaagacttagagagttatgaagcagctgccaggggatgaagtggcattctgtattacatgatgaaaacatgctgatgaaccaagggaatgcagagatctcatttgaacttaatcacacatgtatacactatactgctagtatatgtgcattttaaatctattatataattttgcattcagccttcatataatcttcttcaggcaatgcagtattacctgactgaaaatatggggagaatgatatagtaaaattgagtgtttttctatccgtgtagtatcaattacctaaagcctttaagtttgaagggcaacacactatgaatgcaaccaaaaaagcacaatatatgcatgtgaagtagtccatacattgtagtgttaccttatttggatggctgtagatgttctgtttcaatgtcaccccaagaataatttcatcagcattcaatgtcatattactgatcatctgctgtccactcagcaccacactatgcattttatttttaagtgtaatcctcagaacagctctcagaatatcggtattactttcttcattaaacagatatggaaactgaagccaccatggttaagtaacttgtcccgggttcacacagttggcatgctgtagaggtaagatttaagcaaaagcctgtctgaatgaagcacctgttttttcactctaccccatggtttctcagttgctggagggatgtagaaaacaacggaggggggaagggcctcctgacatcatgcacatgtgagatccactagtcagcttgctcctgctgaatactctttctggaccgagctaaatttgcagatatttgctcagttaaagcctcttcaggatttaatctcaagcgtctaccattttgctagatccttctgtgcaccactgtgtcagggaaggttagggtttttctgtctacctgctcaaacatcactgaacttcagcaaggaaaaaaactttccagaatttctgatgccaacaatatcccttctacatcatctcagcccctgagtgtagaaactgttcacactgatgaacatcaccaaataattgcttgactgtttctgtcactttactcatacagacttggtataagcaatgttgtcagtgctgaaatagttctgaatttaagagttgagcccattatggctagttaatagatacggaactacaggaaggaaacacccaaatgtgtagactgatagtccaaccaagagaataaatattccctggaaaggtaaattatgaagtcgctctgtttttagcatatgaaacctggagaccatctctagacagcagccccatggctgcgctactctcatttcattttcagaggagccctgtagaaagttctttcttctaggagtagggcttaccagatgaggttcccttctaatggtttcagattgctcagatgagaggctgtgggcctgcctgccctgttgaaccctcagctaggacttccttgtcccggggactatattctaaggtagacctggatctagaaagagattgctgtctctcttcctttcctcttccaccccaacagaaaatatgcttatgctggtaaaatataaataaccacaaaatatttgtagctccatattgaccttaatgataaggtttatatggggaaataaagatttcagcatattttacattatatggccaagctacctttatttccctgctacctaagtcactgcacctgtggccctacaagttacaggaaacttgtgtgccttatcctagcagtatctctatctaagaggtgactactggtaatctgaagaatgcccacttaatctctcatttgtgcttaattattgatggcacaatctcttcaggaagtagcctgcgattgtggatattacagagtgaatgagaaaaacggtgtccttagggacaataaaagaatatgctatcagttcttagtactgttgacttgcctgccttccccatccatattcttattagctgtgcctgtgcaggatattcatattatcctgcctgtgctgaggccaggagcctcctagacatttgttttcaaccagcggcaatagtggtgccaggttggagcctccagatatgccagtgtggttctgcctctgtctgccccacagcctccttcacatgctggctgtgctgccaagcttgccgagacagatggtgggaatgatgtgaggaaccggcaatgactcatgctcccaggtggtgatacagtcagcatctgcatcaagcaacaaactacctggcactggcacaaagtgccaggatattctattgtcgacttcaatttgacaccctgttgtccatttccctcttcctttctgatctcaaaagctgccaaggtctaagccatatttgggatttcactccctgcgggattttatttcgatcaaattcaatcagtatatattgtattcataggttggtgtcaatgctgagattcttcagttttgttatccattatgcatggttatacatttttgctattactttaccatccaacccccatctttataggcttaattctggaggatttggtaaacatcatattagaatgataaaattgtatattaaatggtcctgttgtaaaaagacttccaacagataaaaaaaaaaaaaaaaacacagtaacaacaacaacaacaacaaagaaaccacaacacttgctcatatctgtaatgttaactgattagcaaatatttattggaacttgtttgggagcaatactctcaagtggaaactccgaggctgcgaaaacatgcatcacctggaagcaaacctctcaatactattaggcctccttccttggggctgttttccatctctttctcagttctcccgcagccactatccctcagtctcccacaaacacggtttcttattttgtccaagtgggggtaagtgtgtgtacataccaaatggaatctaagtcctacagtcgaatttcaaatacagatgtgaatctacctcagttgttgcattttgattcttgcaacaaaggttcaaattgacattggtcaaaaataactaagttaatataaaaacgaaaaataccttcaaccgtagggtttgccaccaccccaatacaaagctcatataaaaatgaaaataaatacctccaaccgtaggatttgccaccagccccaatcatttttaatatctaacctattaaatgctctatcaccacaatgactctcaagctcttttccctttcacttccatacccaccaaagtgtatccaacacctacttctaaaagaagtatctttaatagtaaataagcaaaatgttaaagacatggtactaagaaaatgcattattttcttctttttaacttgactcctagttttcctaccattctaatatgttgatgacctactttaaaaatatttttttctttttttcctgccattaaggtcttccctgtctctcttagaaactaggtgatacaaactacatgctgtttagactacaagtttttagtatgagtattgagaagttactattatataattcatgagcttgaagtacaaggttaacatacatttttcaactatttttctttagtcattttggcctatttcaagtgtgctggaatatacttcttctttttagttgactggaatcccagaggcttttctatagcctcttgagtttttagactagaaactgaaggaagagaagtttgatccccttcaagtgcttccatttctcaattaatcttttcaacattatattcaggcttgtgctataataaaaaaaggattgcatgaaaatatttactgaagtaattattcatttatttaaagaaagagacttcatgaataaatataatgtgtatttttagaaactattttgcctctgcaaactaaataattcacaatgaattatatgtttatatgtattttataatatatttctgataattcattatattgaatgaggaatattaaataattatgttttagttatcactgttttctcaatatcaataatgttcataattttatgttctacataagacaaacagatttcttttaagaagcctaagagatcagaaagggcatgtgataaaaatggaaataaattgttattgctcataatcatcattcttttcatttacacctgtttccacccaatgtgcagtcaatttagagaaaggtcattttgttttcagacacttctatttgttacttcatagaagaagctactttaataagggaggagaaaaagcaaaatgcttttattgttattattttagtagttactattcattaagtgcttacctattctgcactgttactcagaaaaattatcttctttgagcttctaaagtaggtatcattatccctattttacaggtgagcaaaataaatttcagagattcattttgctctcaaaaatgaaaatgcctgaatttgtgctgggactcaaccctgctcaaatgtgtttggttcatctgctgcagatggacccagaaagtccatctgtgtccagagcacatactttccccaatacacagtaagacagatggaatagagtatctacccatctaccttcagagattctttagggggctctttaagcaaggctggtatgcatttatattagtgtcacgtcattgatgggatatttctggcagcaacattttcttccttccatatttcttttactgagctaacatacaccaaagccttatttgagacaaagtgccagtataacatctcattttgttcaaactactgtctcaacagcatcaatctacagtaactaactggattgtccataatactacaattcataattttgtcacaataaaacatccttaaaaagatcgtatattatgaaaatgagactcacagatagtgggacatatttctgcaagaaagacttcaaaactccccagactacataccttttggaataaaatcacatgcttatatgttttttaaatgtataattcattgtgcttacttttcacctaaatataaataagttgaacaaacctatcagtttatgcttctaagatgtatgattcattgtttctactctaaaggctcctgtatattttcttgatttattagtttattatttaatgaagtaacttttgaccaaatcatatggaaaaatgtcaagttcatttttgaaaaagcagatattatgggacaatttatgacaatattttttaagaaaaaaaagttctaggccaggagcagtagctcacgcctgtaatcccagcattttggaaggccgaggcaggcggatcaccggagctcaggagttccagaccagcctggccaacatggtgagatctgtctctactaaaaatacaaaaattagccgggcatggtggcacgagcctgtaatttcagctacttgggaggctaagtcacgagaatagcttgaacccaggaggaagaggttgcagtgagccaagatcgtgccactgcactccagcctgggtgacagagtgagtctctgtctcaaaacaaacaaacaacaacaacaaaaaattctattgtgagtcagttgcaggtactattctttgagcatcctttattcgacaagaaatttgaactttacgtttctttacaaaaaaaaaaaaactgcatagaaattgaagtccattaagaagaatttcctaataagaaaattagtccctttctccttttgtggttttatgcatttttctgtattctctttttttcttgacctttttttgatactactgcctttatctttatggagaaacttgttcctacaccagcaactctaacttgtagctcttttattttccttgttctatgtagctgtctctcctccacatgggcagaacagctgaattcatttctcattctaattggtttcttcagaatctttagaaattgaagatattataatagcataatatttggctatacatttaaaatgttttttccatggatatttcatcaagttttttttttttttttttttttgaaaccaaatctcgctctgtagcctaggctggagtgcagtggtgcgatctcggctcactgcaagctctgcctcccaggttcacgccgttctcctgcctcagcctcccgagtagctgggactacaggcgtctgccaccacgcctggctaatttttttgtatttttttagtagagacggggtttcaccgtgttagccaggatggtctcgatctcctgacctcgtgatccacccgccttggcctctcaaagtgctgggattacaggcgtgagccaccgcgcctggcctcatcaagtattttttaaacattgatttttttaactgtatctcaaaatagatcaaagggtccatataaagtcaaataatatttaaaaatcaatatagtttgaaaaactgggaattgccttacaaatcatgggattcattttgtttcaaaataatatttaagaatatttagtctccactgatttttgaagactcaacttgttatttgaattaagatgttttaaaattccaaaaagaagcaggatttggatcatagatagtttcatgattgatgcttctcttcttaaaagtctctaaagctttccaaatttacttagggtaacatctaatctcctttccttggtgtataaaacctgctgcacgggacttgctcctgtctcctctctgttctcttctctctcactccacctggttcattctgctcccttcataccagcctccgttaagtgtgccaacctgggtcccacctttgtgcctcttcccaggttattccctgagcttggaaagtttgtccttgaagtcttctcagttggttcctttttataattcaggtcttaccacacgttttacctcaccagagaggcttttctgaccacccaatctttaatagcttcgtctgccacctcctccaagttgttttcatttaattctctttttattctcatcacataatcgttaccattgaaacagcatctggtatattctgtttacaatgaatctggaatattcattatttacttttaaaataaacgtccttgtccttccttcctaaaataatgtgctttataagaacagggaccctcactatctatcttgctcagtgctgtgccctcaagtgctagaatagagccttgctcagggatctcaatgtcaagagcatgaacctgattggagagggcatctcagactcagttcatttttccttctctccatttatgtcttctctacctcatacctcctttaatctctcttctctcttaataagccattttcattcatttcagccttatggatttggagcttccttgcacattgtgtcatttattattttaccctgtttatttcttatacatgcattagcaagtcttccatcttttgccataagctgaatatttgttaaataccaggtaatgcaagaaaaagtaccttccccacatataataataacaaaacacaaaagaccaagccccagattaaaagtatccttcaggatatcagtaaggatactatgacttatttctttcttctccctgttctgcacaattatggcagattctctttaaaagatttttcttccaaaatgtgaaaataaactgtgtctctggatgtccttgtattggcatctaatgtttccatttaaatctctcctatgtttgaagtttcagcactgtgacagaagttctgcatttttgtggaatctggacagctctggcatctatcagtgacccttgtggtctcaggggtccactttgtcaaagggtttagagcagattctgatactaattgatctgcattagcaaatcttaccaggtacagaattccaatagggtccttaatacaaagatagcagttgccggttaattcacaaagacatattcattgtccccatgttatcatctttccaatatccaaagccttcttagaagcaaacagcaaaaaatggttgtttggttaagcacaggtttagaattaatcaaaatgaatgactttaatgcatattgccatcaaactatgtggcctggataggcagaggagcctctaccaagatgactccaactagatgactgtttcccagcatcaaggaccttctttactcacacttccattgctacaggaaaatgtaggctattcacccaatgtgtgttactatattctggttttagtcataaatgaaatttaaatcatagtgttatgtgcatgtatcagtcatgttctagagggtataatattctaacctatttcatctatagaatttattaaactatgtttagtaaaacatcaactagggcaaattaaaaacttgcattctatgcaaaagcaattatgaaaacctgcatcttaccagtgtgcatcagcgactaatggtcaggcaaaaaagacaaaagagaattaaaatgatcacatgtctgcaatgtctttatctcactctagttacacagttttttaaagtcaactatttgaactttgcaactaaatgagaactagtacataaaggcagcatcttctaagtaatcaattgaaaagtgactagctacagctagtgactaatggctattgatatattaaatccatcacacatgtatatataaatgaaagagagttgggttatacgaaagaaaattgatatgtgacttttaccttaccatttgctagcctccaaccagctctggcttcttcaatgtaagcatgtgaagaactatgaaacagcccagacaactccggtctcccaaaagttgatgaaatgtgtcttcttcttgctgcctttttaccctccatgttgaccattattcttctattacaacagcattctttcatgatgggtatattaaacatggttataggttatgttagtttcatcattacattaaaatccataatgaaatttggggttgattctctgatatcagaagccacacacatgcatactttgtcttaaaacaagctacttctatgatttattcccattaaagtttactaagaactacctaatgcaagacactgttcatggttggggatgtcaaattggcaaaacctcatccacaacaatctcatccatttcataaaagtgagagaaataattttctgcttcgctggcagccacttggcccttgctcccaaattctggtaatgcacagaatttggagtttagctaaagtttttatgcaattctatttgttaaataaatgcttaattttaatcttgggtgatatttttaaacaaacagcactaactttaataaaatatttttatttgaggagcattaagaaaaaggatgaagacagaaacctgattaacagactcaaggagctccaaaccccaacacacattgcattcactacaagataggatattttaccccatagaccactttcctgagttgtatatctatctttactagtcttgacagaaaacatgaggtttctgacatagaaaacagaatgattacctacaaaaaaatcttgtattggtttcccacaccccaatcccctacagggtgatgtgatgaaagtcagatatacccagtttgtgcaagaagagagaggtctgttccataggagaggaatcccccgaattatacatttctgagctttcatagaatggctgtcatagttgcccatcctcccttcagaagaaagagaaatcatatcttctaatataaacaaattatctcggggaagagaaagagaatgtctccagaatcactaccctttgtcatctaaacaaatggttccaggggagaaaaatctgaatctctccaggacatatctgaatttaattttcaaagggttcttgccattcgttcatgtttgaacccaggttgctagaactcagaaagctcacatcatgaagaaatatgaaaatatttatgagacatttcttcctgacagtctgctgttatccctcttcagatcaccttttagtaattgaacagtatgtggtgtgctaagggagtgtccagagcatgaaactgctttactgtccaggcttgaaatcagccatactttctgttagttcctgttccaaaatgcttcattttctgttaatctttggttatcagagtgagtatatttctcctttcctcacaattctcttacctgtcaataactcataaaattaggttgaaaactcttgtttatatcaattcaaaaaactaaaggaagaattataataattatttcaaaattaaaaatcaagtctgactcaatgtttttgtctagaaaattcttagaaactttctactaaaaaaaaataatgcccacctgtatatatcagttattcagtccctcttgtttcactttgctgtccataaccattcattggaattgtataggaagaaatgtgatattttaatgttaaatatccatacttacaagtttaaaaataataatttcatctgaagttacagtgtggttatcaaaggcttcttttcaattaaaatggagttttaacattaggattgtatttggcttatccctccaatgaaaggttttctcctgacaaagtgattaatgtatcccctaatgacaaaataatttgtctttttttttttatgaacttgacatccttttctcattatttctcaaccaggtcaaaaaggcagaaacagttctgcagaattttttaggtggttggaaatgttgacattttatcattgcttgagggagaattaagaatggacttaagaatatccattttttgttattactgttatttctgtgatggagagtttgattttggttgcacactctctcagagaacttattacatgctaatataataacttttattgcctttataatttattattttagtatttatttaaatgttttactaatatgtttccctgatcaaaatgctcaagtagaaagcaaagttgatcttacaaatatatttcaagtttttgctagactttcatttgttctgattagttattgctgcataatctactacccccaaaacttaatggcttaaaacaaacattttttattgttcatgattttttgggtcaggaatatgggaagggctcagctgatgcccatggcatcctctggaatagctgaggctggatgatccactccaagatggcatcttcactctcttgtctagagcattcgtgctgttcatcccctctctctctccacaaggtgtcgcatccttcagagcctcttcatgtaaggagcttctcttagcttggctgcccaagggtacctgagtttcttcacttggcagcttaagtcgccaaagccaagtgtcccaagagacaaaggcagagtctggaagccttcttataatccagctttggaatttgaacatattctattcatgaagccagtcatggaggaaagggagttccattctacctctcaataggaattattgcaaagaaagtgtggtccatacattcaacatgcccagaaaatggcttcatctctgcctctccagaaaactgggtagtaaatcaagagaaagaaaggctgattctcatcacagctttaaactttaatccagtattagacccatttgaaacaaacaaaatgatgtacttagctataaagaaaaaagatcaagaattgttaacttttttctcaagaagaaagcaggtgagctaatggaaagaaggtttaaagggcactttacaaaacactttttataaaattgcctgttaatctctcacagaaacaaaaaattcctggcatgctgcaaatgacatggtgatgtatcaatcaagactttcgattagacaagtgttaaatcttcagggaacttaaatctcaagtgtttaattggctgtttcatctctccagcaattttcaagaactctgaagaacttagcactttcacacaagtaaaaccagcagttttgtttatcagtggttcataaaataacctaataatttaaaatgaaaccctcttttaaaaaagaatacatgattactataatacctgcgtaaaattttcctataaccaaacaaaattatgaatcctccaacaggcaacttacacacgttttttgtaaatctaacaatttttcatcttgtcattgtttccttgttatctgtatcaccttcttctcttccctgtttttcatcctttttgttttttataattcataatagtgctgatttatatgcattttaatatttctgatgcccaaacattttaattttcaaaacaagattttagaatttgttttctttttcctttccactgtagtaaaaacattaatgataataatgtgtttttaacattaagctaatcatactttatcaaaaaatatttttcttaagaaatctttgataaatggatttaaatagtcacttgttgctctgtagataataaatgaaaatctgttgctatatctttatttctcaatattcttcccttaggcagatgctgacttccctgtccttcatatatattgatttgaagaatgaatattttaaataattttagccagctgtgtgttccctgattttttccccactgtcttctgttaattctagactctaaaatagttattcattctgtaaatgattttggtgtgtctactttatttctcttatcattgcactaatttctggtcaaagttgattaaaatagggccgttgcccttaagatacttatagtctagcaaaaaaaaaaaaaaaaggaagaagaaccattaactattacaaaatacgtgaaataccgcaacagaaaagtgtattatgggttcagtagagtcagagcagattcttcttggagacaaaaagagcaggcaggaaacatcttctccaaacaaggccaaataaagatctatttattcatagtaaggactttagaatttattctattaaaaagggttaaatagagagcaataaggattgtatgcatttagaatatttttataattaaacattaaagtccatgatctttatcttcaatcttgtaaaaattttccacataattttataaaattatctatgaatgcacataactgtaaaaagtactctccttttctcaagtctttctacagaagatatgtgaatgagtttgcctcccaaaatacatactcttttaagaattaattcccagaaatattttactataaaataattattacttctgacctgcttaaaacagatacatgggctatttttaaccaatattggtagttaaaataaatatgggttggaataatactacaagtaacaataataaatattcattgaggcccattcattttccaggcattctactaattactttatagatattttctcattttgttctacaataatcctataaagtaggtattattattttctctattttacagtactaacacagaaacacaaagattaaactactggatccaggtctcaagccaggaggtggaggatcaaggattctaataaaggtgcaaggattctagcatgttaaaaacatttaaataagagacccgcaaattatggtaccagaagtcaattaataggtattttcctatattgtgatcatttctaagcacataatactgattattttgttattagtttaaatcttatgacctgtttttgaattagctatataatcctgaaaatctccaaacatttttttttgctctaataacccatgctaacatgtacctccttttatttattgtgatgtaatttgcatacacaaaaatgtacaaattttggtgtgcagcttaatgaaattttacatgtgcatatataatacattaccaccacccagatcaagacatgttccttctccccagtagtttctgtatgccactttccagtaaataactgtattagtctgttctcaggtggctaataaagacagacctgagactgaataatttataaaggaaagaggtttaattgtcaaacgcacagttccacgtggctggggaggtctcagaatcatggtggaaagtgaatgaggaacaaagtcacgttttacacggtggcaggcaagaaagcttgtgcaggggaactccccaatataaaactatcggatctcatgaaacttattcactatcacaagaacagcatgaggaatacccaccccaatgattcaattacctcctaccaggttcctcccacaacacatgggaattatgggagctaaaattcaagttgagatttgggtggggacacagccaaaccatatcattccattactgacaactcccaaatctcatgtcctgacatttcaaaacaaatcatgccttcccaacagtctccccaaagtcttaactcatttcagcattaactcaaaagtccacggtccaaagtctcatctgagacaaggcaagtcccttctgcctatgagcctataaaatcaaaggcaagttaattacttcctagatacaatggagtacaaacattgatacaatggagtacagccattccaaatgggataaatgggctaagacaaagggggtacaggccccatgcaagtccaaaatccagcagggcagtcaaatcttaaagctccaaaatgttctttgactccatgtctcgtatccaggtcatgctgatgcaagaggagtgttcccgtggtcttcagcatctctgaccctgtggctttgcagggtatagcccctctcctggctgctttcatggcctggcattgattgtctgtggcttttccaggcacatcatataagctgtccatggatctaccattctggagtccagaggatggtgtcccgcttctcacagctccactaggcgctgccctagtggggactctgtgttggagctccaaccccacatttcccttctgcattgccccagcagagtttctccatgagggctccacccctgcagtgtaccactgcctggacatccagacatttccatacatcctttaaaatctagagggaaattctcaaacctcaattcttgacttctgtgcacctgcaggcccaacaccatgtgtaagccaccaaggcttgaggcttataccctctgaagtcatggcccaagctgtacgttggcaccttttagccacagctggagcatcagggatgcagggcaccaagtacctaggctgcacacagcaggcaggccctgggcccagcccatgaaaccatttttttctcctcagcttctaggcctatgatgggaggggctgctgtgaagacctctgaaatgccctggagacattttccccattgtattgccaattaacatttggctcctcattacttatgcaaatttctgtagaagacttgaatttctcctcagaaaatgggtttttcttttccatcacattgtcagactgcaaattttccaattttttatgttctgcatccttttaaacatgagttccaattccaaagcatatcttgtgaatgcataaacctgaatgcttttaacagtagccaagtcaccttttcaaaactttgctgcttagaaatttcttccaccagttgccccaaatcatctctctcaagttcaaatttccataaatctctagggcaggggcaaaatgcccccagtctctttgctaaaacataacaagagttacctttgcttcagttcccaataagttccttatctccatctgaggccacatcagcctggactttattgttcatatcactatcagcattttagtcaaagccactcaacaggtctctaggaagttccaaacttcccacatctacctgtcttcttctgagccctccaaactgttccagtctctgcctgttacccagttccaaagtcacttgacattttcaggtatctttagagcagttccccggtacacctggtaacaatttactgtattaatctgttctcacactgctaataaagacatacccaacactgggtgatttataaaggaaagaggtttaattgattcacagttccacatgttgaggagggctaacaatcatggtggaagatgaaggaggagcaaagtcacatcttacatagcggcaggcaagggagcttgtgtaggggaactcccctttataaaaccatcagatcttgtgagatttattattcactatcacgagtaaagcatggaattataattcaattgcatcccaccagttccctcctacaacacatcggaattataggagctacaattcaagatgagatctgcatggggacacagccaagccatatcaataaccaactacacccagaggtaacaaacatcctaaactctgtcaccataaattagaatttttctctttctaaatttcatataaacagaatcaaacagtagatacattttaggtctttgtcctttcactctacatgtttttgttattatttatgtagttacatggagtagtattttttattgctgtatgatatctcattgtatgaatatgacacaatttttcatcaattatattataggtggacatttgagttgtttcagtttggtgctgtcatgaataaatcttctacattctttttgtggatgcatgctcttgtttctcttggccatataaaccaaggagtggaattgctagaacaaaaaatatgtctatgtttaacttgatttagtatgtgcaaagtcttatttaaagtggtttactattttatttacactcaccagcaatgtacgagaatactttttcttcacaatctctctgtcacatgcaaatctttctaattttagtttttctgatatttaattttggttttaacttccatttccctgagctatcattggatcataatgtaacagtagattgggtaatgcagaaggaaaaagccctgggaattttaatttctgttaatgagtgtctaagatctaaaatttctacttagttctatttgtttttctcctgaagtgttccatatttccaccaattatacttatcttttcttttaaattgtataatatatgtttattattgtattaaagtccttgcctgctaatttaataatttgctttatctgtgagcctgcttctattgactgttcctcttgattctaagtcacatttttctggttctttgtatgttttgtaatgatttcattgtattctgggaattgtgaataacagaatgttggagactaaatatacatgttttgttattttccagagagtgcacaccctttcctgtgcctagcagcttagctgagggttaatcattcagactccttccagcatatgttgagctggcactcaagtgaagctacaaattattgattttacctgtgattaacttaaactttaattctctttgtgatcaaagagatatcaaagagatatcacctctttgatacattaattatttgtgcaggaacaggattggcagaaggtttacatatttttagttcacctttatattcaaccctagctgggctgcagaatccaatcgtcttgacaatgtactatatgatttatttctgctcatcagcccctcctataaagttttctgagcaaaactaaaggatagagaaaaattattgacccagttgtttgtccatctatttgacttttttccagatgcaatccaccctgccaatttgtgctgttgtcaaaagcccagataattttctcttttgcatgtacattttctccatgtatcctgacctatattcaaaccaggcatgtttcttcaagtgtgaatgctgatatggctctgcttacttataaagatcttgatttactccagaatttactacctccttgccagttactaccatctgcaatattcagaaatacaaagatgaaacttatttctttataaaatcaattatatagatcatatacttcaatttctgctaatgataaaaaagttaaacatgccaattcaagtaactctgtcatgtgtgtttagaattcagtcattttggataacatccagtctaacccagatttccaccctcctccttctcattccatctccttggttttatacccagcatctaatgtaccaattaccatactggagctaggagacagttattacaccaccataccacagtatggccttgcttctggcttttgttgaggaacagcatcttacccagtctctgtcatcctaaaccagtagatttcgctaataatctacagggatcagatccttgtaacctgtattctctttgctctccttgcttagcggtatctgtttctctcttagaacactggtctgatgctctctttcactactgtgaagtacataggactctaggaatctactctgtgaaccatttgcctaaaccattccctcagccattgcttgggtactggttagatgcacttgcttctaaggcacaagaaccttcttaattctacacaaagtgaagaacaaacaagtctgtcacttctcagattcacccaaatgtatgtgatatttcagcctgaccctgggatctcagcccagtggagagcagaacctagacatttcacatttgtattaatgttcttttctacttccagcagaattctgtctcctagataccacctcctcctcctgtaattcaacaaaagtttgccccgctccacactggcagaaaaacttctgaaattctcatttgtagtatttttatattttataatttgtgttattaaccctatatttatagatctcctggctttgaaatttcatatgagaagtcaatcacatggaattcaagaaacccttttctctggctcttgaaattgagagctgtggtttttaagagtgtcatttctattgagggtttaattaacttctttgttctagccatatttccctttccaatcaatgcatatacaacgctatgctccctgaatagtgggatagattaacagtgtaaagaagcatgagaacacgattaaaatctcaatacatagccctaacaatcaggtttctgacaggaaggagatggcacactcagaatgcaagaatgaaaaatgtttaaggaaggaactgtttaccaaatatggagatggttgaggtaagcccactataggtgatgatgcaagggggaattatctctaggtaaagggtgaagtgattgttttttaaagaagagagagcagctatgctattttaataattgtaggaatgttcacaaatcacaggcaggtcacaatagctagaaatgggctttgtgaactactagcattgtattcagactttgaaagagcatgaacacagggtaaatattaagggattcattttgagatcctcaaattctctaaatttgtttttataaagctgatgtgcccaagatagtggggtttttttgtttttttgttttgttttgttttgtttgtttgtttgtttttttgagacagagttttgttctgggatggagtgtagtggcgcgatctgggctcactgcaacctctgcctcctgagttcaagcgattctcctgcctcagcctcctgagtagctgggattacagatttgcaccactaagctcagctaatttttgtagttttaatagagacggggtttcaccatgttggttggccaggatggtctccatctcttgacctcgtgatccgcccgccttggcctcccaagatagtgtcttctttaaaggcctcaaggtggatgaagaatgaggcaattattgcctgtgttgagatgttctaaattccaatgtattgtgtagtgaggcaaaagtcatgacaagtttaatttaaaaatcttgccacttcttcttttatcagtctttataaaaatctatcactctgaaggagagaatggtaagaagtggctatggccttagatagaagaacatagccattgtcaaaccatatcgtcacagggagggaactacgggactaaatattcccctaattattttctgccactacccagactgatgctagttcctgctattggttgaaacctgccaaagacagaaggaaagaaatatagttgtagcacctaaatgtcagcttgtggtggaaagaccaggaagagaagagcagaatcctagaggagcaaagggagaatatagagcaagcataacaacacattgttttctatcttccttcccaattattattcatgttaatttaaaaacagtataatgcttgctttattatgatacccatatatatatatacactttcatgtatatatatatagataggtgggggaaagagttgagccaactgtatatagttcaagagtcaactgtatacaagtacatatgtatgtgtatacagttgtatgtgtatacagttgacttgaattatatgaagttgactacgtatgtgtgtgtgtgtgtgtgtatacagttgactcttgaacaacacaggggtctagggtgccaaccagccacacagtcaaaaatcgatgagtaacttttgactcccccaaaacgtaattaacagactactattgaccagaagccttattcataacataaaaaagtcaattaatacatattttatatgttatatgcattatagaccgtattcttgtaatacagtaagctagagaatggaaaatgttattaaaaaaatcattaaaaaaccatcttctattcattaagtcaaagtagatcatcctaaaggtctttaacctcatcatctccacattaagtaggctgaggaggataagaaggaggggttggtcttgctgtctcagaggtggcagaggcaggagaaaatatccatataagtggaaccatttagttaaaaaacccactttgttcaaggcttaactgtatatagattttttcctatctataatttctttctcaagcaattcgtccttttcttgagggagtaagttagtcagtaaactcaatccatctttattccagctacttaccaagtgaccacataaccttttcaatttcttctttccttcattgtctcctaaacaaccactattcattcttcaagatgctattaggaactatcatatggaattgttaaatattgaatgagttagcaaataaatggtgggggggagactcttaaaagctatttttgttctttccaatttgacccactttccttcctatctgatcgttgtttgttttcttaaagaatcacagtccctttgggctgctattataaaacaccgcaaactgggtgacttataaacaacagatttttttctctgagttctggaggctgaaaagtttaagataaaggtgctgacagactttgtgtctagttagggcccacttcctcgtagacagctgtcttgccattataacctccgtggggaaaaaggtagggcagctttttggagtctcttttataagggcactaatccctgccctcatgacctaattgtctgccaaggaccccacctcctaataccattgccttgggagttaagactgcaacatatggattttgggagtccataaacattcagcctattagcaagtaaccctatgcattaaaattcttacaacattttatttctttctttactcttaggatttagcaaagggcctagtgcatagtagggactcggtgaaagtttgtagaatgaattaattcttcactgtcctcatgaggtatattgtatccctaataaataatttatggattataaacttgttatgttgatccactgaacaacatatctatatacaactattcatctttccattcccaacatcccagctttcgattcaatataaatacccacttattcattctcaccatttaagttgtcatctgaattctcccatttcttcgtggtttctctccttttcttgagtgtttttttttatctatacaaaaagttactgcaattttatgcttcccctccattgatctctttgaatgccattcctttcttcatacatttatttttcccttttactgtcctcaaacaagattgtctctcatcaggagctttttcttctagcctccaaatgaacagtttaatattttatacatagttattgtatactttgtttaaccttacaattatatctctccataatctttcttcttcctctagactgtctccatcctacactgtattttatattctttactttgaggcatctctaagaagattctttagacagggtctccctcttagctctgtcacacaggctggagtgcagtggttgcaatcatagctcactgaagcctcaaactcctgagcccaagtgatcctcctgcctcagcttcccaagtagttgtggttacagaagcaagtcactgtgtccagttctaagatgtttcttgtaatctaaatcatgacagctggcatttactctttcatgtgtcatgttctgtcctaaatgtttatatgtaagttacttaattgtcaatacaactctacaagttgcataccatgagtattcccatttttatagttaacaaatgtgagatccagagagtcaacagacccatgttattcagctattaagtgattgagctgggttgctctgcctctgtggctcacattttaactggtttttggcactatttctatattttcttactaccctggaactcatatagtcagatggacaaatgataccagcccgtataactgtatttctatttttccaaagccttattattgtctcaggtgcttgtacctgttttattctatatttttctgtgtagtttgcagaaaggtttcatttaccagaagaaatggtctgcataatccttctagaaagcactggtatcctttgattctccattctaacatttcctcatattatttacaagtacaagctttcattgcctatgtcttcactgtgttttgggtgtgttctaataaaatctaatctttatcttctcccaaatgaatgaaaattactttttttaaaacattttacttttctagctagagttattttaagcctctgaaatgtccatgttttattaaaatgattaatgcatcatagtatcttctgacctgtcaccatatcactgagagcttaatatctaaaatgatagacataattattaatattgaactgcatttatgaaaaatcccaagcttctattagtaatgtagctgactttatccagagacggaaaccaaataatgtacaatgcaaatatttggagaataaactgttttattacttgtacaaattaattagaaaaacaactaaaatacaaaatatcttactatagaaatatatgttaatagaatttccctaatactaagcagtaatctctccaggtagttttaggatttctacactaaaattgttattacatattactgccaactgaacaattccttcattttgattgtactatgtgcaaaacgaatcataaaaaactctaactgggagtctcaatatctattttaggtaagtgtaattaagtcctgttacagagcaatagctgaaccagttgctctcttgtccaaggtccaaattttgggatctatatatttgtttaaactcatctccatgtgacttattattttacatataagatctaggctgggtctgatccattcccccaagtatgtttacaaatagttgtcatgaaactcccctgttttttagatcttatcactggacagctattgggaagattctaacagcaagataagcaggccttttaggctttacgattatgttacatttgggagtttagaattatccatatcagaggtgtctatgttgaatatcttgagcctctccaacccagaatgagctgtcacttaggaactttccatcttagttttttgtttaggttcccaataaatagtttggagacaaagatttcaggaaaaagtagtttattgcagaagtgaaagtaatgaggagttggaaaataacacaggaagaaaaggcagataaataaagaatgagatattcagccacctatctctggtgactggaacagattctggtagttggacatcagacaggaatgaccaggtttgagaaacacgaatggagcactcagtattgacttgtattagtcccttctcacagtgctataaagaacttccccgagactggataatttacaaaggaaagaggtttaattgacttccagctctgcatggctgggaaagtcccaggaaacttaacaatcatggtggaagggcaagcaggcgacaggagagaagagaatgaaagaggaacttccaaccacttataaaaccatcggatctcatgagaactcattcactgtcataagaacagcatcggagaaagcacccccatgatccaatcacctccctcccttgacatgtgggaattacagttccctcccttgagacgtgtggattacaatttgagatgagatttgggtggggacatagagccacaccatatcaatactctcacagacacatatttaagattaaaagaaatggagagttaagtaagttaaagttaagaagaaaagctgcaatttaaatagctagaacaatatagaggtgaaaataaatagtaattggaattggaaaagaaatggaataattataacattatgtcctcatttttatatgtcagttgttactttcaaagtaaaattaattaattaaattattttccactttttagtagatcatcagggatatatcaaacaagatatttcaaagttctccatcagatctgattcatagtattgaatatgggtggctttaccaaattttcagcagcatacacgttataggaataattctccattgtttgttattcacattataagatgtcaaacagtatcatttgttaattgaattttatcaataacactttcagtattctctctaagcagaaaaatttttcattccagatgtgccaaattagtaatttctgtattttgcagtagcctggtgcatattgggatattccctgcagaataaaaaccaggttgcttaatcttgcataccccgctgtaaatagaggcacaatgcttggcaggtctttttgggttttagatgttgtattagtcagggttctctaaagagatacgactaataggatatatgtgtatatgaaggggagtatattaggagaattgactcacacgatcgcaaggggaagtcccacaataggctgtctgcaagatgaggcaccagaaagccagtccaagtcccaaaacttccaaagtagggaaactgataatgcagccttcggtctgtgtctgaaggcccaacagcccctggcaaatcactggtgcaagtccaagagtccaaaagctgaagaacttggagtctgatgttagagggcaggaagcattcagcatgggagaaagttggaggccagaagactcagcaagtgtgctctttccatgcctgcttttatgctggcagctgattagagggtgcccacccagattgagggtgggtctgcctctcccagtccactgactcaaatgttaatctcctttggcaacatgctcacagacacacccaggaataataattcgcatccttcaatccaatcaagttgacactcaatgttaaccatcaaggatttttttttttttttgaaatggattctcactctgtcacccaggctggagtgcagtggtgcgatcttggctcactgcaacctccgcctcccgggttcaagtggttctcctgcctcagcctcctgagtagctgggattacaggcacccaccaccactcctggctaattgtctttatttttagtagagacagggtttcaccatcttggccaggctggtcttgaacttctgacctcgtgatccacccgcctcggcctcccaaagtgctgggattacagacatgagccaccatgcccggcccagggatgtatttacacaacatttggaatactgatcattagtgagtaactcataaataaaaactctgtcctttagcctcattattcaaacaaagtaatattgcctaaaatgcctgtgtcagttaaggacaatataagtacttaaagagaattacatcataagcccttagagttttgaaatcaagccatgctctcttaggcatgtaactattatatttctgagaaatggctcctagcatgctattgggccttactcatgacagaacatcggatcagagtacaaaatattcatgctaccttagctgtccctcatgaactaggctctatcttttccattaagctacgaaattcaccaccaagggcagcattcaaggaggtgatggtggaggggtggggagtagtggggcatgtaagattggccttaagctgatcctaaggtaaaccacctgaggaggtgattgatactcttagcacatgtactcccacacctctccacacatctcccttagcaaataccaatggactcatgtcgggatctctgagacagagttgactgaagaaggtttgcaggtgagtaggcaaaatatgctagtaccagccagaaatgaactgctatataatgtagttatctcaggggtatacttggagagcactcctttggctatgtcttcagatgatatatctggaggggctagaaaaaagaaatggcaagaagtatgaatgtgaactgattcgtgaatagtagcaaaaatttggatggaatggtctaataatctgaagaaacaggacttgaacacattttaagtatggtagtctcagaattggcccagagcataagaatatgtgtgtcctatatgaattattcatcaagggcacagactgaagacaatgctttcaataatcagatgttcaatatgacacactctagggatgtttgcaatctgctctcccattacttcactgcttatttgctcaaaagttaatgagaaaaatggccacagaaaccaggctggaagttatatgtttgctcaacaaccttgtctttccctcactaaagctgatctggcgcacccactgctgagtgcctagtctattatcaggagcaaaaactgaccctttctcatgaggttaggggagcatgacagacagtcatgtcattatggatgggacaaaaatttgcccccacaggaataaatatttatcccaaatgtggatttctcttttttggacaatgtgacagccccaaatgccttatttgccatcattttatcccttttactttgcctttaacaaagaatgtttatggtgaaaaagtgagaaaacaggctgattacttaggaaatcattacaacgtggtgcaactgtcaataaatcttaggtgtgacactggctgggtgacaacaacttgcaaatttgaagagctattctacaggatgctttatgagctccaaatcaacaacattatctggtttttcttttttccaaagtcagaatatagcaacttagagcacagtactatttctcttaggaacactcttgaaaagattttgctttcatttttctctagttatgcttttggctgattagaattcttggtttccaagggacaaatgcttaacaagggcacaaaataatccattgacctggatgctgaggctgccagctggcctttggggctcctcatgttccagtaccaatgagcaaaggagactgataaagtatctgtggtgactgatcttagagtgggtgtgactgatgtttctacaaaaaaggggcagcataaactatgtctaaaaccaggagtttctctgagaggggatacctcctagcacttccacatccagctgaaaaggttcattaaagtttcaaaccaatcaacacaataaaaatgaccatggctcatcccccattgagagaaaagtacaacactcaatcaaacaaagctgaagaacatggaaattataaataccaactatgacctcacgaacaacagtagaaacaactagagcaaccacccatggttgttagtttatgtttttgttatttgtattttatgtatattaatctatttttcttgttcttctttttccttactattatttcattaaaatgggttggtagtggttacatttataattttatccttagttttcagaatattagagtagggctataattaaatttcgatgactaaaaacacttagctagagatgtagttactaatgggatgacgaatgtatttggatatttaggaaagtagtagctttgtagatgagtttttctcaatgcaaaaacatttaaaaggaggcaactttaaaagatgaagcatgcaatcttaaataaagatataattttctaacatctttactcacccactatcacatcaccaaaatacataaagcaaaaacattagtagaaagtcacaacggttgtaggtgaatttaaataaactgtcagttatgattgatgaggtagaccaaaatatgtaagagtgcatgtaatataataaatcatacagttgacctaatcaatatatctcaaacacaataccctgacaacagagaacactttttctttatatactcccatgaaattcttcaagaattgattatttattaggctaccaagaaaacctcagcaaaatcaaaaaagtggaaatcatgtagatcatatcgatttgctttccaatataatcgaaatatttgcttttgtttcacaatcatgtaactcccagtttttcttttagaaatcattttgctgttaaagcacttaatagagaacttggagaaaaagaatggaaatgcttatgaggaaattgcttctggcttctacactggaaagagtagagtcaacttgctgcatattttccccccagggaataaaaatcttacatttctactcttacttaaaacaaacagaaccatttacaaatctttcatttttctcttaataagctttcagctcaattcaggccagtactaacaagcagaactttcccttgggaaagatatctgaaaaaaaaaagttactttattctattttccttccaaattactttactcattataaaccaggtctcagaatatcctagactaaatcaaacagccctctgtaataaagacggagcatcccagctactaaggtgaagcagataaaagaaagaagagtttactcaagttccccaaatttcaatatatttgaaaagttattgatgaccctcaatattctaggttacccaagtggacagaaaatatctctttatatatttgatttccccacaaattgttcatactttatttctctaaacatactctttttaaaaaatctagtaacgtatcttgtttctatgcaataatacgtaaatgtttatcattcagtacttatatgcttatattgttgttttgtataatctcatgactcaaagatagagcaatgtaatatacaaaagaaaccatgtatgaatgtgaacttcagtgcaagcatcagtgtaataagcagctcaggaatagtaccaaatgccttaggaatttgatctttctgcaaatatttattgaggacatactaagtgtcagggaccattccaggtgccaaggataaagcaatggacacaacagtgtaggggaagtaacagaaaagcaaaacatgcaagtatgaaatatgtcagagtatattacttgtatgtgctatgaagaaaataaagcaggggctaggtgcggtggttcacacctgtaatcccagcactttgggaggacaaggtggacagatcaccttaggtcatgagttcaagacaagtctggccaacatggtgaaactctatctctactaaaaatgcaaaaattagccaggcatgatggtgggctcctgtaatcccagctactccagaggctgaggcaggagaatcgcttgaatccggaaagcagaggttgcagtgagctgagattgcaccattgcactccagcctggtgacaagagcaaaacctcctctctctctctcaaaaaaaaaaaagaatgacaaaagaaagaaagaaaaagaaagaagaaagaaagaaagaaagaaagaaagaaagaaagaaagaaagaaagaaagaaagggagggagggagggagagagggagggaaagaaggaaagaaggaaggaaggagagagaaagaaagaaggagagagaaagaaagaaagagaaagaaagaaaagaaagagagaaagaaagaaagagaaagaaagaaagaaaaaagaaagaaagaccaaaagaaagcagggtaaggatgataggtagtgccaaattgagtagagattgctatcttacccatgatagtatgggaaggtctctaagagggcaacagttgagcagagacttgagtaagcaagagttgattcacaatgatgcacggggtaagaatatctttggcaaagagaacagcaagtgtaatatctcaaggtgggtgtgtacttgacgttggaggaccagcaaagaggcacatgtagtggtaaagcagcagtgggtatggaaagtggtaagagatgaggccttggaggtagtgaggtgccaggccatgtagggcttgtgccagttaatgacattggctttaactgttagagagatggggagactttggagatcataagcaaagcagtaatataatctgacttagattataaaagattacagaaaatctcaaatatgtgggagcatagatacttcaaatttggctgaatgctgtcacattcagtggaaaaaaatctataaaagacagaaaaaacaatataaataatgtgtggcccgtagctgctgaacagaactgataaaaaatattgaaaaatgtgcagtaaccaaagtcctgattctagggctggaaatcagaactacagaagtggagtttgtggtgatgccctattataggatgttctggcatgagttcccaagcgggaccaatcagggggttttacttcctaaatcttccaataaagacatattcgatcaatcagctacatacacgagcagatggaggactaatttaaaaaataaacttggataggacatggagcctaatataggtgaaattattgtgtgtggttgatgaaacccaggaaaataaaggggccttatcttattaaagctgtcaccttaggtcaggctggggacatctctctgtaactttctccagcatccccacactgtatacaacttgggaaataattttgttctatatttgcattcccacatttctacatatatttttctggttttctatatattttgcaataatgcattacagttatttaccgatatgtctctcttcctcactaacttgtgagcagttagatactaggtatcatgtctttttcatctttgcatctcacagtcactaggacagcatttggcatgtaggatttaccaagtaaatagtaatttaaatatatctctggaaacaaggaagcatgtataactttttcttgctctatctaatttttaaaaaatcatcctcttagtttcccactcctaattggagaagaatctctctgttggcttttcatttttgtcattatggaggatttataggtttgattttcccaacattttgaatgtgagaactaagatttcacaatgaaagttaagctttcaattaacaaagaagaaagagaaaggcatcttggtctgcataaatttaaagtcacttgattaaaaatgtatatatatatatatgtgtgtatacatatataatgatattgaaaagatagaactacaaaataaatctatagcacatccaattaatagttatattgtaagttttatttagcacttactccatgacagaactgttctaagttctttataggctttttattaaacttcttcacaatattattttcaattatatgtgtcaattaatttggatgtagagaagaaatagataattttctaccaaaatggacataataatttctattttctggattgaaaaggatggtatgagaatttggaaagctagtcagacatgtaactgccagcttttaactagacccagaaaagtgagttttactcaatttctagtgaacggataataattcctaattcaaactgttctgataaagaaaacaattgaaaggttttcaaattattttacgaagcaaacaaaaatcaggcaaggacatcacacaaactgaaaactactcttaatttcatgtatggaaacatctgtagataccctaaattcatgcaagagatatccacagaatatgaggagcaaatgtgtttaactgtagaaatttaaagatggctcattattaggaaatttgttactataattggctatattatcaatgtaaaaatattgattatatgggaagattaataaaaactgatgaaatacagtaagttttaacttagcaagttaaaagtagaaggtaactgcctttataaatggtgctctgccagatatctacaacaaacactctaactagacataaagcatttgaaatatttccatcaaagctaggtataagcaatgaacacggctattgtaccacatcatattgccttgtagccactgcagcaagacaagagaaaatgatgaggtaaaaatattggtataaaaatatttcactgctgaaagtttttaaagttattatctaatccacatgtcaccaaagtaaaatatggaagcgtgaatattaatatccaccttatactgttttaaaatatacttgaagaattttttcctgtaaagcttttagcagagtcttacataaaataagtactcaattacctatcatcaacattatcatcattatcatcaccatttactccctgagcctgcgaagttaaaggcacaaccaaatccatgacaatttgaatacatttaaaaggtttgatctgcaactcctagttaaaggaggagattgaacatattccttattaaaagcataaactcacaaagacacggaggatgaaagaagagagaaataataaaaattacttaaacaattacttaaagattaaagtaggtaaaaaagttaaaattacttaaataagaaacatttaagcaaaatagaaaattctcccaaaatttggagttattggctctaagaacctctagaagagatgagaggtgtagaactgagttaaggagacttagcagtcttttttaaagaagatttatagatcccctccccttcccctccacccctccatactccccacaagatgctggatagtttttatttgggggggtaatttacttgggagatatcaccagacaccaccaccagattcatggtaaaaccttaatgtccagggtaaaaaagaatataattttaacaattttttccatatgtaaaaaaggagtactactgtggaatgcatttatgtaatttttaagttaaattattgtctaagtatttaaaagcattgacagatgtgggtatctatgaatgcagaagaaatggtgaatctgaaaccacaaataatattttcttaatttaattctccccagaaatactactcatcagcatgttgaaggtttagctgataatttccagaacaaattgcatgggaaagttgaatcatttgtgggttttttgtatggtgagtattagaatccagatatagacatctagataatagcatttattgggagagaatttttgcatgattaaaaaatttatacatgatgcctatgacaattgcagtattaggaactgattaaatctttttatttggggagtgtctaaaatctcagtttctacttttattatgactgcttcttttttaacttttaatttaagttcaggggtacatgtgcagggtttgaaaaataggtaaacttgtatcgtgggggtttgctgtacagattatttataccagccatgtattaagcctagtccccacgagttactttcctgatcttctccctcctcccaccttccaccctccaacagaccccagcatgtgttgttcctctctatatgtccatgtgttctcatcatttagctcccacttataaggaagaagatgcaatatttgggtttctgttcctgtgttagtttgctgaggataatggtctccagctccatccatgtccctgcaaaggacatgatctcattccttcttatggctgcatagtattccatgatgtgcatgtaccacattttctttatctagtctatcattgatgggcatttaagttgattccatgtctttgctattgtgaatactgcttcaataaacatacatgtgcatgtatttttataatagaatgacttatagtccttgatttaacctttgttttggaaagaatcataaattttaatgaaaaactggtcaaaattggtaagagtatctacaaatattgtagccaacgaatggtccttctaacactgtatctgttacagaacttttatgtaaatggacaacattttacaatgttgaatgaacatagattaattaaatcattctacaggatggaattgttcaaaagctcaaagtgaaacccttcacatatcatacaagattctctcagctgcaaggaatagaaaatttccatttcaattggcttaaaaataggaaaaatattaatgttacatgcagaaagtccagagaaagaggtttcaaagttggtggctttagtatctcaatgtctcattaaatatcataggaatcctcaatgccagtttcatactcaggctttagcaagatgcctgatggatgtagtgctgaacacaatttttaaaacactttaatatccagaggaagatgagagacctttcctggaaccaatcactggaaaggggaaatacatttaaaccagtgtagcctgccctgaaagcttgaagttgggtcatcttcctctgagatacatggagaggagattttctagaaaaaaaaaaaaaaatcaaagttctatcaagacagaaaaaaggaaataaatgctgggtaagaacagacattgttgtcttagatgtgttttcttggcttgaactggagacagtttagtcttgattgatgaactgcaagcacaatatgtggttggcactactaaaatgaggttaggtggtttggtatgaagtggtgctgaatccttttatggaaatttttaaagagtgaaaatcagctaactgatgaagactggatcaaaaacatttggatgaacattattatagccttgaatattatagccattgaattcctttgaatatttcttggcaaggacttcaaaagaatttacaccaacatatgctttgatttgcacattcctagtgagactgtgactcagaaatttatttggcagagcacacactggtctttctggagttgaagttcattttcaaaatgaaagcaatggtctcagccaagttctacaattttgagattaagatccaattttcaaaacaaggatttctttgattttaaatttcatgaaaataaattaccatttcccagttcattttctcttaaaaatttgacagcgtgaatgaaaaactgcaagtggatgctgttaaattataagactacctaatactgcaactaaatggggcaatattagaaatcagaattctacaaatatcttagctgcttccctaaacatacaaaccagtcagcaagattttatccgtgttcatgagtacctgtatttgtgtactactgtattcaactaagaaactgcttaaaaacaaacattgctctaagttaaaggatcaaaactaaaataatttctgattttcatattttggtgcaatagaaatatgttagatttcagattgcaaatcaaagtagtaacatgtcggtaaggaaaaattaaagaatatttaagaattaaatatttatatatttaaaattacaatgtctaatgttacttatgctttcttttgctaaatgtttacactgagattatatttatggtagctggaatttttttccatatgctctgatttttgcaattgaattatctgcctgtagatattttccttgtgtctctgttttagatctaaatgagttattttgtcttaaaaccagccaaaaactgtatgtaggactgtcaaatgattctgccttgatcttttgaggattggctttttaatcccaggactgtgttgaggctacttctttagtgatttacagttatattttgtgatggaactactttcatttagttctatttattaccggatttgatagttaattttgtcagttgtctgagccacaagatgtgcagatactcagttagatgttattctaggtgtgtttctgagggtgtttctggatgaaattaacatttaaattggtagactgagtaaagcaggttgccctcccttatgtgaatgagctccatccaatccattcaatcccttgaagacccgaacagaaaaaaaaaaaaaaaaaaacaaaaaaacctgagtaagaaggaattttctccggcctgagtgtcttgagctggaacgtcagttttttcctgcctttggactcaaacagaaacatctgctcttcctggttctcaggtctatcagcttttgaactggaacctaccattggccctccgcagtgtctagcttgctgactgtagatcttgtgatttgtcagccttcataatcatatcagctaattcctcctaataaatctctttctatacatccccccaacacatacacacacatcctattgtttgtgtttctgtggaaaaccttgatgaatacatacactggaaaccagatttattatccccttgctttcagcaaaaattacattaggtagatgattgctttcatgcttattctcttgacttcaactgggcccaacatttctgaatagtctattaaagcattacttctcaaatttggggatcattgttaaaatgcagttctggtatagtaaatctgcatttctagcaagctgtcagctgataccaatgctgctcaatagtaaggtgtctgagaattgtgttttcacaaacaattcacttacccctaaactttgacaatatattgaagatcattttctggagcctttgtctacagaattgcctcttgacatctcaacacaaaagttaccttaaatgagactgtatctttcagaaccatctattgccatctaatgatagtttagaaggcagtgaagacttattaggaaggcataccatactcatggaataactgtatcatactttcaaagaaaattatcaaaactgatttctagcagtttccacagatatttatgacttctccaattcaattaagttaaatattttaacattttcatttgctcccctcactttatattcatttaccacatgtggcataatgaaataaacataggctttggagtgagacacaacttctttcaaagttgtgatttcaaagatttcaaagtaatctaaattctttggacttcaatttaattatctatcaactgaaatacactcctcattaccaagtgagtcttctttttatttgaagctcctattaaaagtataaatctacaaagcagaggcaagaggttgtagaaaactttagttgtttttatttcatcatggaattaccaaatccatggaaataaggaaatgtcttagacccaacctgacttagagaagatgtcctaacaagtactcttttactacagtataattccttaattcttctttcactcattacttcaccctctcaaacaacattataaccacctaaatctacatgaggggaacatatgggaggaagaagaaatggttccttctgaaacctttccagaagattgttgctatttatgtttttttctggggacttctgttgtatctgattcctgttggaatcacaacactttataattttcagcatctgctcacaatgtttgaaaaattatggcttgttagatatcctgatgccttaagtcatatctcagaaatctatttcagtactattcctcactataattaatattgtttaaaacaatagagatgtctttgaaatttaaaaatataagaaatatttttaaagaagaataaattaaggaaacagatatttatacaaagacacagtgtgtttttctgtctagctaacaaattctaactgtatgtataatttttgttttatacatatataatctttgctataaaaatgtacaattgcttgtagatctgtggtattatttctgagggctctgttctgttccattggtctatatctccgttttgataccagtaccatgctgttttggttactgtagccttctagtatagtttgaagtcaggtagcgtgatgcctccagcttttttcttttggcttaggattgacttggcgatgcgggctctttttttgttccatatgaactttaaagtagttttttccaattctgtgaagaaagtcattggtagcttgatgggtatggcattgaatctataaattaccttgggcagtatggccattttcacgatattgattcttcctatccatgagcatggaatgttcttccatttgtttgtgtcctcttttatttcgttgagcagtggtttgcagttctccttgaagaggtccttcacatcccttgtaagttggattcctaggtattttattcttattgaagcaattgtgaatgatctttgacaaacctgacaaaaacaagaaatggggaaagaattccctatttaataaatggtgctgggaaaactggctagccatatgtagaaagctgaaactggatcccttctttacactttatacaaaaattaattcaagatggattaaagacttacatgttagacctaaaaccataaaaaccctagaagaaaacctaggcaataccattcaggacataggtatggccaaggacttcatgtctaaaacacaaaaagcaatggcaacaaaagacaaaattgacaaacgggatctaattaaactaaagagcttctgcacagcaaaagaaactgtcatcacagtcaacaggcaacctacagaacaggagaaaatttttgcaatctactcatctgacaaagggctaatatccagaatctacaatgaactcaaacaaatttacaagaaaaaagcaaacaaacccatcaacaagtgggcgaaggatatgaacagacacttccaaaagaagacatttatgcagccaacagacacatgaaaaaatgctcatcatcactggccatcagagaaaggcaaatcaaaaccacaatgagataccatctcacaccagtgagaatggtgatcattaaaaagtcaggaaacaacaggtgctggagaggatgtggagaaacaggaacacttttacactgctgaaggaactgtaaactagttcaaccattgtggaagacagtgtggcgattcttcaaggatctagaaccagaaataccatttgacccagacatcccattactgggtatatacccaaaggattataaatcatgctgctgtaatggcacatgcacacatatgtttattgcagcactattcacaatagcaaagacttggaaccaacccatatgtccatcaatgatagactggattaagaaaatgaggcacatatacaccatggaatactatgcagccataaaaaaggatgagttcatgtcctttgtagggacatggatgaagctggaaaccatcattctcagcaaactattgcagggacagaaaaccaaacaccgcatgttctcactcataggtgggaattggacaatgagaacacttggacataggaaggggaacatcacacaccggggtttgtcgtggggtggggggagtggggagggatagcattaggggatatacctaatgtaaatgatgagttaatgggtgcagcacaccaacatggcacatgtatacatatgtaacaaacctgcacgttgtgcacatgtaccctagaacttgaagtataataaaaaaaaataagaaaatgtacaattgcttctgtctgagtattctagaaagtagagctggagataaagataacattggcaataactggggggttgaggtggggcaaatacaaagcctaaggtattaagagcaagggaaaatgggaatgaggtaaaagatataatgtgatactgatggcaggtcacaagccagatttgtttacttggtctatagggcttctatggaagaaatacaaaaggaattatacttagagtaatctatagaaagtattatttaaaggcaatttgtctctttaattccttcctctttcccaattcccattggtcaagatttaccacaagagaggctaagtgttctctggattgcatcattcggccctctatcaaccattcaagagacaaagacccataccctgctgtgtgatgtttaatataagtctgaaaacagcagggtccaggtggaacactgatgaaacagagaaaaaaggaaactttcttttctcctgcagcaggaggctgcaggaaacctactacgaactttacattcgaatatccaggtactatagattcggttttgcatagcaatgtgtatagcagtctagtaacttatccagggttttacttaaaatcaggtttttaaataataaatcttaatgccatttgcttaccagtcttaatattttcattacaacaaatgcattgataaagtatctacatgatttcaaggggtaattttacttaaaatgtgttctgcagagaagtatggaaatctacttttggtttgcaatgtatggcaaataaaagtagttttaaaatcctttacataagaatgatgaaagtcctttcaagtatggagtttattatctggcaggtagatatttgtggaggtttatacatcagcataggtaatgtggtaatgtagaacacaaaagctaaccttgaggttttgtttctggggtttgtttatttgtttgtttgttttttaagaaaatgatcaaacagaatggcagataggaccacattaacgaagctttcaacctatctaaagtctatgtcattttaatatttataaaacatctggctgaatatattttggatactattcggattcttgatgaactagcctcagaatttaataggcatgtgtgtttgtgttttcaaaaaaaaggtttagattgaaggactggattgtcactgtatttcagatagtgatcacagtccacaagacagctctgaaaaataaaataaatgatgtaatgcagtgagacagacaatcagtatctattatgtgattaaggaatgaaactgttttcaagaacaaatcagaactttttgaaaaatgtattagagatacaaacttttatgaaataaaatatatagaattagaaccgctgatagtactgtcacataccagctgggagaatatttctgccaactttggaatatgctcaaaaataaatagctctaactttagaaaaagaaatttcaggccgggcatggtggctcatgcctgtaatcccagcactttgggaggccgaagcggatggatcacgaggtcacgagatcgagaccagcctgaccaacatggtgaaaccccatctctactaaaaatacaaaaaattagctgggcgtggtggcacgcgcctgtattcccacctactcgggaggctgaggcaggagaattgcttgaacctgggaagtggaggttgtagtgggccgagatcgcgccactcactccagcctggtgacggagagagactccgtctcaaaaaaaaaagaaaaaaaaagaaaaagaaatttcaaacatttgaatttagtgttcatcctgggtagagcaaatatatgagctttattctaccaaggagtttagaaaattaatcacatgatctgcttctaacagaatggcagatttggttgaggaaactcacaacagaatgtacttttaaggaagaggaaaactctgaaatgtaaaggaactggtgagaaataaaatagaaaatgtatgtgaacctaaataaacatcatataaatgcagacaaaagaactaaaattcaaaacaacaatggcatgtatgctaggtggggcatgattagagttaacagagaaagaagaaggattgtcttaagagtcatgtattattctgaaaaaaggttaataaattgttcaatattataattttttcataaagttaaaggataaagataaaagaagtatacgatgtacatttctaaaacagtaaagagaaaagtaaaaacagtaatatgaataataggacaaataggaaaaaaaataacataagtgataaggtttggctgtgtctccacccaaatctcatcttgaattgtactcccataattcccatgtgttgtgggagggatcttgacatatttgactccatgtttaacaatgctgtgaacttagaagaattgttaaaggaagcctagcaagtaggtcaaatgtgtgtgtaggtgaaagtgtgatagtgacctcaggtattaagacagcagcttgaaaattgcaagaacctaaagatgaagtaggtaaatggatcatgagaagggacttttaaaagaatgaggaagagcctttttggtttgtacttttcccactaaaacatcaggaagagaaggtacaaaatgatgactacggttaatgacaatgtattgtattcttgaaaaatgctaggagagtggatgttaattgttctcaccacaaaactgataactaaatgaggtaatgcacgatattagctagatttaattattccacaatgtacatatactccaaaacatcacgttatacatgataaatacatataattttatctgttgatttaaaaattacattaaaaagaagttagagaagtaaagaaagatgggcctacttaacaccatttgtcaggatggatccaaagtgaaggaggagaaaccagttgctcccactgtcaaagaagctgttatgcataggaaccaaaaggaattaaatgtgacttcctgtgtcaaagaaaacatttatgatcatggggcaatcagtgcagaactcacattgacaagacctgtatgatcaggcagcttttcatatgaaaaatatgccataaaaatcaacgactgtccctagatactaagagcttctttcttaatttaaaatttagaatttagttattttacttgtccagcaagtgttctatagcagcttttattttgacttcgtagcatgcataactgagtaattttggcaaatactatttaatttaaagacatagaaaatgatacatttttctaaaagctagcaatactactgtcttcattgtgtacttgggaggcagctgttcctgccagttatagtcttgtctcaggaaacagtgattgatacattggaaaatagctttgacaacagcctagagtaaagcatgtgaaattgaattgcctctgtaattttcctttgttgttcatttattatgtgttttccaggagatggtagggtagaaaaacgactattagccaatgattaataaaaattaaaatttagtctattttaaagcgtcagaattaaagtatcctcagggtttaagttaatgtaaaaatgaccaaacatattgagccttaatacaaaaataaaataagcaatgtaaatatttatttttatttttgagacagtgtctcgctttgtcacccaggctagagtgcagtggtgcaatctctgctcactgcaacctctgcctcccaggttcaagcgattctcatgcttcagcctcctgagtagctggaattacaggtgcacaccaccacattcagctatttttgtatttttagtagaaatggggtttcaccatgttagccaagctggtctcgaactcctgacctcatgtgatccacctgcctcggcctcccacaatgctgagattacaggcaagtgtcactgcgtccggaaaacaataaaaatatttgtatttctctcaaaccacatatatctgaagcacaagtatatttgtaaaaatatgtttctagttcacaagaaaacaaacttaagtatcaaatttagtatattttgacttgatgtgcaatgttataaatgaaaagaaaaaaatcatgtaaaaatactcatgagttttaggaaggcttttctcattttagttaaatgttattagcttgaaaatactagaaaagtaaaagctttctttattttttagccagtcattcattttaatcaaggcaaacatataaaacatcataagtgaaacctcataatgagaaggaacatcagaagtcatcagagcagctactctcttttggggaggcaactgtattagtttcctagaggtgccataacaaattatcacaaactaggtggcttaacacaacagaaaattactctttcacaatcctggaggctagaagtacaaaatcaagttgtcagtggggccacacaccctctgaagcctccagagaagaattcttccttgtctcttcctagcttctgtggttgccaacaacccttggcattccttggcttatgactacatcactcttaattgctgcctctgtcttcacatgctcttctttgtgtgtgtctctgtgtcttttcgtggcatacttataaggacaccagacattggatttaggatcctacttcaatatgacctcatcttaattacaaggtcaaagaccctatttccaaaatagggccatcctctgaggttctgtgtggacatgaacttttggaggatattatttaacccagtacagaaacttgagctgttgtagtttatttattcacttaaaactctatatgtatctcttagttatggcaagtgccatactgagcacaataatatgtaaaatcctatatgactctgccatcatgaagattgtagtcattcagaatttttttctgaaatgcagttacaaggtggtatgatagaaaaagcactggttggctaggcacggtggctcacacatgtaatcccagcactttgggaggccgaggcgggtagatcacgaggtcaggagttcaaggccagcctcaccaacatggtgaaaccccgtctctactaaaaatacaaaaattagacgggcatggtggtgggcgcctgtaatctcagctactcaggaggctgaggcaggagaattgcttaaactggggaggcagaggttgcagtgagccgagatcgcgccattgcactccagcctgggcgacagagggagactctatctcaaaaaaaaaaataaatcaaacaataaaaaaagaaaagaaaaaaaaaagaaaaagcactggtttggcagttggaatgcctaatttatagatcagacccaatactgatgagttctgggatatgaggtaggccaaataactgctttgtaatttataagatgttatggatgaaaaatgtggccccaaactacagccatttctaacctatatgcatttgtacccagattttgctgtttgcccttttagagtccatggtacccaggtatcttttggagtcctcaaagcaatatatcaattttgctccatgcccactttctatgaaactgcctgttcagtcctatctttcctctcatcactccttggagtcagcattactcagatgatgggctaccactctttacagacagccattgcccccctgctgtgtcccatctcacctgtggctccatgggcatggtatactttactgctgacctctcaaagcaatgtggtagcctgtaccggagttgagaatagctttctctccttcgagacatattctattaaagagatctgaaagccacatctctttttcccacattgtgttttatagaaaaggcttttgtttttactcactaactatttatgccccctaggtacaagacaagtgtccagggaactgaggttggcagattcatttaataaatatcattctttatttggactgccagttcctgagtaatctgctgtggtggtttttatcatggcaaatcagccaagctaaaactacttttcccagaattcccttccacccatggttctggatgtgggttggccacagggaaagttgtgagagttatagagaggagagaatcagcagacattagctcctaaggtcgttgtaaggtaccaggtgccaccataattagcacccgttgccactgatctgctggcttatctcattgggatggggtggcaatttagcctcactagcttcactctagtcccttgcatgacttggcctcactagttttattctaatccatgtcagatattgttttgtttaaaattttaatattttactcaccataaatttttggataaattttgacttgatgtattacattaaatattatttatcttgattactaagttatttggcactccataaatttttgcatcagcgactattgtctaaaggactagtgtttcactcatttctcagccttgtatccagctcctgctggatctcttctggcttctctaaattctggaacagatgtgcagcactgggacaaagaggaccagtttcttcagaaggtctcccacatgattgaggttggaggtgatgagagacagatgtgggttaaatattaaccttgcaattcctgtttgatatgatgggtttcatgttctagtctgtcctcgcttccctacttctcactgtgcctttcgttccaattgggccctgcgggcttaacagtgccttcaggcctacaatcagaagcagaagcaacagcttttcctaggcttctttgccagatcccaccattgtgtcaagtctgatccctagtgtaaactccacattccatgtcttcatagaggttccacttcccagcttgagacttagttaatgcatcctctgagtgcctggtccctctttcttcagatttttttttcccttggaggttctttagtagtccccgaagatagaagtttttttggtcccaccctgcaaacttgccagaatgtacagaagtgtttgaacttcagcagcaagtaacgcttgacttctttgccagcagaattctgtttcattttacataaggatctggcagattatctctggctgttcaccagatgtgaccagacatatctggttttccctttctctaactgtacctcagactacctaatattttatgacccctagaaatatgtttccaattaatataaaacctaggatacggcctccaaagctactccagttagtataaaacctaggatatgggctccaaagctacaggcattcttttctctgggtgaaagatctctggtattcctcaaaagtacgtgattttctagacgtaccatctgtatcagtttcctggggctgctataacaaggtgctgcaaactaggtggcttaaaacaacagaaatttattgtctcataattctaggggctacaggtccgaagtcaaggtgttggcagggtcatcttccctctgaaatttgtagaaaaatcattctttgccttttcctagcttcttgtggttttctggcaatcttaggcattccttggtttgcagctgcataattccaatctcagccttcaccctcacatgacatttttcctctgtgtgtgtgtgtgtgtgtgtgtgtgcatgtgtgtctgtacatgtgtatgtgtgtctatgtctatatgaacatcttataagatcaccagtcatattggattattggattaggtgcccaccctactctccaatttgacctcatttatgttaactaattacatctcccataatcctgtttcaaaatcaggtcatattctgagacattaggggtcagaactttatcataaccattttattggaggggcacacttcaaccataacaccgccattgttagcctccttactaatgtctttaccttaccaatgtcttataaatgtggtggtaagtattaaacaaaataatctaaatcagatttgattacaacagaatatagtgagattactactttcttctgctactcacttccttacttcgcttatccaacaaatgtttattgagtttctattctatgattaacattctgcttgtactaggaatacactaaagtggaaaagagacaaggtcactatctttatggagcttacattctaataaggagatggaaacaataagcacatacttttgttagaatttcgattagactggattaagaaaatgtggcacaccatggaatactatgcagccataaaaaaggatgagttcatgtcctttgtagggacatggatgaagctggaaaccgtcattctcagcaaactactgcaaggacaaaaaaaccaaactctgcatgttctcactcataggtgggaattgaacaatgagaacacatggacacaggaaggggaacatcacacaccaggccgtgttgtggggtggggggagcggggagggatagcattaggagatatacctaatgtaaatgacgagttaatgggtgcagcacaccaacatggcacatgtatacatatgtaacaaacctgcacattgtgcacatgtaccctaaaacttaaagtacaataaataaaatgaaattaaaaaagaatttcgattatctcaagtgctatgaagaaaaatagaccaggataattgaaggaaagtgatgggtgttatcagaaaaaggattatctttgagagattaaagaaatgggcttggaggtgggagtatttatggggagtttaaggtacagaaagaaggccagggtggctgcaaggcatgaatgaacagtgacatggaaagcaaacaaagaggcaatcatgccccaggaggcagagttgtggatgttatcctgggcgtgaatttagtcaaaggcttttgagcatccgagtcatgtggtataacatattttggctgctgtattgagaaatgagtgttgtagaacaatagagaagctgaaacacctatttaggtgccatttacagtagcaaaggtgagagataaatggtaatatggaccaacgtgatagccagagttgtgatgatggtcagatttaggatgcagatttgggacagaggccttcatgatttgctgatggattggagtaagagagaaaaaaatatgaactgtaagatgctctagtacttagaagtttagaagtagaaagagaactccataaaggatattgagaggaagtggtctgtgatgcaggagaaaaacagagagcaaaagagagagagagatccaaatgccaaagaaagtatttcagaagaagggagtaatcaaatgggcaaatactactgataggtcaagtaagataaggacagaaaactgacagaggttgttggtgaggtggcattgaatggtctcagtggaatttcaagagaaaatgagttgaggtaaaattgtgaattaagacaattcttatcacactcactattccaagccacatattattgaaacacataccccccattttatttctagaagttaactcctttcaaactgtttcaccagctgtttctgaggctttccagatggttaatggtcatgttcccagaggcaatttcctaaatatttggacattcagcctctttattggttctctgctaactagttataaatattagttttaataaaactagctgaaatacaatatttttcaaaatttatgtgagtttgaataacacctcgaaaatgagattggattccatttttattttcctttgttttttcaagattacttcacaaattggtgtcatgtgcttccttccaaaagtatacgctatttggtcatttctttgttcacaatgctagtaaaaatatgttgactttgagttccaattacattttattttcatggctgtatatatattcgaaaattttgtttcagtgctgaatttcattttcactcctgttaaattttgttttatagttcaggtttgtcattctagtcagttaaagctttgggtatatcaataagccacacttctctattttgtcccaaattctcaggagaaatttttacaaattctttggtaaattaagatgaagtgtttcaaaaatttcccctgatttagataccctagccacagtgagtacatggtggtgttcagtgataatgcattattttaaaacagttttagagccagtctgtttaatagttctagagttcttttagggatcagcaaccaacatgttagcaagctaacacttttttaagtggtttcatgaaacatcagatgtgttagttgctgatctttgaaagaactccacttttttaaagtggtttcatgaaagttttgaacagatgtctggaacttctttatctttatataaattcaaaaagtagctaatgatttgtgattacatctgcaaatctttccaccactctgaaatatgattttggtggaagttcacttctctgtgacttcacatcatctgagctataacttcctctttataatgtattctggagcatttccagttttaatatgattctttttatagacaaaagaaggaaacaaaacaggaactgagtggtacttttccctgtccacgcacttaaattttaatgtagggaattttcttagatatgcattcgtttatggtccgctttgctcaccacatccctcccttccccttcacccaagataagtgtcctgagtataggaaatttgcttcatcccttgctgttttcttagaatctggttcagtttcagccaccagtaggagctcaaaaaaatacgtgttggaggaatagctttttgtagcctttttgtggtgcttttaaaatttttattttagctttatgtatatcaatctatctaatcgtagagaaatttgacaataatatctcctatttcctctttgttgagaagaaaccttgaaactttgtactgtcatttctaatagttccatttcaaaacgtttacatgtgaattttctctgtcttagttgatatattttgattttaataattatgtacatgtgatcataaaaattaattcataagaacaatttttagatgttaaacatttaatagtttaatcctcagttttacttaatatttcaagagggctttataaagcacatacttaagtaccattgcagaaaagaagtttagctgttcatcatgaaaaatatttaatcaattctaatagaataataaaaacatttttatttcagatttctaaaatttcaggagaaactggtgtttccaatatctctcaacccctttcaaattctgtgtttataaaactctgtgtttataatctataataaatatatcaaccactttcaaaggggttgatatattacctataaattatttgtatattttttattatattatttatatcttatgatataatatataattatttgtattatttatattatttatataatttatatattatgatataaccaactcctttgaaagggatcatatctatcaacccctttcaaactctgtgttaataaaattgtgtttataatctataataaatatatcttgcatcaagacaatatgcatacatgtatgtgactgtatcatatatagagagatatatatctcatatgtagagatatatatgaagcttttgcttatatatgaagcttttatatatagatacatatgtgaaagctatatctgtatatgaagctttcgtttctatatctatatacattttttgtttatatagagtgatatatatatacctctatagatatccttattagatgagatacatattctattttatactattttattctattgatctaattcattaaaagataaaaagtgatcattataggccatcaaacaacacaaatattgataattttcttagaacagtctctacttaagaaatcaccattgtaagagttcaattcagtttagcagttactgattatgcctgaccaatgtatccagtgctgggttagacatcgatgagtttacaaaaattggacgaaatgcggttttagcacttggtacataccatcagctttattttcctccttcttgtcatcatggtttggtacataaagtccctagaatctaactctaacttcattattcccattgatatcttctgacacttcacaattatagaactctgcaccttattatcagatattctgacacctctgagatgtgtaccagtgttctttcatacaaaaatatccttacctctttttgtataactagtatgttacagatattgaaaataagttatctgggagcctaatctacttgtagtattttcttggcctcattgatcactgcctttaaggagattactttattttatatcatggattcccaaatgttgtcgcgccataaagttttcacaagaatgcaatgaaatgaaaaataaggacgatataataagttttggatagaggtaaattcatccaatttaaggaaaagttccttacattgaggatatttttattatcttgttagatttttaaattattaatttaaaaaatctggtaagtggtataaagtgtatttttctcaacttttgttttggattcagagagtgcatgtgcaagtctgttacatgggtatattgagtgatgctgaaatttggggttcaggtgatcccatcacacaggtaattagcatagtacccaataggtactttttcagcccatgctcccctccctcttctctctagtagtttccaaggtctatagctcccatccttacatttgtgtgtacttaattttcagctgccatctataagtgagaatatgtggtatttggttttttgttcctgtgttagtttatttacttaggataatggcctccagctccatccatgtggctaaaaagaacatgattctgtttcatctttatggctgcatagtgttccgtgttgcatatgtttcacattttctttatccaatccatcattgatgggcacctaggttgatttcatatctttgctattgtgaattgcactgcgatgaacacatgagtacatatgtctttttggtagaatgatttatattcctttgggtctatacaaagcaatgggattgctgagctgaaaggtagttctgttttaagttccttgaaaaatctccaactgctttccacagtgactgaactaattttcattcccaccaacagcgtataagcattctcttttctctgcagccttgccagcatctgttatttttcaactttttaatgatcaccattctgaccagcatgaaatggtatgttattgtggtttcgattttcatttctctgaggattagtgatgatgagcattttttcatatgtttattggccactgtgtatcatataaagtgtctttaataagctaaaacaaaccaaaaagcattttttaaaacaaacaataaagatcagtcaccttaaattcactttacatttagagggtgggatggctgtggatatgattgctccatttatatagagtaacataaaaatcctgaaatgtcaaagtttacctttctgtcaaaagtccccagtctcccatctttgacataaggttatctccaatatgggctatatgtgcttacttttctcactaagatttagtttcaatctaacctagaaccctaatatgtagagggtctttggccaaagttctctgaggattgtcattttgagttttaattctgatattaattcatttcagatgcttatttcatcacctcttctcagacaactttttgtgagccagatattcagtagttagctgatttggaagtattttcaatgatttagacattttattcaaaggaaacttgagtggcactggacaaacccaacagtgtttttcccatttcatccatttctttacatgtggaaacaggaataagaatagtgtttatctaagtcctatccttgttgtacagattttattttctttacttatactcagacagctaaaatgtgcttatttttatgttatttatttatttattcatttatttatgtattgggtagcatttgggtctcaccattagccctggctggtcctgaaatcctgggctcaagtgatgctcacacctcagcctccaatagtgttgggattacaagcatgagccacgacacctggcctctctatttatttttataatcactatcttagaattgatatattattactgattttaaaatacaagtatctctaagttgaattaatatggaggaaaaaaccctacaaggatgcacaagaaacttcaaagccagtgattgtgaggaagaggagtgggaaccagcagatggagaacaaagatgagagggataccttttgctgtatacttttatgtgcagtttttgctttaagaacagtgtgagattattacattttcaaaagtaaaaagaggcaaggcacagtggctcacgcctgtaatcccagcaattttggtggctgaggcgggcagatcacttgaggccaggagttcgagaccatcctggccaacatgatgaaaacccatctctactaaaaatacaaaaaattagctgggtgtggtggtatgatcctgtaatcccagctacctgggaggctgaggcaggagaatcgcttgaacccgagaggtggaggttgcagtgaaccaagattgtgccactgcactccaacctgggtgacagaatgagactccctctcaaaaacaaaaaaagaaaagaaaaacagaagtaaaaatttagaacaaactgataaatgtaatagtttaaaatatccttgtctaagctcttaaaatgtcataataaaagaattagattggtaatactgaggaatttagagtccaaagagttgatataagttaacattggaggtgtaatcagaccagagttctgacccaaataataataaacattaactccgaagaagtggccactcctggaaaagacctctaacaaagctgtgccagcagacacagcaataggcaacaaagctaaagccaaagctcaggttctggccggagccactctagaggtggtttagatccacttagtaaaccagagcagacccccaagaaactatccaagagtcagcagtcatggccatgcatccagctcgcagaaccaattgtttctaagattgatttataacatttaaaggggtttggatcacaatcccaaaagagacagttccgtccataatcctgaatgttgaaatcccggaaagatcaaaatccctaatgtctaaaattccaaaaatcacaattccaaaggttaaaataccaaatgttgaaatccttaaagctgaattctggggaagggattagtgtgtttttgattgtatacagtaaagttgcatcttattaggcaaaactattaccttgttatcatctttattttggaaattaagtacggtttaaagagatgcatctggatgccaaattgacaaggggtggacttgtggagttaattctaggtgtcaatttgacaatattagggaacacctaggaaacctgtaaagcattattttgggtgtgtctttgagagtgtttgcagaggagattagtaattgagtctgaataaagtaggtgggaaagatctgcctgcagcatagtcaggcaccatccaactggccaaggacctgaacagaacaaatacaaaacgtgaacttgtctctctctgtgagctgggacagactttttttctgccaccttggacagaaatttgattccacaaaagtgcattgtcacaacattgactttgtgtgtaagccttgtgtgtatacataaaaacatagaaacttcctcaataaatgaggagatgtcttttttgtacatgtgcatttgtaaaagataaaatttcttggcttctagggtggctgcacatgtggtggtggccatcacggttttagatccatcttgtgaaaaggcttgggttgtctcttagcgtatttcagagaattgcattattgagctggttatacacaattaccaaccataatgacatacatttatatattttgctttttcacctatttctttatgaatatgaatatggtttgtctgcttataactttatgcctgtgctactgttattatacctgagtgtttgtttgcaaaaatatacactattatttacctattttaccatgtaaagtggcctgtgaagtgttctgtcatgctttcatatgtttctcaaataaatatattttagaaatgtaaataaatatctttcaaattatttttataattgtatttttgggatattgatatttcagaatttcaacaattgagattatggctttcaggactgtcttctgggattatgatcagctcccgatttaaagatttttttgatggcaggatacaaaacattgatattccaaaccagagaaagctgccaggcagggcccacagagagttgcatccaggaacagggtaatagcaagctgcagctatagggggcaacgtgcatatgtcaagggcggtgaggttagctaggttttgcaggatcccggtggatcagctaatttgaatgatttcacaaggctccagggcagagggattgtctctagttttctggtacctacagctggggcaattagggcaggtgtatagtggcccagactgtgatcacccataaaggaagttgttggagtatacacatacctgttcaagaaggggaactgacctacctctagtcaaggcctcaaaactgggtcaagaaaacattaaaaaacaaaacaaaatgaaactttattatacttgttaaaaagacacattcctaaacccctctccaaacctcctgaattgactttcttggtcatgaggcttgggaatatgcagttttaacattttctccaggtgaattgaatttacagtaagtttacagagagctcaggttgggctctggagttaacctgtctgggttagtgtctagatccaccagttgtagcccctgagcccctcacttcacttctttagttcccagatttctcactgtaaaattggatagaataatagcacctacatcctaaggtggtatgaacattaaatgaaataacatataaagtagagtgcttgccacatccaagtgcttgtgttaagcttaaaaaactttaaatttctttgaaaaactagaactaggccaggcatggtggctgacacctgtaatcccagcactttgggaggccaatgcgggtgaatcacatgaggtcaggagttcgaggccagcctggccaacatggtgaaaccttgtcgctaataaaaatacaaaaattagctgggcatggtggtgcatgcctgtagtcccagctacccaggaggctgaggcagaatcgcttggacccaggaggtggtggttgcaatgagctgagatcgtgctgatccagcctgggcaatggagctagactcagtctcaaaagaaaaactagaatgataaaaatccaatatcttaaaacatttcctttaaaaggattgtgctagttgcatgtcatttaggaaatactaatgcagaatccagtcaagtatatttctcaataatttttaattttaggagtcactaatcagggtagccatgagaaaattctttttccatctagtccatcttcatttgaaatgaatcatctttatttttttgcagcatttgtatctttctgaagtctttaaaattttgttgatagtacatgtttcatagccaaaacaataataataataatgaagcaacaaagagagaaagaaaaagaaacacttttttaaaacactttaatcttcattccatcattccttcaggagagaattgattactacttgcttgcaactttagaagcacacgaaaccttattggcatctccaagatctgttttgtcctttcacctcttagccacatgaaagcaaaattggctgtaatgtgatattagtggtctgcaagaaaatgtgaaatgtctttttttcagtttacaagaaaatcatattccattctcaaaagataacacttccatgacaattaaaagggaactaatattttaaaaaattaatttaaaaaatttttccagttttatggaatcaaatacatattgacaaaatggtatattttaaggtgtactacatgatgttttgacatcatctcccattgttagttgttgggtgtggtgagaacattaagatctactctcttaacaaaaaattaattttaaaatattaagatttatacctcttttctgtgagcaaatggtttcacaggcttctatctgttttattacttttaacttacactttgagtttactagaatgtgattgttcatacaaaaagtgagttttatacactaattttataaaactctcactgaatatgtgagaatgccacatttcttcctatctaattggttaaatgataaaggattttaaaaataagaatcaatttagccatactattaaaatcaggaaagtgtctatattcagttatcctactcattgaaattataaaaataagtaatatttgctttgttaaatcttcagtaacttcagattgttgattaaagttgaaagaaactcttaacttttaatgagaccatctttattttcttattggccacagtttataaaacttaaattttatagacactgtagttttaaaggattttttaaaatatactttaagttctgggatacatgtgcagaacatgcaggtttgttacataggtatacatgtgccatggtggtttgctgtacccatcaacccatcatctacattaggtatttctcctaatgctatccctcttcttccctctaccccttgacaggccccagtgtgtgatgttcccatgcctgcccccatatgttctcattgttcaactgccacttatgagtgagaacacgtggtatttgtttttctgttcctgtgttagtttgctgagaatgatggtttccagcttcatccatgtccctgcaaaggacatgaactcattcttttgtatagctgcatagtattccatggtgtatatgtgccacattttctttatccagtccatcattgatgggcatttgggttggttcaaagtctttgctattgtgaatagtgctgcattaaacatacctgtgcatgtgtctttatagcagaatgatttatactcctttgggtatatacctagtaatgggattgctgagtcaaatggtatttctagttctacatccttgaggaatcgcctcactgtcttccacaatggttgaattaacttacactcccaacaacagtgtaaaagcatttgtatttctccacatcctctccagcatctgttgtttcctaactttttattgatcgccattctaaatggcgtgagatggtatctcattgtgattttgatttgcatttctctaatgaccagtgatgataagcttttttaaatgtgtttgttggccacataaatgtcttcttttgagaagtgtctgttcatatccttcacccactttttgatggtgttgttttttttcttgtaaatttctttgaatttcctgtagattttgggtattagccctttttcagatggatagattgcaaacattttctcccattttgtaggttgcctgttcactctgatgatagtttcttttatggtgcagaagttctatagtttaattagataccatttgtcaattttggtttttgtttccattgattttggtgttttagtcgtgaagtctttgcccatgcctatgtcctcaatggtattgcctaggttttcttctaggtttctatggttttaggtcttacatttaaatatttaatccatcttgagttaattttttataaggtgtaaagaagaggtccagtttcagttttctgcatatggctcgccagttttcccaataccatttattaaataagaaatcctttccccatttcttgtttttgtcaggttttcaaatgtcagatgtttgtagacatgtggtgttatttctgaggcctctgttctggtccattggtctatatatctgttttggtaccagtaccatgctgctttggttctgtagccttgtagtatagtttgaagtcaggtagagcaatgcctccaactttgttctttttgcttaggattgtcttggctatagaggctcttttttggttccatatgaaatttaaagtagtttttttctagttctgtgaagaaagtcaatggcagcttgatgggaatagcattgaatctataaattactttgggcagtatggccattttcacaatattgatttttcctatccatgagcatggaatgtttttccatttgtttgtgtcctttcttatttccttgagcagtggtttgtagttctccttgaaggagtcctttacatcccttttaagttgtatgtagcagttgtgaatgggagttcactcatgatttggctctctgtttgtctgttattggtgtataggaatgcttgtgatttttggacattgattttctatcctgagactttgctgaagttgcttatcagcttaaggagtttttgggctgagacaatggggtgttctaaatatgcagtcatatcatctgcaaacagagatgatttgacttcttttcttcctatttgaattccctttatttctttctcttgcctgattgccctggtcagaacttccaatactatgctgaataggagtggtaagagaaggcatccttgtcttgtgctggttttcaaagggaatgctttcagcttttgccgattcagtatgatattggctgtgggttcgtcataaatagctcttattattttgagatacgttccatcaatacctagttttttgagtatttttggcatgaaggggtgttgaattttctcgaaggcctttgctgcatctattgagataatcacttggtttttgtcattggttctgtttatgtgatggattatgtttattgatttgcatatgttgaactaggcttgcctcccagggatgaagatgacttgattgtggtggataagctttttaatgtgctgctggattcattttgccagtattttattgagtattttcacatcactgttcatcagggatattggcctgaatttttatgttgttgttgttgtgttgtgtctctgcctggttttggtatccagatgatgcttgcctcataaaatgagttagggaggagtctctctttttctatttttggaatagtttcagaaggaatggtaccaaactcctctttgtacctctggtagaattcagctgtgaatccatctggtcctgggcttcttttggttgttagtctataaagtacttcttcaaaatacatgagttcatttctcattccttcacactggactgctctcagggatcagatttgctattaaaaataaaacaatagttgactgggcaccgtggctcatgccacccagccttttgcaaggccaaggtgggaagatcacttgagaccaggagttcgaggccagcctggacaacatagcacaaccccatctttacaaaaacctaaaaagtaagccaggcatggccgtgcatgcctgtggttttagctactcagtcagctgaggcaggaggattgcttgagcccaggaattcaaggctgcagtgagccatgatcacttcactgcactccagcctgggcaacagagtgagagtctgtctcaaaaaaaaaaatatatatatatatatatatacacatatatatacacacacacacacacacacacacacacacacatatatatatatatatccttaatgtatcccgaacaacagttcctggttttccagtaacatgttcactgtacattttatattttccatcatcccaagtgtttatcctcaattctcaccatctaatccctttaagtgtctagttatgcatgccaataatcacaataagcagaatatcaaaaatatagctaccatggattggtgtacctgctgtgtaacaaggcaacagcctgagttctgttacatagctattattttatttattccgcagaacattcccaggataaaaataacatcactttcatcttttcacatgagagaagggtgcacaattagagacattaaataaattgcccaggaccccaaaactcttaattggatgacacaaaattcaaactccagcccctttaactccaaagtccattctctcaaccatcagctaagtgccttccctctgttgagaaagcatcacactctccagtcacacacctatgacagaagtaacattctctatttgttcttactatggaaaaactctcttctttctgggctcagactgagtggacatgacttagcactctgcaatggaaatataagtcacgacgtgtgtatttttaaatgtattagtacacatttaaaaacacattaaaaataagaaacaggtgaaatttttttaaataatatattttaaccaacacaatatattgaaaatattatcatttcagcatgtcactagcccatttcatggtccaaatagccacttgtgggacaatgcaggcttaatatcttcaaattagactatccacgggatcatttatttaaatataaatactgtcttatcacagatattaaaaagtctaaattataacatttaaaataataaaaaatccattagttttcataaagaatatctaatgagtatttcctatacaatcctctaatgaagatgagaaattatctctccaagtcattgaggtacataatcaggagtggtatcttggactatgagttatgaaatctcatcatattcttctattttttaaattcttattttagattcgggggtgtgtgtgcaggtgttttacatggatatatgtgtataatgatgagttttgggcttctagtatacctatcacccaaacagtgaacattgtacccaataggttgtttttcaaaccttccattcttctcccttttagagtcctagtgtctgttgtttccaactttatgcccatctgtaccagtgtataggtcctgtttataagtgagaacattcagtatttgattttctgtttctaagttatttcacttaggataatggcctccagctccttccatattgctgaaaagaatacgatttcattcttttatatggatgcatagtatttcatgatgtacatataccacatttctttatccattcttctgttgataaacatttaagctgattccattaccttgctagcatgaatagtgctgtaatggatatgcaagtacaagtgtcttttcgatataacaattccttttactttctttcaacccagtagtggtattgctgggttgaatggcaattctattttttgtgttttgaggaagctccatactattttccatagaacttgtactaatttacattcccacaaacaatgtataagcgttacatttttttcatattcacaccaatatatgttggttttgacttcttttttaaaaaattttattattattatactttaagttttagggtacatgtgcacaacgtgcaggtttgttacatatgtatacatgtgccatattggtgtgctgcacccattaacttgtcatttggcattaggtatatctcctaattctatccctcacccctcccccgaccccacaacagtctccggtgtgtgatgttccccttcctgtgtccttaatagccattttgagtgatagaagatggtatcttattgtggttttaatttgcatttctctgatgattagtggtgttgaatatttttcatgtttgtttgccacttgtatgtcttcttttgagaaacatctgttcatgtcttttgcttactttttaattaagttatttgaccatcttcagagtaagccactgtggggcctgagcagggtagggtagtgtcattgtcattggaggtaacattgtcattactcaggtttataaaccactggcttttcaacatttgcagctcaaggcttcactgtttggttatctttagaaataactttttgtgtaattagcagagttgacattgggcatgagagtcttaaggagggagtttgttttcagaaaatattttatgtggagtaatcttacagaaacatcttatttttttttaaagtacagaaactccagatggtttcaccatctttagtttattcttttgttatgtggcacttattaaccccgtccaaaatgctggctccagtaaacctcgccaaagctttaaaagtaaaatgttttatgaaattttacatttttaaattatgcaagactgctctaatttcacaaagtgtccttaatggcatttattattatgatctattggttataactaattaaaactgaattacattaaatataattactgtatcacacttgatttctagtgtctgcttgcatattttctttattctcccatctctccccttaataatccgtaaaagtcagcaatcaacttcatgtacctttattgcttaaatttaaaaaggcatgtaggtggagccaactcattttaaaaattttaaaatggacataaaatattttccctgctttcatgtattataaatttgataccgaaggagtgaatataaaaggaaatgctttttaaaaaggaaaacacacaccttatttgtgaagattatcccattttactctttatggcactcacactttggctttggagtccctcagcttttccttacttctacttgtcccatggatttatttttgaaatttaacaaaataatgcatataaagtgcttgcacatctctgataacacaaacatgtgtcagattgatttatctccttcctcatttttcttctcctttatcataatgatcattataattacaatgaattctgcctatttgcctaagagctggttcgtgagtattccacagctagcttgcaagagccaactgttgaattttcaggaattttatgagctgattcttaaacatagccattattagaacttaaactataaacttacaattaaataaattacataaaatttaataaatactgaaaacacaatctgtaattattttagcacattttatattttctatgctcttgaggttatttgtatcctttgtctcagtgtggtagaaatactttatactgttgagctactgtacatctcttctcaactctgcattcagtgacatcatattggtggcttgaaactgcccatggtggaatatttacagtgcagaaatcatcaaattccaaaaattgaggcttttttccccattggagagtcattcgttaaaatttacctggggcagaaaatatacaaaataatcctggagcatcttgtaatgccaaaaataaggaagttctaaaaaaattaaaataaaaataacccgctttccaatgatgggggtatgtcaaagtgacacaggcaccaactaaaagagctctcaatggccaaagctggaacaatttgagcaacactataaagaatttcattggtagtgtattataacccaaattataaaatgaatattcataaatccatactaatataaacaaataaattgagatgggaaagaataagcaaatctcacgtggagaagaattccaaataaactatgcagtcactcgaaactgaaggagatgaaacagaatcccctattccttaactatgagctttctccttccaaagaaagcttactaagaagaagaaaaagaataactttagaaaaacctgacaagcactaccttagccaggtgatcaagaccagcatttacagtggtaagtcatgttgatagtattcattatgtggtataatgtgtttaaaatggccctttacttctgtggtctttctctcaaatccaataacccaaatctactcatgagaaaagctcagacaaatcccaactgagggacattttccaaaatacctaagcagtactcctcataactgtcaagatcatcaaaaacaaggaaactctgagaaactgtcacaacaaagaggcagctaagatgtcatgaccactgaatgtaaagtggtatgctagatgggaatcctggagcatgaagagaacattagctaaaaattaaggaaatccaggtaaagtatgaattttaattaataataatgtattgatattgattaattgtgacaaatgcaccaaactaatatgttattaataggggaaaccgactctgagatatatgggaacactctatattatctttaaaatttttctgtaaatctaaattattataaaattgaaagtttttttttaaaatttactaacacagaactgatcaatttccaccctagatgtcacttactgaagtcctattcaatgctcagtaactgtgggtggacatcaagctgttttgctggtattgcactggtcctgggcctgtcccctaaacatctccatgctaggatgggggtgaaggtaggaaacttgatgaacaaataaaaaattgttaataatttatgttaaaaattatatatcgacatcacatagcttgcattcttgtcaaatcattattaatctgtaatatataaccacaggatggcaaataagaaacaagagtttttaattaatctatttcttcattcatcaaagacaggttaaaattccctggctgtgacctgctttttatccagtatagcaagaacagagttctaaactctgttcccagggatggaaaactcaaaaccttcagggttaggccagcaaatgagtggattgcctgagtgaaaaacagtaagagatggtgggtggattgcctgggtcagagagagtagacatgatggagattttcatcaaactggagagcacaagcttgacctaaagcagttagtgttaagtatttgttaaactgctattgcagcccaagaaaaagttaccggtttggcaggaacttctgttctaaattgtcaattaaatcccaaagaaatttctttgacagacttgagtgaaattgaggtgtttcattcagcttatagttcgtctcgagatgtagacgctcagaaattttaatacatattaatgaattacttcaatttattttatttttaaactggataaattcttattttttatttttaaattaaagaaattcactaatattgataagtaatatatgtttttacaccaaataactggtaaaaaggaaacaggctgctttctgtgtttttgttgaggtctgtctgtaaataatatacttttaaaaatcaataaaatttaggatatttttagcttcatattattggaaaatcaatcatattattgtttgttctaatcctgagctcctttgagattaggttttcaaataatatattaatatgagagttcttttatcagtaagtttaaaaatagtaaggaattttactatctccttaaaacccaagcacacatctagtgattttttcacacagaaatgctgttattaaaattagtcaagggcaatgggtaagttcaatataagccattattagagaggactacagttatgacttctaatgatagtttactacaaaaatattcatagaataagaaaattaattggctagattcctttgagctaaagcaatattttctgttacaggagctgcagaggatatacagaaagaataatttaagtctcatgcaaaaataaattcctcttaatgcttatattgaattaaattctttgtttaagggagtactaaagctaaagtatcgttctttcctagcctcaagataatttttaaatttctcagcaatttaacatagccataaaatgcactaaaaatcagtgaccttgttgctaaattcagtagatatggttcagttctttttttactttgctcacagtagttgttgatggtattgttcattttccttcttaaaaatgcctaaatccacagctcttacttgcttcctacctctcttgtttctctcaccaataaattttttatttgatgcacaaagcttgaacatattcctgaggtacatgtgacattttgattcctgcataaaatatataatgaccaaatcagagtaattggaatattcatcacctcaaacatttattatttccttgtgttgtggaacattccaaatcttctctcccagttactttgaaatatacaataaatttttgttaactatagtcaccctactgtgactagaactcattccttctatctaactatatttttgtgcctattaaccaatttgatttcatctctccctcccctctattattcccagctgagaataccattctactctgagaaacaccattctactctctacctccatgaatccactttggctaccacaagaacatgagatatttgtctttcagtgtctggcttatttgacttagcacaatgtcctccacttccatctgtgttgttgcaaatgacaggatttcattattttttatggctgaataatattccattgtatagacataccacattttctttatcaattcacccattaatgaacacttgggttggttccatatcttggctattgtaaatagtgctgtagtaaacatgagatagctcttcaatatactgatttcctttatttatgtttttggatatacaccctgtggtaggattgctggaccgtatggtagttctttgtttttcttttttttttttttttggagatggagtcttgctgtgttgcccagactagagtacagtggcacaatctgggctcactgtaacttccacctcccgggttcaagcaattatctggcctcagcctcttgagtagctgggactacaggcacccactaccacgcctggctaatttttgtatttcttgtagagacagggtttcaccatattggccaggctggtctcgaactcctgaccttatgatccacctgatgcaccctcccaaagtgctggcattactggagtaagccaccgtgcccagccagtagttctatttttagttttttgaggaacctccatattatcttccacagtgtctgcactaatttacattcccatgagcagggtacaaatgttcagctttctgggaatcttcactagtgtctttaatttttttatctttatgataacagacattttaactggtataaaatgatatctcactgtggttttgatttgatttcccttgcaattagtgatgttgagcattatttcatatacttggccatttgtatgtcttcttttgaggaaggtctattcagatcctttgcccaatttttcttccattctataggttatctcttcattttgttgagtgttgtctttgctatgcagaagctttataattttattagtctcatttgtctattttttcttttcgttgcctatgcttttgaagtcttaggcataaaatctttgtctagacaaatgtcctaaatcattttccctgcattttcttctagcagtttttaaagttttgggtcttacacttaagtctttaacccattttgagttgacttttatatatggtgagagacagaaatttagctttattcttctgcatatggaaatccagctttcccagcatcagttactgaagagattgtcctttccccagtctatgttcttggcacctttgttgaaaatgaattggctataaatgtgtgggcttgttcctgggttctcaattctgttccattggtctatgtgtttgtttttatgccagtactatgctgtattgattactattactatactatacatttgtagtataatttgaaatcaggtaatatgcttccacctttgttctttttgttcaatactgctttggctatttggggttatgtgattccatgtgaattttagaattgttttttgtattcctgtgaagaatgtcattaatactttgatagtgattacattggatctgtagtccactttgggtagtatgaacattttaacaatattaatttttccaacccatgagcatgggatatcttttcatttgtgtgcgtgtgtgtgttctcttcaagttccttaattagtgttttataattttcattgtagacctttttcacttctttggttaagtttattcctgggtattttggggtagctatcataaaatggaattgcttccttaatttctttttaagatggtttgctgtttgtgtatagaaatgctactgatttttgtatgttgaatttgtattctgtaacttagctgaattaatatgtcaggtatagcagggtttttttgatggagtctttagttttttctaaatataaaatcatgttgtctgcaaaaaagtataaattgacttctgcctttccagtagtgatgcctattattactttctcttgcctaattgatctggctaggacttccagttgatcaggagtggtgaaagtgggcattgtgtcctattccagatcttagaagatagccttttaatttttttcccagtcagtatattagttttgagttttttatacatggcccttagcattttgagctttgttccttctctatccatctgattgagaatttttatcatgaaggaatgttgagcttaaatgaatgcttttttttacacctattaaaatgatcatatgatttttttcttgattttattgacatgatgcatcatgtttattgattcatacgtgttgaaacaaccttgtgtctctgggatgaatctctattaatcatggtgaatgatctttttattgtgtttttgaatttggtttgcaagtgttttgttaaggacatccaggttatttggtagggccttacaaaggcatgaaatatggcttacaaagccagcaatatggacacttaggcattattacctattgctggatttttaaatactatatcatggttgaaaacgattatatttctaaacatattctcacagaattagaacatgatatcagtggacaagagggaagaattaaccataattaaataaagcagattttctaagcttgaagatactatgtttccaattaaatttggggaatacatttgtcctacattcatatgcataaaatttttctatttttcaaaatgaaatgtagtgtaatttgttgaaattaggccaggtgcagtggctcacgcccataatcctagcactttgggaggccaaggagggtggatcacctgaggtcaggggttcaagaccagcctggccaacatggcaaaaccccgtctctactaaaaatacagaaattagctgggcatgatgacatgtgcttataatcccagctactcaggaggctgaggcaggagaatcgcttgaagtcaggaggcagaggttgcagtgaggcgagatcacaccattgcactccagcttgggtgacagagtaagactctgtctcaataaataaataaataaataaataaataaataaataaataaataaaataaaaatttgttgaaattagcagccaaagaaagaaagctattagcccacttgtatatgagggcttcaagaccctattaaagacttaatatatctggtatttaaagtaaaatccacgacattcagataaagctaaccgactgtgtcatatgcatttgatttgaatgagtaaataatcagaaagtgtttgacaagtagcaattaacaggaaactttcatttgaaggaaaaatgagaatggatttgtagctgccaataaatttctcagtaagcttgaataatgctgtttattcaatgagtctgaataaattttcaagaacatttcaagcattaacttgcctcttttataagttttttaaatttgaaaatgtagtatggatctgtcagaagtaaaattggaatttttaactttttcatacttgatattatgcaaaacatgcaagacactgatgtatgagagttctccccaagcattttcttttactgacaattcagagggcctgcttcttagagtttggatatttactccctgcttaatacaagccttggaaaatctcactctaaatagaaaggcaagacacagaaccttgccatgagtttgtcaccaggagaaaataaggctctgctgtcttcaatatttcttactaattctcttcgtcagaagtcatatatttttagaaaatttaaaaagagaagcagcaaagtctttataagaaaattatcatcattccttttgctcaactacataatagattggaatttagaatattccaacacaggccatgataccccaattctccaaccacaatggggtcttaaagaaaggtactttcctagacacatcagtttaatgaaaacacatttagagaattgaggatctggaaataaatcccttaatatttaccatgtgcacatgtgcattcaaactctaaatatgctaccagctgtgtgcaaatcaatttttctgtccaatgtggtagctatagtataccatttgtagtttatgaacatgcctatctgttaccaatcactgtgtaaaagctgttctttctgctttaaaaaccaatcactttaccctttacctctaacttcatctagcaaatttcctttctctatgtatttagctcacatattttctgttgtgaaatagtctcttaccttggggcaagaggtgtgagagtgtcagtcaatttcatcttcctcagtgatatcagtactctctgcacataaatctatatgtggttaccattagtatattataactgtttatattcatgtctctctcctatattagattcagaaaatttctgttgtggagacggaatgatacatgtgttcctatccccaacatcgtgcacaattcctatcttaatattagtgttcaatagcttaatattggcttcatgagtgttcatggccacacacagcccccagacttatctagttaaattgctcatcaataagaaaaaaaaactctttcaaagcactctaacataaaggtaccaaatttttgcccaaaggtattcaggtatggttatgttagcactttttgtgatggcccttacaattgttagaatgctgtgtctttatttagcacccaagtgggtatctgcgtaacttcaacaatgtctgaattctccatcctgaagaaacaagtgtatagactggtactttttcatgccagttttgccttattcttcttgttctcttttttaaggtaaaatgtgacttacctattgcaaatatcccaaacatgaaatagttttaaaacacttaacatttctgggcaactgtttttatgtattttaatgtctcttttgaaatacaacaaaaaaacagaaaacactagatataaagtgatcagcctaaagcatgccagttacatagcatgaataatttcaatttaataattctgtaatagagccaaatgatgaatatttaactaatgctacttattgcttaaagtgctatcacatcgaaactatgccatctgtgcctgtgctgatgcccgttaaattaaaatgttgttgcttctttggagccaaaccctcctctaatccacaagccctggcaactattgatcattttctcttcctatagattgcctattttagaatagcatgtaaatggaattgtacagaatttagccctttgagtctggcttttttctttgcataatgcatctgaaattcatctttgttgtttcttgtatcagtagtttgtatcattttattgttgagttgcattctgtcatatgaatacaccacagttagttcattaatttacaagccaaaggacatttggattatttcccatttatagtgattatgaataagctttattaacatccactcatggtttttctgtaaacataagttttgtttcacttagataaatatctaggaatgagattgatgggttatgtaagtgtgtatttaactttataagaaactgccaagctgcttccacttgtccctctgtcagcaatgtttgacaattctagtttctcagttttaagaattcaagtggcacagagcaacctaacactggatatttattttactaatcttattatagttattctaatatgtatgtagtgatgtatcattgatttttgacctatatttccctaatactaaatattatgaagcaccttttctagtgcttatctgtcattcatatttttgtctattcccatgttttgctcattttttgcttgagttgtctgtttaattattatggagtttcggtaattctttatatatacttacttgttttaaatatgtgctttgcaaatattttctcacattttgtggcttgtatattcagtttcccaagaatatatttcttttcttttcttttcttttttttttttttttgagacggagtctcgctgtttcgcccaggccggagtgcagtggcgcgatctcggctcactggaagctcctcctcccgggttcatgccattctcctgcctcagcctcccgggtaactgggactacaggcgcccgccaccgcgaccggctaattttttgtatttttagtagagacggggtttcaccgtgttaaccaggatggtctcgatctcctgacctcatgaagaatatatttcaaagaggagaagtttttaagttttcatgaagtccattttataaatttatcatttttttcttttataaattatgctttgggtaccaaatctaagaaataatgtttccttcacttttctctagaggttatacagttcagttttaaatatagatcagaaattcatggatagaggttcattatttttctacctaaaaattcaatgtccagcaccatccgttaaaaattatttttgaacattgaattgactttgtcctttatcaaaagtcagttgaccacaaatgtttgagttttatttctggatttttttttattctgttccatttatctatgtatccattcttttgccaatatcacagtctttattattatagctttagagtaagtattaatatctaatgatgtctttcctccacattttttctttttcaaaattgtttctgatattccagatcacttaggttttttgttttgcaaattttagtattagcttgtcaatttctacagaaaaaaaatcttgctggaattttttgttgggattgcattacatctacagatcagattggggagaaattgacatcttaacaatattgagtcttcaatatgtgaacatagtacatcacctacttagtcttctttgtttattttcatcagtgttttgcaaggtccaaagacacattgtgtgtaagctttgtcccattatgaatcagaaaagatagatcacagtattcataggctcataattaatataaaataagaaaaaaatttaaagtggtcttatatgggtttctctattcagtggaaaaaaattattttaaaaatgttgtgagcaataaactctcataataatgttaagcaatgacattataagtgacaatattaccctctgtcccttacaaatggctttaaacaatatactttgactactaaaatatatttttataatattaaaagtctattacttcatttatacattctaattggataactatgaaattgtctttaaaaaatacagatgtttaaaaacactacttttgccttaaaatgtatctggatattggctacaaaattttactccacatcataaatattgtcacagaatatggacttaattattgaattaaacacacattcgaacttctgaatcaaaattttacaggccgtactaatgttttttcttctttatttttttctcttttattttaggttcaggggatacatgtgcaggtttgttgcatggataaattgcatgttgctggggtttggtatacaaattagttttccacccacgtagtgagcatagtactcgacaggtagtttttcaatcctcacccttcttccaccctccacccttcagtaagcgccaatgtctattgttcccttttttgtgcctatgtgtactcaatgtttaacttcacttaaaaatgagtgcatgtggtatttggttttctgttcctgtgctaattcacttaggattatggcctccagatacacccatgttgctgcaaaggacatgattttatttcttttaaggctgtgtagtattccatggtgtatattaatcatatcttctttatctagttcactgttgataggcatctaggttgattccatgtctttgctattatgaaaagtgaggcaatgaatgtatgcatgtatgtgtctttatggtaaaatggtttatattcactcaggtatatacctagcaatggttcagatggcagttctttggatgcaaactgctttctgcagtggctgaactaatttacactcccaccaacaatgtatctgcattccattgctccatgaccttgccaacatctgttatttttttgactttttaacaatagccattctgactggtgtaagatggtatctcactgtggtttttatttgcttttatctgattattgatgatgttgagcattttttcatgtgcttgttggctgtatgtatatattttgagaagtgtctgttcattttctttgcccattttctaatggggttgtcttctgcatgttgatttgtttcttagagattctggatattacaccattgtcagatacacagtttgcaaatgttttctttcattcttaggttgtctgctggctctgttgattatttcttttgctgtacagaagttctttggtttaacttggtctaacatgccaatttttgtttttgttgcaattgcttttagagcctttgccattaaatcattgccaaggcctatgtccagaatggtatttcctaggttttcttctggagtttttataattttaggtttcatgtttaagtcgttaatccatattgaattgatttttgtatatggtgaaagaaaggtgttcaatttcaaatttctataaatgggtagccagttctcccaccactacttattgaatagggagtgctttccctatcatttgttattgtcaacttagtaaaagatcgaattgttgtagatgtgcagctttatttctgggttctttaacccttcccattggtccacgtatttttattattattattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgtccttgcgatcgtttactgagaatgatgatttccaatttcatccatgtccctacaaaggacatgaactcatcattttttatggctgcatagtactccatggtgtatatgtgccacattttcttagtctagtctatcattgttggacatttgggttggttccaagtctttgctattgtgaataatgccgcagtaaacatacgtgtgcatgtgtctttatagcagcatgatttatagtcatttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctttgatggccagtgatgatgagcattttttcatgtgttttttggctgcataaatatcttcttttgagaagtaactgttcatgtccttcgcccactttttgatggggttgtttgtttttttcttgtcaatttgtttgagttcattgtagattctgaatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagctttacggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttggactgaaacaatggggttttctagatatacaatcatgtcgtctgcaaacagggacaatttgacttcctcttttcctaattgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagagttgttgaattttgtcaaaggctttttctgcatctattgagataatcatgtggtttttgtctttggctctgtttatatgctggattacatttattgatttgtgtatattgaaccagccttgcatcccagggatgaagcccacctgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcccggactctttttggtttgtaaactattgattattgccacaatttcagctcctgttattggtctattcagagagtcaacttcttcctggtttagtcttgggagggtgtatgtgtcgaggaatttatccatttcttctagattttctagtttatttgcgtagaggtgtttgtagtgttctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgatattttgaagggttttttgtgtctctatttccttcagttctgctctgattttagttatttcttgccttctgctagcttttgaatgtgtttgctcttgcttttctagttcttttaattgtgatgttagagtgtcaattttggatcttttcctgctttctcttgtgggcatttagtgctataactttccctctacacactactttgaatgcgtcccagagattctggtatgttgtgtctttgttctcgttggtttcaaagaacatcttcatttctgccttcatttcgttatgtatccagtagtcattcagaaacccatctcacacaaaataacctatttctttctatcatttttctttaattttattttttgtcagcctttatctgttttaatgctgtaggacctttatgacttttattatatctattaagcaactcagtcctatttccttgcagtggaatatttttaccttctccaaagtttgcaaagcttaataaaaaaagaaaagtgagttgttgttttatgtgaccacaattgattgctaataataactgttattaatattgattcttatattttcatttgcatatattttgtcatttgcatatattatcatttttagcgattcactacataagcaatcagcaagtgcttgacaaaggaatgaatgaaatgatgaaggacaacagttcagaatagcactgcaattattacctcaattctacagatggatgaacatccataaagaaaataagaacacatgcatgtgtcttacatggctttcagtttaactttcattactttatggtcatattttgtaaggtgctcagtgtctactgaaagttagtggattactcgagactgacgtcattgtctcctgattttcaattccagattttattttgctttgttctatttaacctcagtaggcaacattgtcacttgggaagctgatttgggaaatacaaagaaaactttcttatttcattggttccccaattaataaatatttactgattattttctatttgaaaatcactatactcagcccatggagaatacaaaattaagtagacataaaaccctacttaatatgtatgtatttatgaaaatagaaaatctaacactgcagccatcaaggtttacataaaatttcttaaaaagactacattgcagagatagcctctaacagcgcaggtgtggggtggcagagcaaagaggactgaaaaatagcatagggaatccttagtgagtttgcttgatgattatgagtatatatgggcatatatatatcttggtgcactggatattctgttcaaacacagactttgtttcgatatcctttgatggtaggctgcttttagagaagtgcctaatgtattacgtgtgcccatcaaacttgtttattccttctacccacttcctgtgatgcaagtatcacaggaagaaggaataaacaagtttgatgggcacaggtaatacattacacacttattcacaaaggctgggcagagaccttgggaagtgtagcaaaaacttcttaaaataaaaacatgacagcttacatttgaagttaataaacatcaactataccaaccctgttcattcatttgagttcaatgcagggagacttgaccacttatcttaaccttttgtacaaagaagaaacaactggaatattacccaaaaatgtttatatttgaaatatcattgaaattaattctgtagggaaaatagtctgtcagtgcactggcaagggcaagccctctataaatgggactgtcaatactctgccttcagcatacatcactaagtgtgacatttgaattaaacttcgtaaaaaattaataacagggtattcaaagaggctttgtactgtgaatctaaaaagctttcaagaacactgcacaattatagcctttttataatttatattatcaaacacactttaaactatcctaaaatattattagcatattagttattgctccaagcttgtaaaggattgcaccacagaccttttgtatagctatttatccttctactttgttatccatatacaagttgaaagccaaaatgctttcaagcattatcaaatacccatgcatttacttccctcaaaaataaggcaaaatggtgaaataatacagaagtgtaatgacaaaatttaaaaatggaggatagagtagtttctcatgtgcaaaaccatctttaattaaaacatgtattttaaaataaactctttacttttgaataattttagatttacagaaaagttgcaaagataatgcagagaaatccttcagctagtttctcttcctgttagcatcttacataaccacattatatttatccaaattaagaaattaatattggcacattactattgactaaactaaagacattatatgtatttcagcagttttccaactaacatgttttctctgttccaggatccattcaggggaccacattgtccttcctttaatgtctctttagtcttctctgattagttacaattcctcagataccatttttttgtttttcatagccttaacagttttgaagagtcaagcaggtttccttgttttttgagctgggcagtttgaagagtcacctttgtagaaggtgcctcaatttgattgtctggtgtctttcttgtgaatggactgggctgatgatattttggggaagaataccacagaggtgaagtgtccttctttttacaccatattttgggatatgtgataccgttggtgatgctacactagtcacttggttacatttcttcaattcccttagcaaatttctgagaatatggtaaaaattactaaaaaaatagaagttatcgcatgcatttttcaatcataaattacccataagataatccaaagtatgagttattttataagatggaataataagaattcattggttaaatgatttgatattttacctcattttatgttctttttgtgaaaacattgtctaaactaaaactgtgatttaaataattgtttatagaattcagtaaaattaataatctgcaagatttttgactaattctaatatcataccaaagacatactgtgagctaactggtctcaatgataacacatgtaactaatgatggctttcttatttcagtatcttgataggtaacaactgttcataaacgttgaattgcagctgttcaaatatacagtaccattcccttaccatgtactaaaacaaaaatcagtgagaaggcttccagaagctttgtaattgttgatctatttgataattaagatactaaagttctaaaaatattactataatgcattttagtgcttcattaagtgaattatttgtgtgctggatggaagtaagagaattggtcaacatattctgctttgttcaggtcacatctaaaatatcaggtgttggctttagatcattatgagaggaaaagataaagtaattttcaaacctgtttaatttacactctcctttttctaaaaacattcccactttcaaaccataggtgaagatctgctgtcaagttcatgcaatgtgatctcaactaattgcttgagtcagtaggcatcaatccacagtctagactaagataatttatatgcttgcttcatctccacccccaccacaaaataattagtacacaaagactagtccatttattggtcacttcaacaaggaagtgatggaaagtggagtctgagttaaccatattggtccatgagtaagaggaccagagaaaccagttcttcagagagaaaggagatggaatccaatccactgcaagaatcagaagtaagaaaaataccagaagtgagaaaaagacagacagcacagatatctctcttcctggtgacttttacttcctctcaaaaatctctgggggaacttgtctgcccttcccaaggagtcttagatatatccctgaaatttttctaaaactctaacctttcttatttaaattaattagattttgttctattatttgctacaaaaatgctgtctacacagaggaaaaaagcagaccaatttatttattgaataaagaatggaatgtatataaatcagaagcaagaagagggaagagattgtgataaatgtactctaatggctaaaaggctttcatatgttgtttcagacttggaaaaaaaattgaaacaagggatggaagtcctagttagataaattcaatcttaacataatataaaaatatgcaaataattttcaaaaaatacagtaatttaaaaatgcaaaaggattcctttttatcctcagatttgttcctcactaggagtcatccagaaaagtctgcatgcagccacctgcgagtattttacattgagtaagaagcttgcctaggtgccctctaagtatgctgtaattgtaagtgataataaaatgattaaactgttttggtgggcatttctgaaggatgtttactgacgttgtggaagaaatatcatggtactgtaaaaatgagagacctattttacaagtaagaactgacaagtaagaaaagattcttccttctgaaagcataccttccattacagctgcacagtggaaacatattaattagagcaaagattgctcatactaaaacactgaggccagagagtcagagctgaaacagtggagtcatttctggtgtcaacaagtaaatcttttgttccataaatctgtccttaagcaacctaagaattatctgatatagtaataacagctatgaagaatgaaatatttatagatcaagatctttgtgaaacctcttacccctccccagaggagaatctgcagactcttcacttggccattttgattaagaattgtcattaatgtcttggtgtaaaatacctggatgctgatattaaagtctattgggtattcttcatagcttgatctacttagtatgtattataaaacctatatagcttttcttgcataaaatgggttttatacatctaattaagtcttcacagaattctaaatcaatgagccattgtaaattttgttttaaatattatctaagttttctggaccttacctatctgctaaattcaatatgtggtttccaagggtggcctaatcatgtcagcatccttgtgggcttttggttctgtctgatgtaaatcaaaagacaattcctaaaaaaatatatgagttaagccaaattattaaactaatgggttacaaggaggaggttaacactaaagatagcatttccaaggctatttcacttagaaatgctgatttcttccttaggcaactcttcttttgagaactggttcttgaatgaaattctactgtagtaggctcatttttttgttttgttttgtttaatttgttcctgataatattaaccccactttctccaacttcctgataaaacatgttacacatctcatagacacttgacttcactaagttatgacagatttgatatgactgttagtaatttattgcttatatattataatagaggtgttttattcaattttctgaaaaaaatagataagtttggtgctgtaaaagagttagagagtgtcagtggctccctaaatcactgattcaaaaaatcagagaataagagaccatttttatgagtgtgatgcataggtatatcaccagattacatttaaactgacccaagaactcccactgatcctcgtgaggtccctaacttacagccttaacttttcgccttttcactactcaaagtctctgtgaatttcaaaatcccagctaactgcttttctttctaacccaaattgtattgcttcaggcactctgtgagaatgctgaataacaaaaattgtgtgtcacaagaaacaagtaattatttagttcccaacttgctctaggctatagttcaggcacaaagttttagaatagcctttgcaaggtgcatacagacttcagctctcaaaatctaatagtgattgaactcacacttactaactttcaattgatattgatgctttatgtcatcagtttttaagtatttgtttgtaaatatttataattattgctttttaataaaaaaccacattgaccatttagtatgtcattctttttcaggcttcttttttttttttttttttttttttttttttttttttgagacagagtctcactcagtcgcccaggatggaatgcaatggtgtgatctcggctcactgcaacctccgcttcctgggttcaagcaattctcctgcctcagcttcct

SEQ ID NO: 273 - DNA, 176103 bp, Homo sapiens
taagttacttcttactactttaagtactttagcttattaggttaataagtttcatcaccctttcccacctaattgtcatggccaaattgaacttccagtcctttcttcttctccatctgaaattgtccatagagtttccttctatgattttgcttttaagacatggaaacaaaagggaaaaaatgaaatccatcacgtgattctctgtatgtgcaagcaaaaccagaaggattctcctttaccaaactcaggaagtttatacagggcacatttgtggaaagaacacggaaaacacaatgcttactaatgatatttctcctcctggatcagacaagaagatcagattttttataccagttttgatcagtttaatgccttataaaaggcaaaaaatataatatattatatataatgccttatataatgccttatatataaaaggaccttatataaaaggacctgtttccaactctttacacgttacccttctgaaacagaagaatagcaatttatgtgttcaacctaacgtacttaacatctgctatatggaaggcacagaggtaggtcccatggggaatacagggctgcataagacaagattcttgctctcaaagagcattcatttcagtatgaagatgatgtagatttatcaacaacctattgctttaagttaagatcatggaggaaatctgtcagtgcccatcatttcctcaccaccttatcctctcttctacacaaagcccaaatcctgacacctaatagactatctataggaccatatgctgtgcagttgcactctcagaaggggcacatgcttggtttaatcctctgctgttgctgtcttggaattcttagtgattttatcttcgaatttgtgtttggtaagtgaagccagtgagacaatgaagcatgcacatgagcagtggaaacaccccagcggggaacgcatgcatgtgtgcatgattcagggcagtccagagtgcagctgagccagtacctgggcccagttgcagtggtgatggtggcgggcagcaggagtaacagtcaggacagcaatggctgcggctccaaagacaggaaagggctctgcatatggacattgccaggaccaccagtgggagaccagctcgcctgtcccttgccagagcttagccccgcatcatctgcacaaatagtaactctccatcctgagtactgggacaggaactcattctgctaacttctcagtaaattagtacaacatgtatacaataaaagtgtatacatgaatattgtcatagcatagcagggggttattagaattcttaaaggatctaaaatgtctagttttgaaaactactacaacatggcaaagcaaataacctcaggcttagaaacagaaattaagtttaaagattgtcacattctacagaaaagaatgctattttcctaggaagtacaaaccaattgtttggcagaaagataattaaacatgttttttttcttataattgaagagtcagtgacagaatacataaacaggccttatgaattatatacaaattatgaagccactttcagtttcttgtaagacctccacaagtttcaggaaatatttccttatgtctgcagaaacattaaaatatcattgtgtaaatttatacttaaaattaaattcagacttttacagaaaactgagttgtctaaggagttaagtccctttagaaaaattattccacaagaaccaacaactctagaagtattaaaatttatatttcaaaataatttatcagaaatttaccttagtgttgtcacagtttatgaaacactcttaacagctgcatcagcagaaagatcctttacgaaatgaaaaattatcaaaatttatttgtgactttatatttcccaagactggctggtgttgctttcagtcttatctattggtaaagaaattgtatgacataaatttcatatctattgaaaatgaaagtgaaatgaaaagaataaattttgatgaatttgcagaaaagtgagccagaaaaatataataggacatcacattaatgaatgattattgtttactgtattatataaaattatgacatcacaattattagtttagcaatgtttaagttcatgtagttactccagtatcactattatcccattacattagtatctttaactgtacttttttcctgttttttacagaggaggtcccatattttcgtttggcaccaggctcagcgaattacatagccagcaatgaccacaagtaagagtgttacagatttttgttataagccatcatagtagacaatgcttgcctatgaatgcttaaggagagtagaaaaagagcaagaaatgcaagaaaatgcatgttcttaatgtgtgccatataaaatctatcaggtaataggcatttaatctatgttaagagtaaagaaatatagccaggcgcagtggctcacacctgtaatcccagcactttgggaggccaaggcaggaggatcacgaggtcaggagttcaagaccagcctgaccaatatgatgaaaccctgtctctactaaaaatacaaaaattacctggtcgtggtggcacacgcctgtagtcccagctacttgggaagctgaggcaggagaatcacttgaacctgggaggcagaggttgcagtgagccaggattgcaccactgcactctaccctgggcgacagagagagactccgtctcaaaaaaaaaaaaagaaagaaagaaaaaaagagtaaataatactgtgggctatagtgcagaatttgtcataaggaaaaatctgtttgcatttaatccaggactgatgtcacaaagcaattggggacaatgccttcaattgatgccattctcattaaaattaggagttttggctggacacagtggctcatggctgtaatcccagcatgtggggaggccaaggcaggaggattgcttgaatccaggagttcaagaccagccttggcaatgtagtgagaccctcatctctacaaaaaacagaaaaaaattagctgggtatggtggcacgtacctatagtcccagctacttgggaggctgaggtaggaggatagcttgagcccgggaggtcgaggctgatgtgagctgtaatcatgctgctgcactccagcctgggcaacaagaggggactctgtttcaaaaataataataacaatttaaaaattatgtgttttgctgtccagagcataagtttgacagggataaacatccattcaaatgggagtcaaattcaggtatcttataaatagcaagcctgttagattgtccttctatgagcattctttgttttcaaatatggagaactatttttctaaagatcagagaaatggccaccacaatatgggcccacctcatctatttttggtttcttcaaaaatgatgactccaatgaactttgcagtaaaaacaaaatgacaataaagatgacttacttgtgaaaaataaacagcagggaaaagcactgaagccagataaaccaaatctgcttcccataaagtgaaaaaagatccactgaattataattgtttttattttcatatgatgattgttgcataaaactaatttgttgctgaattaagaaacataagacacatatttaccctaaataattttagttcatctcctggcttttagtgaaattatcgatttctaggtgatataatttgtgtgccggctgggcaaagtggctcacacccgtaatcctaacactttgggaggtgaaggcaggaagatcacttgaacccaggagttcaacaccagcctgggcaatagggtgagactgtgtctctacaaggaatttaaaaattagcggggcatggtggtgcacgtgtgtagtctcagctactcgggaggctgaggcaggaggatcacttgaccctgggagtgagctgtgatcacgccactgccctccagcctgcatgaaagtgtgtcaatgcttttttttcctccttctttttatttttattttttcttcactctgtcacctaggctggagggcagtggtgcaattatacctcgctgcagcctctatctcctgggcttaggtgatcttcctgcctcagcctcccgagtagcagagactacaggcacatgccaccatactcagctattttttttttaatattttgtggagatggaatttcaccatgttgcccaggctgatctcaaattcctgagctcaagcaatctgcccacctcagcctcccaaagtgccgggattgcaggcatgagccactgtgcctggcccaatgcttttaatgggcccattttagccacatttctagtacttatattattcaaatagactcagaaaagctgtaagcctgtacagaattacagtgtaagacatcataaacaatgttttaaaaattagaaaaaccaattgcaatacatgtaagaaagaaaaaataaatattcacaatatataaaccgctcttacaaatcagtgaaaacacaactttacagcatgacaactttgaaagaggaacaccagataagaactgtctggggcgagcatagaagagtctcattcctctgtctgagtggtactgggtgagtggaatggttggtgattataggctgacaaagccctaggctttttcttagccccagctccctgccttctcccctcactgccccctcctgtgggggcactacctagcaactgaggtttgggttttacagtgaaaataattttatgagtcagaaaggagtgagaaaagtgtgttatcagatagcattccacagtggtaaaagcaaaacaaacaaaaaacaggactatttctctacatactgtctgggactttgggaccttcactgcagacctcttgtggcagtgtatgtgtgattccagtcgtatggtgggtatgtggttagggtattattacatcgtaggtctataaagggccaagccccttgctccgacatgcaaagaaaggattgcaaactggcaggctgcaggtcataccgtgctcatagacagctactgttttgtatgcacagtttttaaaattgtgaattagtgtaatggttaattatatgtgtcaacttggttaggctacggggctcagttttttgttacaacactaataacaatgtggctgtgaagatattttgcagatatagttaatatctacaaccagttgactttaagtaaaggagtctactttcaataatgtgggtaggcctcatctaattagttaaaagccttaagagcaaaatcggagatttcctggagaaggacttctgccccaggattgtaacataaaaatctggcttgagtttccagcctgctggtgttttctaagatttcagacttgttgtatgcctcctactggttctgtttctctggagaaccctgactgatatagttactatgacacagactattaattgctgaccccaagagcctttctccctttattccctatagtaagtgcctctgaaatagagactacatttcccagcttcccttgcaattagctgtcaccatgcagctaagttctagccaataagatgtaagcagatgtggtttgtggcagctcccttgaaacatacctgatgcataccctgtgtctccttgtttttccagccagtcctccatccttctgctgggaacttggatgctagagctcttgcagtcacactgggccatgaagataaaggtcaccccctaggaatgatagagcagaaagctggaaggaacctgggtccctgatctctgtggagccactgaactgcctctaatgaaggaaaacatttctctcatttatgctgcatgttcttttcgattttatgttatatttagtggagtataatcctaatttgatacaattgccaacttttaaaaatcaggaaatttcacacaaatattcagctctctggcttttctcttgaaaatttggtacatctgacaaaacatgaagtcatgcttcccattgcagcaactgacctgggcaggataatggatgcctgcttcagacagggatggagacctcaccaattttttttccttcattttaattgggaagtggggcaagatggaaaaattgtggatgccaactttgtaactttgtctttctccctgcatcatttttagcaagaacatttcgacactggtgtagtccacaagggaagatactgagagaggagaaaggaagaaacctttcaggcatcagttagggtgggtccttggttaaattctttcaaacaaaagaacagcctgaaaaatcaagctgcaggcacagataaggggatctgcacaggtggccttgactaagacattcccacagccacacagatatgaaagcctacccagatgacttgcccagatacttctgcagtggaaaattccatcccctgacacatgcgcagtaaggggaaaaaagcaatatggaataaaacttaagctaagggcccacatgcacactagaaggatgaggtggagctaccagaaattcatgccttatgcaaatgagatgcccagccctcaccggttcttataaaagcctttgcagtcacctgtaaaagcagcaaccctcctccaggtcccctctccactgtggagagctttcttcttttgcttattaaactttcgctgcaacttcatcctttgcatccacgctccttaattttcttggtcatgagacgaagaactccaggtgatacctcacctgctacattatggagagactgctacattatggtgcactggtgaaaatataacatttctgatggtggtggaagcagaggccatcctttgctgtttcatgcccaattctgtaggcctgcctcagagagaaggggagcacaggtctcagcatccacagacttttcatggcggtgaagctctactatcaacacttggaaagagggaatcagagggtcttctactccatggctgcaactttttctcattttaaagatcctcctctagtctaatggatttatatttctctggctgacgtaattttgaccctacttcttggtaatacccgagccttaatttgatgaaagagtatcactcccacctaatttccaaccacctctctgccctgagtagcttcatcaaaattcacaccttgcttgacaatggagagaagatttcgcctaacctgggggaggatggaggggatggagggtatagcctcagttgctgtcagacctaaaccagacttggcaataattgggggaggtggagtgccctgggttgaaggagtcttggtgagttaaacacccattattgtctttggctgtaaatgaactcaaggtcactaggaagtgagtggaaagtcagatgaactctgtctctcagaggcaggccaagggcaaagaaggcacagaagccacttcaaaactttcaggccttttgggaggaaagggtgggtatggaatgaggctgactttcaaagatgaagctgtgacagatcagaaatctgtatttttgagccagactatgtctgtgtctaggtttgcctttgtctttttgttgtcagaatttcattaaactaattattcattcatgtatgagtgtcttctacagccaggaactctttagacaagattctggccctgatgacacttacgttttagttgccaatacagataataaatataagaagtaaacaaaggccgggcatgctggctcacacctgtaatcccagcactttaggaggctgaggaggtcagatcatttgaggtcaggagttcaagaccagcctggccagtatggtgaaatcctgtctttactaaaaatacaaaaaaaaaaaaaaaaaaaaaagagctggcatgatggcacatgcctgtaatcccagctactcgggaggctgaggcatgagaattgcttgaacccagcaggcagaggttgcagtaagctgagattgcaccattgcactccagcctgggtgacagaatgcgaccctgtctcaaaaaacaaaaaacaggctgggcacagtggctcatgcctgtaatcccagcactttgggaggccgaggtgggcggatcacttgaggccaggagttcaagaccagcctggccaacatggtgaaaccccgtctctactaaaaatacaaaagttagctgggcacagtggtgcgtgcctgtaatcccagctactcgggaggctgagggaggagaactgctcaactgggacttgggaggcagaggttgcagtgagtggagatcacgacactgcactccagcctgggctacagagtgagactctgtcttgaaaaacaaaacaaaacaaaaaaagaagtaaacaattagataatcagcctgggctacagagtgagactgtcttgaaaaacaaaacaaaacaaaaaaagaagtaaacaattagataatcaagatggccaggtgtggtggctcacacctttatcccagcacttcaggaggccaagatgggcagatcacttgaggtcaagagtttgagactggcctggccaacatggcgaaaccctgtctctattaaaaatacaaaaattagccaggcgtggtggcatatgcctgtagtcccagctactcaggaggctgaggcaggagaatcgcttgaacccaggaggaagaggttgcagtgagccgagatcgtaccactgcactccagcctgggcaacagagcaagactctgtctcaaaaaaaaaaaaaaaaaagataatttcagatagtgataagtgctatgaaaaaactttcaaaaatccccaaacttaaaaagaaccaacaatgagacagagtgacaagggtgaatggaagagtctattttagatgggtggtctgggaaggctgctcttgaggaagtgaactttaacctaaatgaccagaataagacctaaaaaaaaaaaaaaaaaaaaaaaagagtgttctcagaagagaaaaccagaagtatgaagagtctgaggtggaaataagctcttggttgggcatggcacatgaggtggagaaagccaagagacaaggtcacacagggaggcaggggtagctcacattaaactttcttttcttttttttttttttgttttgagacagagtttcactcttgacacccaggctggaatgcaatggcgtaatcttggctcactgcaacctctgcctcctgggttcaagcgattctcctgcatcagcctcccgagtaactgggattacaggcgcctgccaccacacccagctaatttttgtatttttagtagagatgggtttttgccatgttggccaggctggtctcgaactcctgagctcaggttatccacctgcctcagcctcccaaagtgctgggattacaggtgtgagccaacgcacccagccgagctcacattaaactttcattcagagattgttttatctttattctctgcccatttagaagtcattacttttaagcagtggaatgaaattattttaattttgaaagctcattctggctgctggttagattctagattggcagaggcagggagaccaattaggagcccatttaattgtccaggtgagaaatgacacctggtttgtacaaggtggtaacagtggagatagaggtgaacagattcagatagattttaaaattagagacaaaatttgctggtggattggatgtggggtatggggaatctaatggagtaatctaatatggtggatgttggttccatttactaagatggaaagcctgaaggaggaacaggtttttggagggacatcaaaagacctgttttgcccttgctctgttggaaatgcctgtgaaacatccagaaggtgatgcaaggaaagagttggataaatgaacctggagcatgtatttagcattctttttggaattttcagcctgcttgtggaaacctaggaaagcccaagaatgtagggaaacagctgccctccctttcccctgcaccagcagagttcgcatacaagggtccagatccccatcatttaaaggggtttagcaagctgatgggtagcagtgtgcttcgtttcatgagctttaaagagttgagaaggtcaagcaagttgcatattgctattcgtcattcacttacatttgctgagtgctttaatttttttttttttttttgagacagagtcttgctctgttgcccaggctggagtgcagtggtgtgatctcagttcactgcaacctccacctcccgggttcaagccatctcctgcctcagcctcccaagtagcagggaccacaggcacacggcaccacacccagctaatttttgtatgttcagtagagatagggtttcaccacattggtcaggctggtctcaaactgctgacctcaggtgatccagctgcctcggcctcccaaagtgctgggattacaggtgtgagccaccgtgcccagcctgagtgctttaaatttgaatgatcttcagttgactcttagcgtgaagtttctggtttttgcttctcctctttcctcatatctccctgccctggcttctttaaccaacctttgctctgtggactatttaaggaaaaaactttaatcggccctttgctgattatggggaaggagggttctccagcagagctcaggaaatagctcacttctccctatttctgaaacattgaggatgaaaacagagagtgacacagacaggaggccgggttggaaggaatagttttaggtctggtggccaggtggactgggctaatactgaactccagaatcaagagctgttgagttgcaggctgcactgggctaggggcaagccctggagagaacagcagataatgtttttcccttaggggtctgtctccccagaggaagaaggcaatgaagctgagcccaatatgctcagttaccctgctcagatggactctacattatcagaggggaatgacgaaggcactgaaagaggccaggaaatagtccttttctttttcttttttttttttttttgagacagagcatctctctgtcgcccaggcaggagtgtagtagcgcggtcttggctcactgcaacttccaattcccggattcaagcgattcttctgcctcagcctcccaagtggctgggactacaggcacacactactacgcctggctaacttttgtatttttagtagagacgaggtttcactacattggctaggctggtctcaaactcctgacctcatgatccgcccgcctcggcctcccaaagtgctgggattacaggcatgagccaccgcacccagcaggaaatagtccttttcaatagaaccctagagtggagaaacagcattctctaacagttaatgaaaatgttcaccattaattaattggctggtcttatatatttaaattttcataaagtagattttcagtaagtggagcataggtgaattcaacaaacaggtatgaggcataattctgctacttactagctgtgtaatttgaggaaagttccttgacctaagtctcagatttctcatttgcaaaaaggaggatagaaataattcatgtaacacacttagtgctctgactggatcagaatagcattcaataaagttttactactactttaatgataactattcccattaccttcttatataatctactaggtgctagaaatataaagataaaaggcataaccttaccatctagaagcttaaggcttagtaagggtgttggaataaaagacattaaaatacagtgcaggcccggctcagtggctcacacctgcaatcccagcactttgggaggccgaggtggatggattacttgaggtcaggagttcgagacctgccttgctaacatggtgaaaccctgtctctactaaaaatacaaaaattagccaggcatggtggcgggcgcctatagtcccagctactttggaggctgcggcaggagaatcgcttgaacctgggaggtagaggttgcagtgagctgagatcgcaccactgcactccagcctgggtgacagagcgagactccatctctacataaataaataaaaaataaaatataggtcaggcacagtggctcatgcctataatcccagcacttttgggaggccaaggcggacggatcacgaggtcaggagatcaagaccatcctggctaacatggtaaacccgtctctactaaaaatacaaaaaattagtggggcgtgtagcacatgcctgtaatcccagctactcaggaggctgaggcaggagaattgcttgaacccgggaggcggaggctgcagtgagccgagatcttgccactgcattccagcctgggcaacagagcgagactccacctcaaaaataaataaataaattaattaaataaaatacaatgtaatgcacatgtagtagggtttctttccataggatgcctgacagtggttacattttagtaagactatatcggtgtaggctatgattaaaaaatatatcatcttggaattgttgcgccacccacatccttattgggtagggggttaaataagtagcttcagttgtccttcaagaaaggtatcaggaaagctcctatagttttttaattgctttttttaagggagttagtcaccaatgaggactagaaggatgatggctctaaaccctcaaggtggtgaaaactggagccagcctcgatttagcacgcctgagcacggatcccaggaggtagatgtgtgtggaaacagaaataccagatcccatgagaatcagacacctagagcctagcctggcagcacctgaaggcccttggatcagggtgacactggggcaggctagaaaggtctcactctggcccagattctgatgctttgctgacaccactgtgccagttcgccaatgctctatctccatttatgttacatcttctgccaaatagctttgctgccttgcccctgaaccactgcatgctcagcagctggtgcttcagcatcctgcagctgtagcccagaagtcctcactgcctcatatgttgagatgactgaatttggccaggagtccttcctgtgagaaagccctggagtgtgggcagcccatcctagaaaataaacaaagcagctttcagcaatgagggacacacagccagttttgctacattcacccttctggctctgtcttcagcctaagctgctcctttcaggtccctcccttgggacctcaagcctccctttcaggccccttttaagcacagcaaatcctgtatgcattaaggggaggtagttgaagtttgggcttctgggttttatgttattactggcttctgaaagctcaaacatttgcactccagggatgatagttgcatctgttaaatttagtgtaaagctgcctccttacatattttaagttaggcctaaaggtttccccatacatggtgaactgtagcctaattgggtatgtaaacagactgtaacctattcttgtaccaatcacagagttctggccaatcacaagtggccaactgttcaaaccgtgttcaaatagggcaaacctgagctacaaccaatccagctgtttctgtccctcaattatgttttctgtaagtcactttattttttccgaccactcggcaagactggagcctctctgaacttactttgatttggggtctttttgatttgcagatcattctttgggttctttgcttgattaaacgctgttaagtttaatttgtctaaggtttttcttttaacacaccccaaactgtaagtggaggcatcctacttacacagtaatagaagaatgcataaagcaataacatgaaggaacaagtgacaaattctgtaacgccatgtgttggggaaaagttctgagagtggaagcttgaataggttttggaagtatgagtaggagtttacaaggagagaatggaagaaggggaattacggacagaataacatggacggaggccggccgcggtggctcacacctgtaatcccagcactttgagaggacgaggccggcagatcacctgaggtctggagttcgagaccagcctgaccaacatggagaaaccccatctctactaaaattacaaagttagccgcgtatggtggagcatgcctgtaatcccagctactcgggaagctgaggcaggagaatctcttgtacccgggaggaggaggttgcagtgggccgagatctcaccattgcactccatcctgagcaacaagcgcgaaactccgtctcaaaaacaaaaacaaagaaaacaacaaaacaaaaaaacagacggaaattttattatcctgtgacaaacactgtatctttggtgaactcaaagtaggtttgcccactttcccacagattgttttggtggattaattttttgtttcagttagtgataaacttccttagctctttactgagtacaggtttactgtatgtaaatatgtataatattagattagtgcctggcacatggttagcactatcgatttttattagggactaggtctcaaacttatggtaattaagtagctcactttttcttttgggaagacgtaaaaatattctcaagcctaactcaagaccatcctttcctgtcttctagtcttgcccactcaaagctccatcctgcaaaagtcttaaacagtccatttcaaaagcccagcatttttaaagggtctaaggaatagcacaaaacaagatgcacccaaaacgtcaaggccatactggacaagggcaacgttagccatttttggtctggggtaattataggcagtatcttaaaacaaggcttgaaaaatgtcatgttatttccaaatcccatttcagaactttaaaaaaaaaatagcattttgagctcctaagaacgtttttggcggtaggtggccacatggagggtggcacagaggctcggcgggggagagcggaacagagctgggcgtggcagtgcctgcgagtcagcgccacgtaaccagaggcgctcgcactaatttgacctctaagagagactaagcgcagggaacagcgggtgcggacattacggcggaaggctctggaggaagcagaagtgaaggacctcgcagtcctgggacggtggggcacagagagagaaagggagccccgggcgcggcgcggtgaggatgcgagcagaggaaggacacgcggcgccgggtacctgccgggagcgccggatccaatgggaggagggcccgcgccgcacctcaacctggcagaggacgtcacgacgccaaggcggtcgccgggccaatgggaggccgtcgcgggcagggacggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggtgagcgggccgggatggggcgagcgaggctgcagggccggctgcgccgagtaccaggctccaggcctttgaaagcgccgcactccgccggcctcggctgggggaggggagcccggcccctgctcccggggtggagggcggtcggctgcgctgttttccggtgaggcctggtcttgcccgctcctttagggaaagggagagggagagtccaagaggagcccgctataaacgttgatctccggagggccaagatgctgctccgggatgggcgttttattgatcagatgtgtcttagagtagctagaaagactcatccctaccaaaaagtttttaacagaaggctgctaggaggctttttgtattccctgaggatcatcacatcggccatttcattgttgaaatagcttatgccaaactgcttacccaaattcaacttggcactgcctgtgctttttgccaaatatggattatgaaccatgactctcactttttaaaaatgtgctttggctagcaggaagtagcctttaggaacgcagaggaattagtctccggcagtacagcgtgctgcagcgatgtgggatgccaaaactacatttataagtaaaacagaatcctgtattttgtccttccctgaatagatactagaaatcaactttttaatctgttaatagaattagtccttagtcacttggcagcgttttaacatttctcccttctcccagtcgtgggctttgtcgtcatttccagtatctgctccctgaatcccggccagtgtggcactcaaacccccactcccacccaggccacatccagcccatctccacgtaactaatcttcccgaacattgaattctgccatcttgtcagaagtcgtcggtgagttgcctccactaatttcagtccagcctttttaggagagtgatgttcaggtttcttctgatctggctccagctcacctccaggctttttagccaccgctttcttgctcatatgctaaagggatatgctcatctgcaaaaaagaatgtgcttcaagagccctttgggacaggctttgtgctctcttgccagttcctccctaacacaagaccttttcaaagaaaaaaaaaaaaagacctggagtttgaagccacggatcaactcttcccaccttggagaaccagcagatacctactctctgtgaagacttccctaaaatttcttggttaagggtgatttatctgaccctttcctttcctttcctttcctctcctttctcctttttcctttcctctcctttctcctttttcctttccattcctttcatttctcctttcctttcctttttcctttcctttctcccttcctttcctttttcctttttctttgttgagacagggtctcgctctgtcgcccaggctggagtgcagtggccccgtcttggctcactgcaacctctaattgatcctcccacctcagcctcctgagtggctgggactgcatgcgtgtgctgacacgcccggctaatttttgtttattttttttttttttgagagaggaggtctcactatgttgccgagtctagtctcaaactcctgggctcaagcgcttctccggccttggcctcccaagtgctggtgagctctcacaccggtgcattgttttcgtgtttcatgttttcgttacatgttactttcttaggcttttccaattttctgttgtttttctgtgtaagaccgtaggatagaactttctgagagactgatcttggtttcactaagcaagaacatttgtaagaatcagtgctgtcccagatgtagtaatcgctattgagaaataatgaagttccccttactggaagtactcaggaagaagttgaataactaactgcctatgaggagattctgatatgggagggaatctgggagataaagttactgggaagtgaagattctgggagccgatttaatcctcacaacagcacgttaaacaggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatatcagctgttaaatacctttctggaaaaactggctgtaaaataaactcaaccaggaaaaaaaaaaaaaaacaacaacccgatttttaatagtgtctatccaaccttttttttttaagttgcaagggatccaccagatggaattaagagaactaagcttttatcatctgctggatataatgtgattttgtaaccattattggattggtgttggtttagacagtttattttcagctgactatatagttaattccgggactcttataaagttttttttaaaaagagaaaaagagaagatcaaaagcactggaactcaacgagtaaataacccatggtaacagagagatataatgcagtgatgtcagaggtgtacaagaagtgtgaatcatttaacatgtgaagccagggtctttagtccacttggggagagcaaagaggtgagtgggcttctccatctttttccttctgcctgccctgctacccccagccatatgcttaggagtggggttcccatttacactgccctgcttgtcgctcctggctcagctgaccctgcttgacatgtccacttcagtaattgaactgaaacgctgattgatgaacttaattcttagtgttcatcttttagccctgtcatttaccccagtatcacatttattttaaaacaataactattttggattaagttaattgtgtgagtgagagattatgaatatgtaactttgcaggtattttgttgaagttttagtcatattggaatttttaagatagaaatgatggtaggtgtagagctactaatatcctttttaagaagctaggaaaaatctagccatgcagaatgccacagtggtagaaacagtgtccagtaaacatattaaatggtcttaaggattcttgtcttttaaagttttatttaattttttttatagagacaaggtcttcttatagctcataactcattgcagcctccagctcctggactcaggccatcctcctgcctcagccttctgagtagctgggaagggatccttgtctttaaaactaggggtatggagggaagggtgggtataatataatatgatttttccgtttaatattttcatatattcttggtgattcattttagttaggcatttatttattattgtttattctaattttgtattataatagaatataattgtcttcttttcttccttttttttttttttagagacagggtctcactatgttgctcagcctgccctcaaactcctgggctcaagggatcttcccctcttggcctgccaaagtggtgggattacaggcatgagccatcatgcctggccttgtcttgtttttattttatatatataatatatataaaaaataatatataaatatataatttatatttatattatatattaatatattaatgtaattaatattatattatattaatatataatatataatataatattatatattatatataatattatatataatattaatactgtattatatataatataatattaattatattatattaatataattaattatattaatataataataataaataatattaatataattaatatatttatattaaaatataaaaatataatatatataatatatatatatttttttgtctcactctgtcgcccaggctggagtgcagtggcgtgatcttggctcactgcaaggtctgccttccaggctcacgccattctcctgcctcagcctccagcatagctgggactacaggcgcccgccaccatgcccgcctaattttttgtatttttagtagagacgaggttttaccgtgttagccaggaggtctccatctcctgacctggtgatccgcctgcctcggcctcccaaagtgctgggattacaggagtgagccaccacgcctggccttaattatatttttatgtaactttttgatactactcaagtattttttcctctacggtactcactatgctgaaagatttttctttcacatgttttctaaactatgtaatataagtgtcattggctatttttgtccacctgatggaggtaagaaatgatcaaagtacagtttaacagcagtattagcaagagttgagccttgctgaatatgtaagtttcaacggatttgctttgcaactacatgcagtagatgttttaagagggtaggtaggatatttaaatttaacctttttgtgccactgtgtgagagtgggcttctgaaaatggaggggggaagcatctctccttggttagtaggcattcaagtggaagatatgttataaaaacctagttgtatcttataggatgctaaaagcaaggtgactgaacttctaacagggcattctacattgagtatgtgcttttctctataattaggctaaaaaaaggttggtaagtaatatgaacttaaaatcaagattaacccccaatttacaaacccatgataaaaagtgttgttgattacttggatcctatcttttctgcagtttatgtttctagtgacttactcaatagttttttcttactctttccctggacagaatatgtaatataagaaacataagtcctttgagttgagggagatcagatagatttaataaaagtcatttagactttattgcatattctggaagtccaaagaagaatgactctggttgcatagcacttctaataaagccacaaaatcattacctgactcagtgcctgttcttgttatcatatttttactttatgttttggtatttcatttatttattacgtttcagctgtgagagtaccttctacaaaacattttaaacttttttctattttcattaagttgcagtcccactccacccagtccagcctcctaattctagcctttatacagctaagattgaggcaatcagttataaggacgcctgctcataattaccttctcagaaggtaattatattaatactgaatttatttagtggtatgctgtcatcaaaaaaattcattaaaaataaaatcaatgaaggccgggcgcagtggctcacgcttgtaatccctccactttgggaggccgaggtgggtggatcacctgaggtcaagagttctagaccagcctggccaacatgatgaaaccccatctctactgaaaatacaaaaaattagctgggcgtggtggcacacacctgtaatcccagctactcaggaggctgaggcaggagaatcgcttgagcccgggaggtggaggttgcagtgaaccaagatcgtgccactgccctccagcctgggcaacaagagcaaaactctgtctccaaaaaaaaaaaagaaactaaacacatttaataaatttcaagtgcataaatacattacaaaacaacattcataaaaataaacattcattaaaacaaaaaataattttattacaaaatattacatataaattctaatataaattaacaagtaacaataaagtatttaaaaatagtgaaaccattcacaaaaatacgtaatgaaaattaaaatactttaatgttatctttcgaaatcaggtttatctgtggtgtcattgtttaagtgcgtgcgtgtgtgtgtgtgtgtatatatatatatatatatatatatatatattttttttttttttttttttttttttttttttttgagacagagtctcactgtcacccaggctggagtgcagtggtgagatcttggttcacttcaacctctgtctccggggttcatgcaattctcatgcctcagcctccagagtggctgagactacaggtgcatgccaccacgcccagctgatttttgtatttttagtagagatggggttttgccacgttggccaggctggtctcaagctcccaacctcgagtgatccacctaccacgcctcccaagttgctaggattacaggcatgagccaccatgcccggcctaagtgcatatatatttttgggcacatttttacaacttttaaaaaaagcttttttttttttttgagacggagtcttgctctgtcgcccaggctggagtgcagtggcgtgatctcggctcactgcaagctctgcctcccgggttcacgccattctcctgcgtcagcctcccaagtagctgggactacaggtgcccgccacacgcccagctaattttttgtatttttagtagagatggggtttcaccatgttagccaggatggtctcaatctcctgacctcgtgatccgcccgcctgggcctcccaaagtgctgggattacaggcatgagccaccacacccggcccctaaaaaaagcttttttgacttagtagtgcccaggagacagttctaagcaaattgtaagcattttcttctgactcctttgtcttcagataatctcacctcttgtttgataacttattgagcaactttgtttctgtttttttgcagggacatcagtttttttcttggtagcaagctgtagattttgtttcaaggaaagcatcttcatcttctctagtttcatcatgtatagatggagattccgatgcaggtatctgtatcaatttcaatacagtcacatttgtgtttatttgaactctagaactagaaaaggaattacttttttctttgattttctttttcttccttctcttgaggatcatgaaagtataaaagaatactttctaaatgagggtgcctttttctttttcttttttttttttttacaatttttacatttggaattaaaattttaactagaaaagagtttttattaagcaagtttttttaaaaaaatcttaagttgttaatcctgctctcaagatgtaagtaaggtgtgtttcagacattattaaaatactgaaatagtggtatttgtaccaaaacactagtatctcattacttaccatgatatataacactgtataactgaatagtggaataccaaaattgaaattgcacactgcatctaatcctgtatgcatccaagtatattcttctgtgcctgtactgtctgcctttttcatgttttggacaaaactgtcatcctttgtgtacctcctctctgtgtccacgttcctattctcctccctcagtgcctttattctctcccttcccattgcttcctttgtatctgcttacacatgttcatatgtttctcttattttggaaaagaaagaaaaaggtcattcatttaatcttaacttgactattagtttcgttttctttccttccttccttccttccttctttctttcctttttttttttttttttgacagtgtcttgctctgttgcccagcctggagtgcagtgggcacaatcttggcacactgcaacctcagccttccgagtggctaggactacaggtgtgcgccaccacgcctggctattttttttttttgtacttttagtagagatggggtttcatcatgtttgccaggcagctcttgaattcctgacctcagatctgtccacctcggcctcccaaagtgctgggatgacaggcgtgagccaccatgcccagccatattagtttcttcagttttataaaccaaacttctaactaggggatttgctgctttttcactttactttagtatgttgttatctggcttcagtccttgccttttccttgaaattctttttttaattttaaagatagggtcttgctctgtcgccctggctggagttcagtggcacaatcatagcttactgcagcctggaactagtgggctcaagtgatcctcccacctcagcctcccaagtagctgggactacaggtgcatgccaccacacctggctaattttatttattttattttttttttttgtggagatgaggtctcactatgttgcccaggctggcctcgaactcttggcctcaagcagtcctcctgcatcggcctcccaaagtgctgggattataggcatgagccaccacaaattccattttttgaaagaatcttgtaagttagcaaattgctaaatccagggatctttttcagttctcatttgacactgttaattctctactgtttaagaatccatctcaggtgtatgaacttggcagaataatgaagcccgtttgacctcagttttcctgtattaaaacttaaaacagctcctaagtttttttgagtatcaaatgcaacaatgtgtctgaaaatatctcgcatctagttagtagcgcaccccaacctgacggtctgtgatgctttagttgctgcctggctcgaaatatctaagatagttttttttcctattttttttcctccctccaccttctttgaataaagacattctctaaggcgcattctttgaactttatctctttgccttatctgttggaaatctcatctacttgcagagctttagctgataaatttgggctgccagcaaccagatagagtacgtcctcacttaatgttattaatagattcttggaaatggtcactttaagtgaaatgacatcaatgatgtcattttaattcagtgttgtttcattataacattgatgagaaaagaaagttggttttcttttacatcatttcacttaaagttgcagtttccaagagcctattgaggacacgaaggctgtcaaccttgaggctacataccttgaggctgtcctaggctaaactctggtgatccatttctgataacctctttcaaaccttcatttgaaatgctttttatcaccccaagtggaatgtatatgaaaccaaaccccttgtttttattcccctttccgacataccttttaagagtactaaatacataatagcgttttaagagtactaatatttctgccaaccagaaaacctcaccaccatctttgattccccccatcccgcctacctttttttaaaggtctagtgatttttctttccattgtgtgcagaattttttccttctcttatttgtcttaacacgggtttcatgcagctgacctcctgattgatccagtggctgatactccccactctgccctgataattggtcacagtgccttgatggtgtttatgtgttacacaaaaatatgtaatgacttccctcttgcctctgagcttgtccacaaacataaagaatttcaggcccagtttatctttctcatcttgccccaaccattcttctgatggtttacttcttgttctcagaacatgcctatattctttcacattgtcagtacagaaaagaggtatatgcagaaaaggagtgatgtattttcaagttagccactccatgagtgactagtactgaatcccactgaaatcccactgaaacttcccaggaggcttatgaaatgaatcttagaaccagcttccatattggtagccctacagctattaacttcccatacttccaggtagtgaatgagtaaatacagagcagtgctttttggttggacctgcctgaagtcagtcacagcttacaagaaattgatcctccatagctggcataagatgttgggtcaggaagtttttgaaatggtacatagcatgtgtctataatggtgtgaaagttaaaaattccagaagatacagaagaatgtagaatgagaagttacgtctcttttccttttttgtattctagaaaaagtttgccaacccctgttctagtcattctggttcctttcctggaaacattcatcattaacctgtttcttgagacgtggtgtgtatttatgatacttacaccatccacatgtacacatacttagtatatactttttctcaacttcaaaatatcttaatgattttctatattagtgtatagaacattcttattattcttttagctctataatattccgttatgtggatctaccatttatttaactagttttctatcaatggacatttagttgtttttttctttctctttgttttgagacagggtctcactctgttgcccaggctggagtgcagtgatgtcatctctgctcactgcaacttgtacctcctgggctcaagcgatcctctcacctcacagcctcccaaatagctggaaactacaggtgtgtgccaccacacccagctacttttgtattttttgtagagacagggtctcactttgttgcccaggctggtcttgaactcctgggctcaagggctccacccatctcccaaagtgctgggattacaggcatgagccactgagcccagccgacatttagttattttgtctctttattacaaatgatagcattacatttatacatatttgtaatccgaaaaggtcaattccttgagtgtttctgtcttgaacttttttctgtaataggcctcccatactcattgcccacagtttgcattcagttttattgtagtgggtcaggatcattaagagctggagttgctgggataggcctttctcaagaggttctacttgagttggaccttgaggaatctggatgaagagggggataacgaaaaggaggtgggaagggaaaaaggactgtgtggctgaaggcttgtggttagcaaaagcctgtcatgctttcgagctgcactgcccagcactgtaaccatgagccatgagtatgtgtggctgtgagcacttgatatgtggctaatccagagttgaggtgtgcggtgagtaaatacctaccagggtctgaagatttaatatgaaaaaaagaatgttaaaatatctcagtagttttaaaaatattgcttataatttaaatagtagcattttggatatattgggttaagtaaaatgttattaaaatttttacctggttttacttttaaatatatggctaccagaaaatgtaaaattgtattatgtggcctacctttgtggctgcatgattttttgttagactctgctctggctcatccttcaggatggagaagcaggttcatttggggaacctggtatgtgcttcagtgagaactgttggatagttaccagaatcaagtatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcactttttaatcctgttaatattttaattaaaaaagatcttctatcttcacggtaccccgatacttttcgttttaagttcttgtcaccatgattggttgtatgattttggccacccaggaccagcttagtatgtaacaagctttatgtttatttttcttgtgttttgtgtgtaggaaggttttaagaatatgtagcatcgcttaatgatggggatgtgttctgagaaactcattatcaggcaatttcattgtgcagacgtcctagagtgtactcaacacaaacctagatgtataacctgctatacacctaggctaaatggtatagcctatggcttttaggctacaaatctgtacagcgtgttactatattaaatactgtaggcagttgtaacattttatatatataaaaaaacatagaaaaggtaaagtaaaaaatttggtactgtaatcttatgggactactgctgcatattcggcccatcattgatcaaattgtcatcatgtggtgcatgtctgtactcttaaagcaaattttattttatccctacattttacagaggaacagagattaaataatgtggctgaagtttcatggctgggaattataaaaccatgagactgtgtagctttgatcactattgtgtttgatttaaaaagtaaacattttgtgtttgagcttagagctaagtgatcataaatggtgtatatttattcctaaaatttttctgggatttcagatcctgaaattttatacaaacctttaaaaagcattttcaggaggaaaatgtgtcagagccaagttgaaatttgaaatgcccttttttttttttttaatataaggattcttaatattggaagagaaaggaagttgttgttttgagaagggggcttgctccatcacccaggctggagtgcaatggtgccattacagctcactgcaggaagctcgtttttaaaggaccgtcaacgtaggtggaaccaaaataatggagagaaagcaagaagcccttaaaatgatacttgcttaattaattaaactcaattcattgagagccagctgtcaaggcaacaaatactttccattttgttaaatttctccagtatttagctcagaggtctagtcttaatggtaatgcctaaatttttctgatctttactgtggaattttataatctttatgttatgtgttaaggaatgacatgcacactaagaatttatgattttattcttacctgtgactagggcctttgtaataaatctgtttttacgctgtccaaaattactatgttcttgggtttctttttctttatctcttgggtttctagagattcataagcttaaaaaattaaaaataagttattaggattggaagagacctttggaagtggtttatctagcccagggcgtctcagtctgggaactgttgacattttggatatataattcttggttgtggaagggctgtcctgtgcattgtaggatgtttagcagcgtttctggcctctacccactagatgccagtagttcccctttgattgtaactaaaaatgtccgcaagcattgtcagatgtcccctgggagacaaaatcgccctggttgagaaccgcttgtctagcccatttcctgggagtggtggttcccttctctggaactcagacgttgagaagagaagggtatttaccacctcctctagcagtctgttccaactttgggtgcgtctttggagacagaaatctctcctctctgttaagctaaaacctgccatctctaactttttagttctgcctcttaggaccgtatggattggatagattcacttaaaaactttcccaattattggaacatgataccccgtccttcctggtccctcacgggattgttttagagccaagtcagcaaacttcttgtagttgccatgtatttgcaggctaccaatctctgatgcataatcttcctttccttccctccctcctccttgcctcccaccagccttccctccttttctctttcttcttatttcttgtaacttcttaaaaatgtaaaaaacctttttttgctcttataggctgggttttggttcagtaacttgccatccctggttttagagtctgacatctgctaatcttcagagggcagtgcagtgctttagaactgtatatagaactttggggaaggtctgagcagcatagaataacgttggacttgtcattaactccttcatgcgaagagcttactgcttttttgaagctttgtcacatttacagcgtaatgacagccaagacactggtttgtctttttcattaggccactttaccttctttttttttgagacagagtttcactcattgcccattgtgcaatgggcgcagtctcagctcactgcaacctccgcctcccaggttgaagcaattctcccgtctcagcctcccaagtaactgggattataggcttccgccaccatgccactttaccttctaagatatttttagacttcagcgtaggacgatctgtgttaacagctgtattaaacttgtcttagctggaaccaactctctataccctgctgaggtttgtgggtcttactctgtccttcagagtgttaatgaaatttttcttagcttcccgtcgttcaaatgttttttaaacatacctgggtctttcatgcaagttactaatacaaatttgaatgagatgtagctaagaactaaatctgaaatcacaaatgcctaacaaataaggtaattttggccaagcgtggtggctcacgcctgtaatctcagcactttgggaggctgaggtgggtggatcacttgaggtcaggagtttgagaccagcctggccaacatgatgagaaaccctgtcttgactaaaaatacaaaaattagctgggcttggtggtgcatacctataatcccagctacttgtgaggctgaggcaggagaatcgcttgaacctgggaggtggaggttgcagtgagccaagatcacaccactgcactccagcctgagtgacagagtgagattttgtctcaaaaaaaaaaaaaaaaagggaattttaatgcatggatatagcaggtctgtactctgttcttaaaattgttttggagaattatatgtaaatctgcattatacatgtttagtatcctcaatctaaaatccacagtgctccaaaatctgaaacttgagcactgacatacatgaaatgctcaatggaacattttggatttctggattaggggtactcagctatgatataaatattccaaaatctaaaaaaatccaaaattccaactacttctggtcccatacatttcaggtaagggatactcaaattgtagcaaccatcgtcagaggttaccgtcgttactgatggctttcagagtgattagacagtaaataagtgtaatgaccatgacaagaaaattttcaaaaaaactaaatcttatttacgtgcaaaataaaataattttgaataatgattttaagaagtaactgattttttttttccagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcaggtgagtgtgcttttccctctcatgagttcgctgaattaaagggaaagcgtgttgtgtgacatggagtcactgagtcattaacctagtcttatgggaatttggcttacaccttatttgtggtcttccaaccttttccttgtgtatcctttccttgtgtatcctctaaaataattttgtaccccctctcgcatagttgtctgaaatttttcatcttcaatttaaggaattgcaaagatctaatttctgttatattgtgtaaagtaagacagttagggctgggcacagtcactcacgcctgtaatcccagcactttgggaggccgaagtggacagatcacgaggtcaggagttccgagatcagcctgaccaatgtggtgaaaccgcatctctactgaaaatacaaaaattagctgggcatggtaatgtgcacctgtaatcccagcaactcaggaggctgaggcaggagaatcgcttgaacccaggaggcagaggttgcagtgagctgagatcgcgccactacactccagcctgggtgatagagtgagactccatctcaaaaaaaaaaaaaaaaaaaaaaaagggagactgttagggtgtttttaaaatctacccagtgactctaaataccattagtaatttgatacccactatcaccatcattcctttaaaacaaatgtgaatatacttttttaacagttggaaatttacatttttttcttcctataatttatattttcatttacttcccttaattttactctaatgattataaatttttgcttcaaaatttattacaaagctggtccaagtgcaatggtgtatacaactaatcgatgacaaaccagttacagatttctttcttccttgtccacccccactgcttcactttatgagcctaaagaaatatatatatggatcaccccatcatatctacctgcaataaaaatatgcatttaatatcattgaattttcaaagatattgtaaatttctcctagtaaatctcttaagtgttaactctatgaattgagttgttatagttattagtactcaaagaaaatatattataaatttaaataatcattttaaaaaattggaaatacatctcttaatgagatgatagggctattttttatttatttatttatttatttttttttagagactgagtcttgctctatcactcaggctggagtgcagtggcatgatcatagctcactgagacctggaactcctgggctcaagtgatccttccacctcagcctcctgagtagctgggaccataggctcatgccaccatgcccagctaaattttttgttttttgtagagacagggtctggttgtgttgcccaggctgatcttgaactcctgggctcaagctatctttccaccttagcctcccagtgtactgatattataggtatgtgtgcctgcccatccttttaccttgtatttattttttaaatttttatttatttatctttttatttattttgagacagactcttgctctgtcacccaggccggagtgcagtggcatgatcccgactcacttaaacctccatctcccaggctcaggcgattttcctgcctcagcctcccaagtagctgagactacaggcacatgccatcacgcctggatacttattgtatgttttggtagagatagagttttaccatgttggccaggctggtctcaaactcctgacctcaaatgatcgcccgccttggcctcccaaagtgctgcgattacaggcgtgagctaccacgcctggcccctggcccatcattttacaatttttaaacattttatagaaataattttaagtttacaaagcagcaaaaataaaatagtatgaagaacacttatataacttttgcctagattcacctgttgttaacattttatcccatttgttttagcatttgtactcttatctaaataaaattgtaaatgtgtatatatacacgttgtttacatacctgtctatagtgtgtacatatacatacattatttataagctatataatgcacacatataatcacaacatttaatatatattatgtattgatacagtacttgaatctgtcatccatattttaattttggatgacctaatgtcctttcttgttttttgaaaggacataggctgggcgcggtggctcacgcctgtgatcccagcactttgggaggctgaggcaggcggatcacgaggtcaggagatcgaggccatcctggctaacacggtgaaaccccgtctctactaaaaaaatccaaaaaactagccaggcttggtggcgggcatctgtagtcctagctacttgggagactgaggcaggagaatggcgtcaacccgggaggcagagcttgtagtgagccgagattgtgccactgcactccagcctgggcgacagagtgagactccgtctcaaaaaaaaaaaaaaggacatgaaatttttaaatatttcacttgtgttatcagttttatgtaatttaagtgggtttaacagtctttatattattttgcctcaactgttaaatcatatgtgtttatttctacatcttctcttttatagctttatttagttttatagatttaaccactttttttttatactttatgttctgggatacatgtgcagaacgtgcaggtttgttacacaggtatacatgtgccatggtgatttgttgcactcatcaacccgtcatctaggttttaagccctgcatgcactaggtattggtcctaatgctctccctccccttgcccctgacccctcaataatgtcctttatatcagtgtttttcccttcggtctaggtcagatattgcatttagttatttattatctttttagtcttttaatctgaaatatatccatagcctttttttaaaatgttttctgacatcaacctttttgggagaattacagtgtatccctcctccctccaccccaggaatgggctgttccccattttttgtttgtctgatgtttcctgatggttagattgaggtaggcattcctgactagaaaactgcataggtgatactttgtctctccaagaatgtctcatctggaagcacatggtgtccatttattcctcattggtgacattaattttggtgacccagtcaatatttcttttctgtgttgtcttcccttgcaactactatctaatctgtagggatatacttaaagacagtacaaataccctcttcctcatcaaaatttctccaaagattttgcatcaattgatgattcttgcataattagatctttcattgatgcttgcaaaatgatgcttttaattctaatacttcttgcatattcaccagtgagccttggtattctactgccagcaagagctctccttcctttcccatttgtttgtctttttactagcagtacaaacttatggattccttttttcaatggtttataattaattatttaactattttgctgcttaaattatccgatgttaggccagtgagagcctctccaaactgtgtcctgtgtctttgtggcatgctcccatttgattttgctcctcactttctagtacaacaagatattacaggttcatcatgcacctgctctgcccagtcctggaactggccatttctcggcggagctttgaggagctttttaggggagaatggtattagaacccaagatctaggtgcaaggttactgagctccttgttactgagatgtctttgcctcttgtctttttcagtggacagagctagaaaatatatgcttgtatcctgtgtgtacacatacatatatacaaatatacatccatacatatatacacacacaataatttaaatacagatgtgcacacaaacataggtttgctgcatttctaaccatgattttaagatcttttcagttttgtaatgtagggaattatttacatacaggttatacatttacaggcagatttgtaagtgttgcacccgttttataaaaagagctggtgaattaaagagtaattgtatttttctttctttctttttttttttctgagatgggatctcactctgttgcccaagctgggatgcagtggcatgatcgcagctcactgcagctttgacctcctgggctcaagtgatcctcctatctcagcccctcaagtaggctgggaccaaggcgtgtgtcaccccgtcaggctaatttttgtattttttttgtagagacaggatttcgccatgttgaccagtggtctcaagctcctgggctcaagtaatccgcccgactcggtctcccaaagtgctgggattacaggcatgagccaccgtgcctggccagagtaattgtatttattatatgtatggtcgtgtcctctgttccttacatagttgtttttgtttgtttatgagacagggtgtcactatgtttcccaggctggttttgaacttctaggctcaagcaatccttccaccgtggcctcccagagtgctgggattatgccactttgcccagccaaatttttaagttttaattactgaatgagtattactgatatacttgtgtttcaccattaggatttgagttcttgatatagttccaagcatcattttttatataacttacacagatgtctttccttatcagtgggaaagagtggaactgaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaagtaagccatggcactgttgatctggaccaaaaaggcactcaactaggaataaacactctacagaggtttctcagtggccccatctgtgtgatatgcggggctacacaaaaatagcttcttttgctttgttctgttcttatacctgtctgtgatctgacttggggttggtgtgaatgtagtagagaaaggaagctgacagatgaatactgaacacaggtaatcagtttccttaattaggttgattataagctcctgaaaagcaggaactgtattttataattttacctgtttctcccgtggtgtctaggatagtaagtgagcagagcagtaaatactgtttggtttgttcagctgaggagaaacggaagaattgagactatagcatttgttgctgtgtgagaccagtggttcagaggggaggtttgggggtcacataaatgtagtttttttggagcatatttcatagaatttaaacacttagaaaagtcaagtgatttgtgtgctattttgatttgcttcctgtgcttactttcatttgtttattatttattttagtttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggtgaaattcttgtaaccaagctcagttgggctctttttactcatccttttccctttggttttgccaaaatgatgccgtggtacttgtcatcttagcttggttttcttatcatagaactttcttttttatagttgttgagaatataaatcagtataatattattgaaggccattttggtgtttaatacctaaagccttaaaaatgtgtagctagccgggcttggtggtatgcacctgtagtcccagctactcaggagggttgaggtgggaggattgcttgagcctgggaggttgaggctccagtgagctgtgttcgcgccactgcactccagccttggtgacagggagacccagtctgaaaaaaaaaaaaaagtgtatagcttttcgttcatgtgttacactaaagaaattgactgttgcacagactacttataattattgtaacttagtaaaaatttagaaacagcctaataatccagcagaaaattggttcagctgtttacaaatctctgtgtagctcttagaatattcactcttcaacatcatttcagtgacatggaaaaattttaaaaggaggtttacttttaaaatataaaaagaaggccgggtgccgtccctcacgcctgtaatcccagcactttaggaggccaaggtgggcggatcacctgaggtcaggagtttgagaccagcctgaccagcatggagaaacccctactactaaaaatacaaaaattagccgggcaaggtggctcatgcctgtaatcttagctactcaggagactgaggcaggagaattgattgaaccggggaggcagaggttgcagtgagcctagattgcaccactgcactccagcctgggcagcagagtgagatgctatctcaaaaaattaaataaataatatataaaaagaacaaaaaagacttaaggaaataaaaacattatttttatttcagtgcttatctatcgttgcgtactgctattatgggtaatttatttatttactttttggtaggggtggggtctcaccatgttgtccagccagttttgaacccctggcctgaaacttcctgcctcagcctcgcaaataatccttctgggattataggcgagagtcactgctctggcctaggtgacttgtttgtttctgtgtaggaactttttgttcaaaaagtcttagcccaagaatcctaagttctggagtgggaagctagagacctcagctcatcttgtagcttttactcttcagatgaagaacctgacccccagagagatcgggtgacttgtgtgagggagtaagctggctggctgtggccttcttcacagttgttcaatgccacttatttaaaacatgcccattggttttttattttttaatttttcttttgatgggaatagcaaggttttatatgaggcgcctgtcattgttcacacagatttattaagatttcatgtggagacggttgtggaatggaatactgctgccacttttcaacctctttttcatcttaactgatactatttcttatctgtgtttatatcagattctctttttataagagtaaaattgtttctaattccttggaactatcataaaagaacaagttctttaattataggctgtggtttaaaatacaagacagttgaaggccaggactaagatagatgggaaaggctattttgtcagggaagcctcaaaaatgctgtattttggggaaaaaaaatggaactctgattttcatttgattctcataaaacaaactttctttaaaaatatcactttaattagctgggcgtggtagcgggtgcctgtaatcctagctgctagagaggctgaggcaggagaatcacttgaaaccgggaggcagaggttgcagtgagccgagatggtgccactgctctccagcctaggtgacagagtgagacactatcttaagaaaaaaaaatatatatatatatacatatatatttatttatttatttattttatttatttatttaatggctgtaccctatattcttcttgatttctagccttttattggctctcagattgccagagttgggactcaatagtaagtaaccattttgttgaggtggtagtgattctaccagggtgagttatcatgacagcagaatcactgcgtttttctctctactctgtggcatagactctatgccatagagtgacgtgtgaaaggcttgaggctccctacctacgagacaccctggtccattctagcagtatggcacgtgctgactgggttttgagtctcttgctgtaaaatcacattactgcacttccctgcattttctcatccaaaaatggggattacctgctttgtggatcggtttgcagatgaaataacacacgcagggtatctagcatggtcccccacatggcacattcagtgttagccacacttccatactaactgccctgcggggatatttaatgagctcttaaatggcagaaatgttgtgtcttttcctgttcccttagtattcctatttttgttggtaatttttcttatgaaccatgcagttgtctagttcaggccattttagtatgcagttttatctttgcttccaacatgatttaatgttcccaaattggatttcacataatcctagtgtcctttgagacttgaattggttctaggccaaaaaagggtgagggggaaggaagaaattcagagtcaaatttggcaaataatatatccctgtcgttttgttttttctttttaagacttgggccaggtgtggtggctcacgcgtttaatcccagcactttgggaggctgaggcaggcaaatcacctgaggtcaggagctcgagaccagcctggccaacatggtgaaaaatacaaaaattatccaggcatggtggcccacgcctgtagtcccagctactcgggaggctgagacaggagaatctcttgaacccgggtgagccgagatcgcgccactgcactccactctggtcgacagagctagattccatctcaaaaaaaaaaaaaaaaaaaaaagacgactcagtatacaaataaagactggaaagtcctatattaaaggaactagttaaatactagtttattttacttaatctagtgaatttttaaatattttctttctttctttttttttttttttttttttgagacagggtctggctctgtcaaccaggctggagtgcagtggcacaatctcagctcacctcaacctccacctcctgggctcaagccatcctcccacctcagccttctgagtctgggactacaggttcccaccaccatgcctggctaattttgtattttttgtagagacagggttttgccatgttgcagaggctggtctcgaactcctgagttcatgcaatctgaccaccttggcctcccaaagtgctgagattacgcccggcctaaatattactttcaaatagaaccatcttcatgggtagcagtttataatacacaagtagaatttgggaaatgtagtcccagtcttccattcttcacagtggatgcttcagccagtttcctgtctctgcacacacactgcccgacagcgggctttcccttctccttcagagcagtagcagttccctttcttcattcccacccatcacagtggcagccccctctgccctcctgtattctgaatcccacccttataatatgcttagattttgcctttctcccagccgttttgtgagcattgttcgtgtgtaccaattttttctcatcctttaaaaagaaaaaaaaaaagccccttttctcaattgtacatcgcaaatccaactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggccacctcacttgctttctcctgtggacccttctttctctgtccttccttgaatgctgcctttgtccctcatgattatgctatcaacattcttctctttctgctttctctgtaacaggtttattgactcttttttttgagagtcttgctctgtcacccaggctggagtacagtggcacaatcttggcttgctgcaacctctgcttcctgggtccaagcgattcttctgcctcagcctcccgagtagctaggattagagacatgtgccaccaagtctggctagtttttgtatttttagtaaagatggggtttcaccatgttgtccaggttggtctcaaactcccaacctcaggtgatctgcctgcctcggcctcccaaagtggtgagattacatgtgtgaaccatccacccaccctgattcaactgactcttaactttaaaaatcacattggtcttaccatacatagttcatcaattgtgggagagaaacttgggtgtcatgctttatttatttattttttttttgagatggagtctcactctgtcacccagggtggagtgcagtggcacgatctcagctcactgcaacctcagcctcctggattcaagccaattctcctgcctcagcctgcccagtagttgggactacaggtgcctgccaccacacccggctaattttttgtatttttagtagagacagcatttcaccatgtttcagtctcctgacctcgtgatccaccctcctcggcctcccaaagtgctggcattacaggcgtgagccactgcacccagcctatttttctttttttaataagagatggagtcttgctttgtcacccaggatggaatttgtagcatagtagtgtgatcataactcactgtagcttcaaactcaggctcaagtgatcctctcacctcagcctcctgaatagctggaactacatgcatgaaccactgcaccattattttatttttaagagacgggatctcgctgtactgctcaggctagccttgaactcctggcctcaagtgatccttctgccttagcctcctgagtggctggctccactctgcttggctctgatatttttccataaagcctatcattcatttatcatggaggtatgttaattttgccttcttaatttctctcaaattcacctgctctttgcctacagtcatctgccccgatctggggcaacgcagtttcttcccagggctgttgccatagcatcgcagtggatcacccttccttcagtcttgttcccctctggttctttctctccactagactttaaaaaatttttgagatagggtcttgctctgttgcccaggatggagaacaatcatagctcactgcagccacgacctcctgggctcaaatgatcctcccacctcagcctcccgagtagctgggaccacttgtgcttgctaggatgcctggctaatttttaatttttttgtagagacaaggtctcactgtgttgcctaggctagtctcaaactgccaggctcaagcaatcctcttgcttcagcctcccaaagtgttgggattacaggcatgagccactgcacctggcctagcggatttctgaagcattaatctgttctgttactttccagctaaaaaccaacaagtgtctgaggacacagtttaaactccaagatgatagggtcctccctcacctggactcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtaacatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttatttcaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttatagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtgcttgtttttccttgtgtgtcatataaaattatcagtattgataggccaatttctaaagctgatgtaaaaacactaacatattaaatatttgagatatgcctaaagtagctaaacaggagccaggcattgttcgaaagcattgtcacccttacagttctgtgaggtagtaggtactaatataaggttaaaaaagaaaaaaactaactcacccaaggttacatggtagagtcacaccaggcggtttaattccagagcctaatgtcattcattatgctaagactacctcattttttcatggcaacttcagtcgtcaccctcgtttgagtatattttgatttgactactacttcacccaagtagcataacagctgctttctctcagccttttatattctagaatcatatgcagtaacattcccattaatagcctcactaaattgaaggacaattctacagaaacatccatgttatttgtgtgaggtataataggagacccagagcaattcaggtttatgagctactacaaaggtccacaatgtagtctgcaatttgaagagattgtgaaagaacccagttaatcatccagcactgtaggatgcagcaattgtcctacatggtaactctgtgaggaagatgatagctactactgtggagatcttaagaggagttttcagcttaaatgccaagttagaagtagcacatgttggtaaaaaaggtcatatttgtagttttctgctataggaagtatcaaagggtagaaaacaatgtctgtggattaagataaactctgtggttagacagtctatattgccttagattgtttgtttgttataaagaaagagtgaggaattctcactagtatttttttttttttttttgagagagtctcactctgtcgcccaggctggagtgcagtggtgtgatcttggctcactgcaacctccaccgcccgggttcaagcagttctcctgcctcagcctcccgagtagctgggattacaggcgtgcactaccacgcctggctaattttttgtatttttagtagagatgatggagtttcgccatgctggccaggctggtctcgaactcctgaccttatgatccgcccacctcagcctcccaaagcgctgggattacaggcgtgagccaccatgcttggcctactaatacgttttgtttgtttggagacaatctatctcactctgtcacctgggctggaatgcagtggcgcaatctcggctcactgcaacctctgcctcctgagttcaagcagttctcctgcctcagcctcccaagttgcagggattataggtgcccgccaccacgcctggctaatttttttgtattttcagtagagacagggttttaccatgttggccaggctggtcttgaactcatgaccttaggtgatccacccacctcagcctcccaaagtgctaggattacaggcgtgagccaccgcacccaaccgttttttctaataacaacagaaaagacaattcctcgtagggagtagctggcaccatcatcgtgtaacctcagttcaggtagcttggtcccattactagcttcatatgcgaataagaacagcatcgcattctgaggcaccacaatcttgtagcaggacataattcctctgagaatttttggtaagtcagacctaagctataaggtaaaaatcgctactgcaataggctccattgttgaataaaagaaagggaaatgtcattgatagtgatcttaaaatatttaatagtctttctttaaaatccaaaatgtgattcttacaagttatgtgccacatgaagcaggtgttattttttgagaaatgcaggtgataactgaaaaacatagcactgaggtattttttatttttaaaattgaaggaaacaaagtctggatctaattatttttacatttacaaaaactgctactgcttggctcttttgctataagtttaggttctgaatacatgacaagagtatgggaaagagcagaataatagtacacgcagttttaaaagctatgcacatcataacctggaataatgattacacagcaagaggcctgagtggaggtaggctaacaacacattttgactttctcctcaaaggatagctttgaaaaacaagtgtaaccaattgttacaccaaattaaaatggcaatattaaatcggtaacaaaacgatccacattttatacaatattgtatttccaaacatacataggtcatgaaaatcagagaacctaatatagcaccgttgaaaccattcattatccttcatgtgtgtatgcaattcagaatttcggcagaagacaacaaatggaaaatgcctttcgtttctataaatcattttggatttcaattaaatctttgccttagtaaagggtattcttatctcaagatcaattagccgtttttagctccaccgttttggaagtaaaaatgatgagctacatctactttttaatttaaaaccaagaaccaagcagtaaggacagcaatgtcaagaatatcacattgagaaccacacagaacattataaagaatttggtgcatgttttaacaactaccaactgatgttaacaatgaaaaatttacaaaggtaaaactttttttttttttttgcactgactggtttcaatacagcactgaatttaactcatctttgggcttcaatctttacatagagtgaatatgaaaatgccatactgaggccttccccaacttaaaccatagtaaagatttcaaaatcattccagtatggtctgaatggtaactgttctggctgacacatctttttttttttttttttttttaaaaagacatttcctggccaatttttttgcttgaagatgattgtctggttatacaagacatcaatctgaaggtaacaacttattttaacttaactactggcataaccattgccagcagtgaacttgcactagtccaagccaactcaaaaacacacattataaacatttgaatgtcatttttaaaagcgatgtcacagtttgtttcctaagaaatttaaaagcttttatttgaaaacgtatcttcagtttaaccctcagagttaagaaatattttttagatcattaaattcaattgtggttgacgtgctttaactaccgttctctaagttgtgtgctatacctagcctgtgggactccatagcttctctgagtcctaaagtggaggattctgttccaatgcttgtgagcaagaaggatcctcaaatgtctaggtttccaatattccaacactgctttactgggcagtgctgtgtatggaagttttgttttgttttcaaaggaccaagtaacttgacaccatattaaagacagcaaacattttttgtagaagtttacagcctgtatacattattccgccaaatttaagaactttaaatggattttaatatggatatgataatgacagccattaaaagatgctatttcttttactaacatttccccaaatgggcaaaatagaggcatcatgtgccattggttctgtcatactggcctttgactgtgttggggaagtaatcacacaaaaagtgcccataaaacaaagaaggcagcaagtgaaactagaaaaaggttggaactgtatgaatcagatttgaaaggagttatttctaaaattctttcttagatgacttgaggagggaagtgcaggggcatctggagttggcccctccactgccgtcctgaagtaaagtagattcagactgtccgtaaagattatcatgagagttggtgactgcaccccaaatcagagccagttccctaagaagaatatggtgcaaaacaaaacaaaccacacattaaatacatgacaccgaaatcactttgatgagaaaacagaacacacaggtattttaaaatataaataaatacatttagccatttttattcaagaaccccagagaactgctttaaaagcaattgcttctttgaacccctttctaaattctttcataaatacttactagtttgattgtcacttaatgcagcacctcagtgtttgctggtggtggtgatggaatttcacttagttgtctctccataaactatatcctattccactaaataatgtttccctgaggaaacccaggcagcttacaaaatactgttataaacactcacaacaaaacctgcagagtattttatttaagaaaaacaaggaatgtagtgttatgacatagggggaaaaaactatgcaaaacagtcacatggaaagaaagtattttaatttttaaaatccaagtttgcttaatttcttgtgaactgttcaacactgttttaaatatcctgaataactgtgccaacaaaattcatccccagtgtttccacaggagacattaaaattaaagaccaaattatactatttttttcctttaaccaaagtattctttttctcagtcctttttgtgcaaaaatattacaagagcaattcaaatggaaatgctgaaatgacatgccaacatttcagggcacatttaaaacactcagaataattcttgaaattattatattctaaaatgttactagcaatcacttttagattagttctgtacatctactcacacggatgcaattttcctagacctctgaaaaataaacaggctcattggtctcttttggtgtccacacaataggcaagataggtttacaatagtgtttaaatcaaactaggcatctacaatctcttgactccaccacattcaaaacaaaaatcaaagttcatttggctatcttgaaatcactcccataaaccaactacggttcactggacctaaacatttctcagaaatgtgtcattttatataatttcacctaagtaagtgatgatttggggatcctttagaaatggttaacgcctaagaataaactttatcaaaatgagtaattgcaataaagtgcttgttacatttcaaaatgatgcttttagactgtggtatgttgttttaaaagtgtgtgctattccttccgtaaaggatccccaggcatgagagttgggtcttctcacctgtctcataaagcagcagcactatcttttggtaggctgacaataggcacattacccatgcggatgaggctatactagtgctatggcaaaaggggaagtaaattagaaaagtgggaggcatgtagagggttcctattatagttatatacaaatatattaaatatactataaaaatagtcgattctattcctttgcaattacttcagaagctccttttagaagaaagctcacccaatccaaacttaaaaggttctctttctccaaacacttaaaatggcaagtgcctttgtgctgtttcttctctaccattcaaaaattccaatcagcttgtcctggctagaaagactcactcagcaacattaatatccagtgtttacccccttccaacagggactcctgtgggactaagggccacaggtaattggaaaggttatagacttgaatgcgttttacacaaatattcatcaacaaactttcaattaccaaagaaacagaaagaaaaaagcagaaatactaaagtaaaatgctatttgcattccacttttaaaaagtttgcctcaatgtagtggaaacatctgaaaacatgttgagtaatatccagtttaaaagaattttcacttgtctgcgtagagtactattttaaggatccctttctaaggcttcctgaacaagggttcttctcccttcaacagtgctcttgatggagctggactgcttcagtgctcctagcgtcaagcagactgctttaaggcaatgaccaacaactacagcacttctgaagaccaaacattttcactattttgcactgaatgttctataacaaactattccaaatcactggcatcttgttattactattccattcctaagccagatataaatgacaaaggagagcacagcactgtcaagttacccccggaatttgggatgctcgaaggctagaccgtagtatttactcacatgctacctgcatctcccatacttttctccaatattttccattcaaaaaatgaagtactttttaagtgtctcggttctggtttgacaccactctaaggagcaactttattaacccttctagttctcacttgcatttgttaaacaatactgactctcccaaaactatgataactgcaagtccaaagcacggtaactgcagagtagctagcatttttcctgaaactcagtagtttcttacctaaaaagtaccacccagaataagtgtttttaagaaagtgagaataaagcagagggaagacttttttttttttttttttaaagctggaaggtgtttctatttggtatctttaaatgctatagatttgggattttaactaacagctttggctatagaaatgaagaacagacactgctgaatcttcatttgaatgctcaagtttcatggggcagggtggggggcgggatagctttgcaacccaaatttaagagaatcaggaggaaaacaaagcagcaaagaggcagctggtgcttactacctcttccactactacgcttcagactgacagaaaagcagctagctgctcctttaaattagcaatggttaattctaagcaggaaaagatgagctgcgaagaacagtaagaatcataaaggaaaattttaattttttcccccgactatttgtggagatgggaaataattgaaggggctggagtaggacaatgtgagtaaacagtttagacgtttacctggggcttgtcttatgctttgttgctgtcaacctaagtagtactcacagttcaccatcttttaagtgtggtatgtagaggacaggcctcaatataatagttcttcatatcttttgttagctaaatccgtatcactaggtattgccaataaataaatgaggcacaactcagatatatatggaatggcataaggtcaagaaaggcaatttgaaaggggagaagaacaatgctattgccatattccacaacatcccccttgtctgtgtacatatgctcaggtacatacatattctgacaactattcttgatattcatgggaatgtgggaaatctctactggatggtcatttagctagaagagctccttgatatgttaattactgattgatatctagtcacacttcttttgtagaagggtaagtaccaattttctttggttgttttctttttcaacattaatgttcaaagtaattgtagccaggtagaattttctgcagaaagacaaagtatatgccttaaggataacagcaaagcagaggacagagaagtcttaagaactggcttagcattcccctgacctctttacctagcaattctgcattaggttaatcttcattattcagaaccttttctgttttaacaacctcaactctgttacacattttcttttgaggtcaattttgatttattacacttgtcctctcctccctttcctcagtaataacattttttatattctaataatgtattttctactaatcctcttttgttctatcactgtaaatttcattagtaccataaaatctgtaaaatgttttttaaatgtatgtaacttgtattggaatttattacttttagaatatgatattgccaaaggaaatcttagttcacgtttagaaggcatgtgagttacaatattctaatgttgtagtgaaggcatagccaaatccctaccccttcttttttctttgtaggaatatcaagatcatattgagcaaatatttctggtaaattcttaaatgactaaagaaaaatgctgatttaggaaacaattttaggatcacattaataactatgatagtgttaggttatcatcttttatttctaaattatttgtacctccagtccaagagactgatagcagtcttcagaggaacttattaggagactaataatgacactgacacccacatgctgttaaaaaggtactaaggtttcaaaactgctacggaaaccggacaatgacttcaagatggtgagttatcacctgaattaaaatcaaggcactatggggttttttcccctcaaataaccctgaatcatttctgactaaaagaagcattgaaattgtgaaggataataaaaaagatttcaacaaatcccaaaagttaaaattcccatgattgagaatgttaaaaagtgcctaagatgttttgtgtgcaaattttacctctataactgaaacattcttgaaattactttcaggcttgttgaaaaccatttacgcaaatatttccaactatgaactataacaaaatatgcaatcaaaactcccagccacctaaaataaagcagtgcaaatcctattttcaaacataattgaaaaataatgaaatgagggatatttctgaataacttgaaaatcctgttgtatcaataatttaacctgaaaaaaaaaatccattcccagcagcacatcatacctcactgaacaaactgtgacatcacagccaaagtatgaacaaaaaaacttgtgccccggaaaagtgaacagaacactactgtgttgtaaacaaaaggaaaaacaggatggatcagtttgcacatggtgtcagaatttcaggaaaggtgctcacacctgtaaggaagagataacgctttcatgcagcatacaaaatgttttgctttctctccttttatctagacatatacatatttttacatcatctgtacatagagaatttgaacccacacaacattctgaaagtaattactgttccatcattatctgaaaagggagaggggttgggggagggggtcgctaccaagtctactggactgtcttcatggcatcactgtaagcaaacccctgacatggcagtggtatgtcctctgtaacacttgataagaggcacagaaccactaaaagttactaacatcattagtgcctttctgattccctggaggtcatttcatagctgagcttcttaatatttggcaatatattctttttccatcaaaaaatatccaggcacctaaaacactgtcagaactggctatgcccctatgatcacctcctgctggctggtatttaatgtacatctgtagcactaggcagcattttctctgccaactaattccaggaactagaacactcaatactgcatctcatgaaactgctggaactttccctcctttcctcaggtcatctgagtaactcttaatgggccatccccttcctcccttgatgtcaagagaggaagcacgtgtgctactgtggttgaaccttggaagggtcgggcaagctgtcagtcctgtgccggctgagttgctgctgttgctgagactgatgttgctggtgatgtgactgagggaaggtgctctgttgtagaggaaatgcagcagagagaatgagttgagttgagggattcccatggagcaacctagaagtctaaaaaacaaatggattatgcagcattgctttactccctttatggcacccacataatagttactcacactctcccctgtccatagggacaaaatccttaaaattctacataatgcatatcactttcactctctggtttaaaaattctaatttggaaaatgcttatgaggccttccctctttctgaaagtatgagagagtttcattttttaaaggaatctgagctacagattttatggtatagaaagcaatctatatcttgagccaaatcacacacgttctttcactttatgtcctaaagacccatattttaaattacaaaatttgagcatagttatgactatatgaaaaacaaatactctgaggccagacagacaatgccttctgcacacaggttcgctcagctggttagagcggcacagttaagtggccaggagcgtggtgggccctgaggtagactgaatggttcaaacttgggctgccctacttaccacatgtgtgacttggtcaagctgtttacttctctgggcctcagtttctttctttagaaaataggaataacagtgcctaccacattgggttcttaataaagattaaatattaatattatttaaaagcatcataaatatgaaggcaaagttgcagccttaggtccgataagcagcagtgtggtataaagacagacaaacaaaacaaaatgaaaaaaggcacaggatttgcagacagaagccctgcatttgagttttgctctgccatttacataagtaagctgtgtgactctgggcaagactcaaatagatgagcctctgttcctttcaccaaatttgtacttctgacatgctgttcattaatgtaaaactctcagatacaaaaaaatgttaacagaaagaaagtgaatttttacaatgaaagtcctttccccattactgacagtacaacttgatgcagggttcttaatttcaaaatggagctgtggtgggcaatttttgcaaatgtatatgaaagaaacatgcacaaacacacacacaaaagagcaaatccctgacaaaccttaaagactactacactttgtcaaggatcttcagagttttctttctctctttgttattaggaaaagctgtgtaaggcaaagacttgatacttatgagccttataagattacaacaggagcatgttttaaaactaggtattacataatttagaaaagccaaattgtgtatttattacctacatacaagtgtatttatgaggggtattgcctatcttatttctttgtgggtcctatgtctttgggatgccttttttttttttttttttttgagaatgtttattcttttaagggcctttgttccttgacatacttagaagactgagatgttaaggcaggtcctctcctttttttagcttatgcttaattctcattggatacattttccctacataataatttagaacttgttttaaattgttgttatttctttatttgtaatagtagctaccccagttatgtctgcagcataggcttaaggtctaaaagactgtatgactctcagatatttaggcaactagcctgttttagttttctacatcacaaagacaaggattatatttggaccaggacacaaagggtgacaaattaagactatatttatgcctgaatatagagtacaataatcacatcacatgttatataacccagaaattgatgataagtgcccagcctagatgaagtggtctctagtacacatacagactagcctacattcaaaattgctccagctaggccagaaggggaaaaggtagatttctagtgaggatcctgaggtccagataagggttttgtacatttctctgctgaggatcttgcctagtgactttcttctgtatcctatagataaggagagcctgtctgattcactaaatgatatctgtgtctatattttggctaatccaagtgtctattacatttgtcaatatagcggtcacaaataacagctagccatgtgccttgtcttatattcagtgatttacaagcactattaatccatgaggtatcaattattatgacctccactttacacgtgacgtttaccaagagtaagcaacctgccaaaggtcacgcagtacgtggtgcagcagtgactcaaccccaaggcagctagactttacagcccaagttcttagctatacatatacttagctcatagatatactacacctccatggtatttctcctctgatattaatttacaactgaaaaattataataagattgaattcaacaaaataatttaaggtaacacctatactagtaaaaagaaatccctgctctgtacagagcagagtttatggttggctagaaaaaggaggaaagaggtgcttgcttaagttccagaaactctagccagagactaagaaaacaggtgggcaggaagtaggccactcactctgtccagcagttctgataactgggtatgcccaatggcacgtctaaagtcttccaacgactgagcaagggaagaaaaaaaatcgccaaccagaacaagctttctatctttgtagagatttaaactgtacaataagcttttgtgaatttttcacatcactcacaaatctgttcacttaatgcttaatttcattacatgaaagtaaatgagtttgaagcagcttccccatggggagaattacctgtaaaaattgttgcggtggctgggtcagctgagcctgagatggttgctgaactgaagtgagctgctgctcctgggagctctgctgctgctgctgctgcgttactgacaatgtctgtgactgttgctgttgtgtagcaaaagtaggatatgcagtcaccacctggcccataagcatagtactaggtaccatgactgccccacaagctacaggagcagtcactaatttggtcacaagttgttgaccttgagaaaatctgttagaagaaagaaggaaaaaaattggagtccaaagtacaaggtatacatcataaaacgcagtggagtaaatacttacctaagataatacccaatgacattgccagtttgtttttcaaggtctgtatattcctactttgtttcattttaaaagattccctttggtgtaacagtaaaacaaaaaattcatacagcaagatcaatgtgtaacaaaaatacaaaacgtctttggatatccacattcaaaagaataaagttagatccttacctcacatcacagacaaagattaacttgaaatggaccaaagaccaaaacataagagctaatgctataaaactcttagaagaaaacataggggaaaagcttcatgacattggatttagcaatagttagcagctggaattagcaataatttcttggatatgataccaaaagtacaggcaacaaaagaacagataaacagataaactggactgtatcaaattaaaaatcttgtgaatcaaagggcactatcaacagagtaaaaaggtaactgtcccatcccacagatgggagaaaatatctgcatatcatccttctgataagggattagtaaccagaatgtctaagagctccttcaactcaacaacaatcaacccaattaaaaaaatgggcaaaggtcaaacttgaacaaacacttctccaaagaagatacacaaatggctaataagcacatgaaaaggtgctccacatcactaatcattagggaaatacaaatcaaaaccacaacaagaggctactttatacccatcaggatggctattataaaaaacaaacaacaatagaaaatgaccagtgttggcaagcaagtagagaaaccttgtgcagtgctggtgggaatgtaaaaatggtgcagccactatggaaaacagtatgcagttcctcaaaaaattcactataggattactatatgaaggaattccacttctgcttatataaccccccaaaatgaaagcagggactcaaagagatatttgtacacccataatcataagcagcattattcacaggagccaaaaagtggaagtaacccaagactccattgacagacggaatgaataagcaaaacatagtagagtagaatattacttagccttaaaaaggaaagaaattctgacaattgctgtaacatggatgaaccctgagaacattatcctaagtaaaataagccattcacaaaaggacaaatactgtatgattccatttatatgaggtacttagactagtccaatttacagggacagaaagtagaatggtggttggggagagaagaatggggacttgtataatgggtatggagtttctgtttgggaagatgaaaaaagttctggaaatggttaggggagatggtaacaatcgtactcagtgacaatgaactgtatattttaaaacggttaacatggtaacttttatgtcatttgtatttttccacaataaaaattttttttaatctataaaaaaaaacctttttctttttataaaattactaggtactaggggtgtcagatatatgtggcacatgattcatctgctacactggcacacagttcatgaataaacaaagctattataatgtattttttaaactctaggtttatagaagaaatttacacaaaattgtagcttacaaatttaattcaaaaccaaatgacattctaacagtgaataaaaactcctctcaatttataaattcatcaacgcagcatagcgtcctctgtgctagaattcattaatttttccctctttccctgcttccttttgctttttgaaatgaaagaacaataaccccaaaaaaatgatgcttctttgtggaacaatattatttccatttgccttttctgtgagatgaagtttataacattggtcattacagtgagatatgacactaacatagatgtggcatgacataactgtatttacaaactgtttatgtaacaatattacacttagtacagatcttgacaataaaatactctattttatacactacacaaccaaatactttaatgcaaaacaaaaaagaattaaaattgtccatattaagaaagtccaaagaaataagtaatatttacaaagtacacttagtcacagaagtactaagtgctgatttctccataatcttaaattaatacctgaattagcccatggctcactggtaaatgtgataagaatattttctttaatctgctttcgtgtaactcacacttctgcagctttgtatactctgggctccctctgcccagaatgcctccctagactccatgccacacccacatccaaagccaagctcaagtcttgaagagtcagggcaagtatctctgccttggtgaagctttcctgaccacacctttattcacctgcttgcctcaacccatgaaactgcttacaaaaacaaaacaaaacaaaacacaacacaacaaaaaactgctcacttcctcctttctaaagacctctgaagtattcatcaccccaaacaataccgatttatctttctattgcttttactagtttggtctttcccttggggaaggaacgatgccatactcatctaggtaggccttcaaatgtttgctaagatgtggtttctgtccccctcaaaagatagatgttcagggaaactcaacttaaaaccacaattaaatatcaccttacccagccagactggccattactaaaaagtcaaaaaacaataatgttggcacagatgtggtgaaaacacttacacactgctggtgggaacgtgagatttctcaaagaactaaaagtagatctaccatttgatccagcaatcccactactgggtatctacccaaaggaaaagaagtcactgtatcaaaaagacacctgcatacatatggctatcgcagtacagttcacaattccaaagatatggaatcaacctaagtgcccatcaaccaatgagtggagaaagaaaatgtggtatgtatacaccatggcctactactcagccataaaaaaagaaaaaataatgcattttgcagcaacttggatggagctggaggccattattctaagtgaagtaactcaggaatggaaaaccaaacaccatatattctcacttgtaagtgggagctaagctatgggtacagcaaaggcatacagagtgatataatagactttggaggaggatggtgggggtgagggataaaaaactacatattggatagaatgtgcactactcaggtgatcagtgcactaaaataagttatagatggttgtttttccagagcagtccacaaaaccttcctgtaatatatgcttaagcactcaagcactgaaatgaagacaccaaggtctgtgttcagagttcccttcctcatcaccttaactagctatagatcccttggctaattactgaaaactcacttttttcttatctgggaaataaaaggaggccctcacatacattttcttttaataaatgactatttgagataatatattttgagcatttaacaaacttaaaaaaggtaagctaccctaaccactgttactacatggaaattctctagcatctatattgaaaagacaaaagcttcacagtgacacagagcctgtcataaaccttttctaacagtgtgctgcagaatttgtattctataatattttgtagcatatttttggacaagaaaaaaaatttgttgttaccctttaattatgaagtctttaaacaatgaatacattcagtgtttttatttcaaatttaagaacattggctgcagtgagcatctcattaaaatcacattaaaaaatttgattaagaaatcaaattattgttttctaatcaatcggtttacaattttaaaaataacaaatgaaatatgacaactaccttatctgcctgtcctgagtgaatgtagttactgcagcactctgggtgctgttttgtggcatactagatggaatctggaccatgcttccggctgcaggctgagaaatcaccatagtgttatacagtggggctgtaagagtgctctgtgtctgactgggtagagatgtttgctgactgtgcccactcagtacattttgttgactctgttaaaaataaagagattttatagacagattaactgaaaataattatttgggaagtatgctagaattcatcattctaacaatatgacaatatgacagagaaagaagtggcaggatatattactctgggggaaatataaccacaaaggaatgactcgtggtaactgagaatgaattagtcttgaatatcttgctggaaggcaagctatgactttagaaaggagtgtgattgtaatagagatgatataaaatatactcaaagaatttctgttaaatgcccaaagtgaatgactaattagtgggcatttttctatttttcatttaaatccttgggatttacagtcacagatctacagtaattaccaacattttctggaatattcaataaaccattatgccccctcccccaacagtctattctgcacatatgggaacaggcttcctggtcagcctcttgagcaagtcataccttttaaacacagaaatagtctaagttacaagaacttggtataactactagactacatctttaaacagattgtgacatattttaaagctcagccaggcgcagtggctcacacctgtaatcccagcactttgggaggctgaggtgggcgatcacctgaggtcaggagtttgagatcagccaggccaacatggtgaaaccccatctctactaaaaatatgaaaatcagcctggcatggtggtgggtgcctataatcccagctactcgggaggttggggcaggagaatcgcttcaacccaggaggcggaggttgcagtaatctaaggtcacgccattgcactccagcctgggcaacaggagcaaaactccgtctcaaaaaaaaaaaaagaaaaaaaaaagctgaaaatatttgatactaacatgatttgcacaaaatattttaataatcactctcaatactatactttctaaatactattaaattttgaaatgatattttatcattagagctttatttctgcttcagcaatagtgtgccttccaaccactgatcactccatagcccgctgtgctcagtaacattacctgagttgatgtactctgtaaagtctgttgttgtatcatgtgctgagttgtgccaatgtgtccagtattcattccactttgaatctggttagtaggaacaacttggccttgcatatttataggtgcaagttgctggatattagatgaatttccagaagaaagttgaacggaaccaaaattcaacccaggatttgattgttgcaaaaacatctttaaaaataaagattatgttaaaatgagctttgtagattgaaaagaagaatgagcattaaaaagaaggcaaaatcaagctacaaagtatgtttaaaaagcaagtaacaaggctaagtcactttgaagaattagcaataaataagtagtgaataaaatatgaaactttatattcaatctttcagttatcttgtttccaattgttagaaaaagtgtaactagtgttagtctgtggattgacagctctgtatcacttatcatttataatttataacatcacacagaagtagttttcactccaagtttccctttaccaaagtcatagtctcctagagtggtcctgctggttggtcatataagactaatttgaatcatacatactggtatcttaataaaaatattactgatgattgatttataaattctgtacccaagatgtacctaaaactttatgtaaaatataatttttatattatggattcaaacttactaaaatttggactggtaaaaaaagatgactggagaaacaaggatgttgacagaaataccctcagaaacaaattatctttagagactgtaagtataatcatactgagtaggtaaccagtgaatatttattgaactgaattgataaaacgtatctcttgcatctcacttttaattaagaaaagttaattttcctagaaatccaaaatgtgaatgggatgctttgtttgtattcaaatataacaattacctgcagcccctgaccatggaccatctgaagttgttcttgaatttttcttagttcttcttgttgccgatgaatatttgcttctatcatgcgtgtccgttgttccaattggtctttcagatgttgcatggctcctaattgagctgaaaactgaaactgaagtaccatgtacggaaaaagtgtaatatattttagaattacttactccttataattgcacaacatgaaaagtaagcagtataacatgagtgaaggatgataacatccttcactagttatgtcccttagtttctaatccacccatctttgctctgctttgtaatattggacctggaccttcaaaatatttctcctttgccagcaggcacaaagttatccacatcagtaggtggtgctggagggacactgccaagaaagtgctcaactcctggttctggtgcttcttgctcttatgtcagggtgccaacgggaagcttttaatattttctcaaccacgtttaacatatgatatggtctggttattgttaatttctgaaatcaaagttgtgtgccctgaaatgtaatttagtatcccaaatacaaactattgaagatagagttaaaaagctttggatgggaaggacatttctcacttttacatacacctgccccggcaggtggctttccagcaagtctcaatgacatcctagtgggcagcttccctgcaagctttaccagtaccccagctgatggcttccagctctctacctctaatctgtggcatgtcagtgaacttctctattatccagttgctatagccacatttgccccaagaagatctgcatcttagcctggcatgggggaagaggaggttaggagcttgtggggagtcttctaagtatgttccttccttgggtactctccatctaccttacagctagtggttgctctctgcatctgctatttctatattcttttttttttttttttttttttttttgagacaggatctcactctgtcacccaggctggaaagcagtggtgcgatcatggctctctacagccttaactttctgggttcaagagctcctcccatctcagcctccccagtggctgggactacaggcatgcaccaccacacctggctaacataaaaatgtattttcttgtaaaaatagggtcttgctatgttgcccatgctggtcttgaactcattggctcaagaagtcctcctacttcggccttccaaagtgctaagaatacaggcatgagccaccacacccagctttattcctatattctttaggttctctttacttcttttaggagttaatccgtgttaccagttaataattttttatattattcctgttcaaatttctggtatgcttctggcttctgactggatacttgactgattacacatacaccctggatttacaagacctgagctcatattgtggctaccacttactggaaaaaaatttaacttcttttttttttttttttttttgagacagagtcacccaagctggaatgcagtggtgtgatcacagcttattgcagcctcaaccacccaggctcaagcaatcctcccacttcagcctctcaagtggctgggactacaggcatatgccaccatgcccggctaatgttttttttaagagatggggtctcactatgttgcctagtctgttgtagaactcctgagctcaggcaatcctcccacaagccaccatgcccagccttatttaacttcttagcttcatttttaccccttaacaaaggaaaaagtagtctgcacctggagttaatttgtatcaatttctgtcatccctagaatgccctctatgtgtacatgagtagaattacccaaagttgcaaaaatctgacagataaccaataatattttcacttttatcttcaatggaaactatcctcagataagtatagaacatgggcttttaaagactaggcaagtatgaatgaataaacgcatacatgaatgaaaataaaattatattttcaatcttatttctctgttttacttgagtcatgagcagctcctattttcttctgcttataatttacccacatttggtgattcatctcttaagtctatacaggctctttaattattcccatgaattttcagtatatgatacagtataagagcagaaagagtttcactttattggaaggaaatctgtcttaaagtagcctcttacagtgaactgtatgtaaaagtgagaaatgtcctccccatccaaagctttttaactctatcttcaatagtttgtatttgggatactaaattacatttcagggcacacaactttgatttcagaaattaacaataaccagaccatatcatatgttaaacgtggttgagaaaatattaaaaatttagtacctcaactccctcaagtttttttttttgtttttttttaaatattagtcaaaatgttataattatggccgggcatggtggctcacagctgtaatcccaggactttgggaggccgaggtgggcagaatgcttgagtccaggagtttgagaccagcctgggcaacatggcaaaaccctgtctctactaaaaatataaaaactagccgggtgtggtggcatgtgcctgtagtcccagctactcgggagactgaggcgggatcgcctgagctcaggaagcagaggttgcagtaagccgagattgcgccactgcactccagcctgggtgacagggtgaggcgtcgtctcaaaaaaaaattaaaaagttacatttatgtcatacaaatgttattttattataactaaagttatttgtacctttggacaagcattatattgatagcaatatagcacttaaaggatttctatcaagtacaaaagaaaatagtaacaaacacagaaggtaggataacaggaagtaaaaccacagacctaagaggcaaagcatttggctttattggtgaacaaaatgtgagacatgaatgcttactaacatttttgacatagtaggtatcctttatttcatgaaaatatccccataacatgttaagaaatgctttagaatcctgagattaaaaaactaataatatagaaagtatgtatctcctatcatatatgtatgacttaaattaaataaccatataagatggagctatttttaaaaatattgttttcacctattattaatgatcattccttgaaatcaagacctgctaagttaaggtatatttaatgccaaacaaaacagaaaagttgaagaaaaatactacttctccatagtatttttaatgtgtttgaggcactgaatgagtacagagtcataaattacaagttgggaagttaggctctaaagtaacagcatcactcttggaattactcccccttttttttggctactttccacattcaggcctccttctggacttaggccaagaaacaattctcctagaaagttttccttcacttcctcaggttgcattaaggattcacacaatctgcttacatatcaacttacatactttcagcacaggcaatatagcatggtattgtaggcatctgtcattccctctagatgtaatggttttttagttcatatatttgtactgtcggcatctgcaatgcctgttacacacaaagaactcaataaatatcaaaagaatgagtatacaaataaagttactcaattcttccaatattcataggaggaacaaaatgaacagctacatttcatccttaatatctttatgtctacagtgttcctcaatgagggagtgttatggcatattaggcaggacaattctttgttgtgcaagactcttatgcatcctgaaagatatttagtattcctggaccatgctcactaagggccagtgataccccacaatcattacaacaatcaaaaatgtccccagatatcctaaatgaccccagttaagattcactgcatctgtaactataattatatatgtgcgcgcgcgcacgcgcgcgtgtgtgtgtgtgtgtgtgtgtgtgtgtgtgtgtgtgtgtgtgctcctacctcagcctcccaagtagctgtggctacaggtgcttgccagcaagcctggatttttaaaaaaattacattagcttaaaagcaatttatcatattcaaatacgcaactgaaacaaaaaccaaaaagtacctgggacatgccttgtggaattggtaaatttgtagcttgagacatcactggctgtgttaatgatgaaccaacagactgggaatttatggactagagcaaaataaaaaataacactgaagtgattctcattcccatacatgagtacttccagcagaaatatcaatatgatattcgtattaataaacttaccatttgcctcatacttttgttagctgaatacagctatgtcttctcatctatattggaaaggcctgttccctatttatcttttattttccaaggaacttcctacagtaccttgaacaagctctcaataaaagttggccagacttaagacaattggtatttgaacttagacataaaacagctatcaattttgagctttccacaattaaaaaaaaaaaaactaacattttacttgaaaaataattagaaggaccaatacatatgacaaccacttcatacaagaaaaggaagtcttaagtaagtgtcacatatcagtaactattttgatctttacaaagaggggtgacaaatagatgaatttctgaagatttagatcatttttcccctcttaataaatctttattcagaagaatatccactaaagagcttacctgactactaaatgatgaccttctttgcaccatcttctcatgagctggtaaatgctgcctgggtggagtgctcgtatccgtcgggatcttggttggtgttgctgaagtcaacaaaatcagaagagcattagtactttataaaatatagtttttaaagattaatctcaaaatgtatttcagttaataaaaatggcttttgaattatttttccaaaccattcaatgaaagtgaagtccatgacagatgattcaatgtagttacttctatctttttatgagcacaaagaaaatagttgaaataggaaaattttaaatacaaaaagtcactaatttaatgacaattatacaagtcttcaaaaagagaagacaataaaaaactttcaaaaagcaaacctaagaacacttactggccctacagtaaaaaaacacaataaatagttgcctttctttttgagggatgattaaaaacatcaccatcaccattaccacctacacattttaataggctacttgaagaacttaattctttgctgaaagtgggcaatgtccctttaactcactggaaaggttactacatttcagaaatgtaaaaacttataattttaaagaagcgtttgatgagaaatgctgatataagtaactaaaagtttagttagttactttaaaggaagtctgctttgaagcaagggtactcacaggaagggtctgagacggccgtgtgagatgattttcttgaactccgagaagaggcagaaggggttgggctgtgatcaaacctttccaatgcttccttgagactgactgtgtttatacgattatctgacccagaatcttggctctatggagacagagtaaaataaatgttttcttgtggttcagttcagagatctcaaattcacaatactgttaacaacaacaaaaaaatcagtttttgtctataacaaggcaaaagtacctgtatgtacatacacatgtaaagaaatgaaaatttatgtgttatagccagaaagttttggcttcattttctatttaaagaaagagaagaagaatgaagttggaatctcttacaccatatacaaaaattaactcaagaccaggtgtggtggcttacacctgtaatcccagcactttgggaagctgaagcaggcagatcacctgaggtcaggagtttgagaccagcctggccaacagggtgaaaccccgtctctaccaaaaatacaaaatttagccaggcatgatggcagatgccttgtgatcccagctactccggcggctgaggcaggagaattccctgaactgaggaggcggaggatgtagtgagccgagatcctgccactgcattccagcctgggcaaaagagcgagactccatctcaaaaaaaaaaaaacattaactcaaaatgaatcacagacctaaattttaacagctaaaactacataactcttacaagaaaacataggggagaaagccaggtgaatgcctgcggtgccaactacccaggaagctgagaagagaattgcttaagcccaggagctagagtttcatagtttcatacagcgacactaatctttcccttcaccaatgtttctttctccatcagctcattctcatcagtatacaaacatgctgttatttctctcaacttaaaaaaaaaaaaggcaaaaaattcctttaagcccactttcccttcctaccactgccccatttctcttctctttgtagcaaaacccctccctattcactgtccctaattcccccatcctggaaaactgtcttttaaaccaactctaatcatgctttcacccacactgctactccacaaaatctgttcttattgatcaccaatgaattaaatgttaaagttaatgctcagttctcaacactcatctaaaatttaacttatttcagctgaatctgatacagctgatcattcactcctcactgatactcttgtcttctaagtaacttcctggttttattcctaacttactagctattacccccctgttgttgattcttccttgtctccatcacctcttaatattggagtgctccaagacacacccatccctttggtgatcccatcaaaattcatgattttgaaaccatccacacattgaagtttctcaaaaatatctcagaaggacctcgtccctaaaccccagggggatcatgatgctggcagtaaatatggtgggaaagtagacatagctggtgtgtattttggaaacagggctaatttaggatttactaggattgaatctttgcataagggaaaaagaaggataattaatctctgtattacttcagttttcataatggtcccctaatcaaggaaccctagattttaagaacttttctcagaaaataatgtcttctaccaaaacatactatgtcctcttcttctaaacatacaaaacctctttggaaaagttctttcacgtgggatccatgaaagcagggaagttgtttgcattattcagtgctgtattcttagcatctagatccatgccgggtagaaggtactttataacatttgttgaatgactgaatgacatctaccatattgtcccctggaatgctgcctatttaactcaagttttatatagatttttgactcttttcattctacttattttctgcaggtccaaaaatactgtggtaggcaatttctgacatggctcacaattcctgcctcctgatattcatgcccttgcataatcctcccatcttgagtgtgggctggatctactgatttccttatataatgcatagaatagacaaaagtggtgaggtatcaatcctgtgattaggttacaaaagactgtgacttccatcttgcaggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaattttggagtaagttgttacacagctatagataactaatatactatacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccccgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatactgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatctacctacagttttccttttacatgactgacattactacataaatgacagtaacaacttctgctgtaaagcacaaaatttatatcaagacttatatatctatatcattcctatatttatatataatgcctataagtaaatttaataatatattgaaaggatctatcagcaattgagaaaagagcactttgtagctctttaacaacttacgcataaaagttacaatgccaaaatcatcataggatgttacagtaattcagaaattctctaaaagaattattaccttactacagtgtgagtacaaacaataaactctggccttgaattccactgatggtaagtgatataataatgagtctgaagccaaatccactgttgccccttagtcaggaacctataataacatgatttgcctttcccatattgcattactaaaaggaaaatagagaaatattttttctttaattcatattatataaagattgttttttaaccaaaagctatcatttacatttaagtttacacatactattatttttctggccttttgataacatatatgtcaatatgaaaatgttattctttagagctagtttaaggtcccaagcaattatcagatctacagtgcccaattcacagctagtcactgctgatcttacaatctttccatacacaattaatacttaagaattcacactgctgacttcctcctgcctagatatacagagggtaataacaataaataatcacccctgagttttttctcctaactactctggcaggcacagaatctttgaagcatttaattttaaaccttaactaaccaaaatcaaagtaactgagtctgaagtaactgagtgcagtaactgccaaaacatgtgctgtggattttaagttctgaagcgttttaacagatattaaacaaaaaaatgggttttgggccaggtgtggtggctcacgcctgtaatctcagtactttaggaagcagaggtgggaggatcacttgaggtcaggagtttgagaccaccctggctcacatagtgaaaccccatctctactgaaaatacaaaaattagccaggcatggtggtacgtgcctgtaatcccagctactcacgaggctgaggcaagagaatcacttgaacccgggaggtggaggctgcagtgagctgagacacgccactgcactccagcctgggtgacaaagcaggactccatcccaaaaaaaaaaaaaaaaaaaaaaaaagggtttgtagttaaattaatttgggaaactttttgttaaataggtgtcttcagttttctcaaaacctagagtatgctaatgcatgtgcagattctctgagggattatgaagtgtttccccatcttccttgactataaagtctttttttatggaccaacattcggtggaacaaaccttagaaaatgctagtcaagaatctctcaatctgtccccccaccccccaaccccgccgccaccgcctctcactctctaaggaggaaatcaaggtctacaaacaaacttgctgtccaaagttacccagctagttaatagaggtatcagctctttagacaacatcatggtgcttaatgcccacatcttttgtgctgaaatgactttactctgaaaattttccatagagttaatgctattatacaacctgcttcattttcatacagtgaggtttataacagcagcataaaacgtcatgaaaaggtctaaaatatctagttaagctttagtgaacactcaagatggtaagcatctgggaggaggatcagagaagcaaataaaacatatcattaaggcaaacctcatcattaaaacaaacttctaaaataaatacatgtgataaaaagagtaggcctaggctccaatcctgtctctgccaccaatgagctatgaaattatgggtgaattacttagccttactgtgttctcagcttactcatgaagataataatagcatctaccttttagaactgtgatggagaataatgaagataatagatgtaaagtgtttagaacagtgcctggcacaaaggatgataatgctcctgctctaacaacaataataagcagataacaccaagcacttactatgagctttctaagacagattttccagacatgtacctagctcctgaaaagattcacatgcctcaaaatcaaaatttaggaaacaatactccaaaagtttgaagtattacaattttcaaaggaatctacttctcttactccagatatagagctcacgtgcttcagaacaaggtgtattagatgcaatattataaaattctacttattataaaaataggaacaagtttaaacttgatctatgattcctactacattggttatatacataaagcaaaatcttttagcatatttcaaaaatatgaaaatgattataaatctgtgtcttactacctatcatttcaggacaggacttctgcttataaaacagttattatcaccagaaatgttaaaatctacttacagtgctcatgacattttgccaaattttctaggtcatccacatgatagtaatcatagcctgatgttcccagaacttcaaatggcaaataccctattatgggtggtgccctaaattacacagaaaacaatcattattataagtttttccataataagaaatatttcaactagaaataaactttggggggggggctttatttttcaaaaaatgggaacaggtttcaaagtcctaatttaaaaaaaagtttgcccttgatccattaatttcaagaattatataacatgactattaccttttcatggaatttaaaaatggaattacctgtgatctagaaacagaaacttccattctaaactatgtctagatgtaaactcttcattgggttcttcaacagtgcacatttcctacaaataaataattaaaatttataaatactttgtgtccttaagaatattaaatattgctacatataaaaataagtcatggccaggtgcagtggctcacacctgtaatcccagcactttgggaggctgaggtgggcaaatcacttaggtcaggagtttgagaccagcctggccaacatggtgaaacccgatttctactaaaaatacaaaaaatagcagggcacggtggcgggcacctgtaatcccagctattcggcaggctgaggcagcaggatcacttgaacccaggaggtggaggttaaataaatacataaataaatagtcattactagataaacttttcctaaacaagttagttgtttctatgtatgtatatatttacctatttctttgtttgacacagggtctcactctgtcactcagcctgaagtacagtggtgtgatctcagttcactgcagcctcaacatcctaggctcaagcgatcctcctgcctcagcttcccaagtagctgggactatagggatgcaccaccacgcccggctaatttttgtatttttatttgtagaggtggggggtctatgttgtctaggctggtcttcaactcctgggctcaagcaacctgcccaccacagcctcccaaagtgctgggattctaggcataagccaaaatgcaggcccttctaaacaagttaatatattttaattttccagtactaaagaatgtggtaataaataacctttagatgcaagcttttgggtgggtacttctcactctacacattttccattcacacatgcctataaacgcttattcaaaattcagacctctctcctgaattacagttccatatttccaaatatctgaatgtcctcatacatctcaaattcaatatgtcctaaaataaactaactgctttactcctcacacccaatcacacaattttccgtattattctatacatgtgtagtggccagtgtctagaaatctgatagttaaaaaaacatactctttcatttttacctttcatcatctaagtggccattactaaatcttttccatttcatctaagtattttaaaaatcaattctatctcatccatcttgagtgcattggtttagacccctgccatcactgatttgctacagtgttcaccagtctccctgtccttcaactcatcttctcttctagggccacaattaccttaccaatactcaaatattatatgacttccctgctaaaaaaccttcagtggttccttgtgctaaactctcttcagcatggagaaataaacaagaaagaaacaaattttatttctggtttctgattacttttctagccttacctcccactatctcttccccctccacacactaaccctagactctagtcatactaaacaatgtattccatcctgcctctgtgtccctgaatgacctgcagcactctgtaatagttgagagcttgggctttgagaaaaaaacaattattaattaatagaatcaagtcccagtttcatcactaatagctgagactttgggcaagtcacttaacttccctaagcctgtttccttataatgtaaaatgagggatcgtaatggcatctaacttatagggttgtcataagaattaatgagataatgcatataaaatacacagcatgtagtaagcactcaaatgttaacaactattatttcataagatcaaaacaaaccaagcaagactggcttaagatcttctattaattcagtactttgtcctatactatgatgtccccccaaatttatttgagacagagtcagactctgtctcaaaataaaatgcaaacacagttcactgcagcctcgacctcctgggctcaaatgatcctcctgcctcagcctcctgagtaactgagaccacaggtgtgtaacaccatgcctggctaattttttgtattttttgtagagatggggtcttgtcacgttgcccaggctggtctcaaactactgggctcaggcaatcctctcgccttgctctcccaaagtgctgggattacaggcatgagtcacctcgcctggccccgccgaaattttaaatcttagcctggctgcctctttccagtcagtttctagtggttaactctttcactttcccacttccctacttgtcatctgtttgttgggtccaggaaataaaaataaaatacctaattttacatttgaaaaggtaagttatatgtggcaaagagccacttgtacatttcaaataaaaatttaaaagttaccttctaaaaataaagattccaaaaacctagatttttggactttcccttttaatagagataatgaacaacacacaaaaggatcctaaaatcttccacaaaagtagggcaatattgatatataataatcactggttaactgcaaaggatatatactaaaaaattagttatacaatttaatgagtgtcttgataactcatcgtttcaaaaatattatcatgcatatttaatgactcatagccattccacctcaatgtctgcaggaagtttcaggcagctctcagcatatgaactgaaatcccctttgggaaataaaattaaaaacataccttgatgaactgaggtgtagctaacctgacagtagctacaaaacaaactctatcttcataagatggcctatgtgtgcgttgtatagttccttcaaaaccattgtgtgctgaagaggatactaaaacaatagggaaatatgtatcatcagttatgccagcaaaacctaattgtcactgatattcaaacatctatgtctttaagagcacagaaaaataacaagttaaaacacattgtgagagaagcattttaactcaccactgtttaaagatttgaaatttcctataaattttacatattcataggtagatggctcctttgggtctattgttcctcgcagcatgtgacaacagaattctaactgattttttgctgaaataaaagagattttaaaaatcacatatttctgatataaaacaatgattgatataccacataaagtaagatcataaaagttgtgtaagtttacaaccattattttccccaacagaagtcgtcaatgacatttagttcataaaagtagagcaccttcaggagaggatctcactttgtctttaatagaaaaaatagattttctggtgcaaacaacttaatgtttccctatttttagctactcatccttttcattctttactcactttcaaaggaaagttttgcttcacattctaaagctaatccttccatctctaccatttatagtctttcctattttctctaggacccgggccacatcactgttccttattcctttagcatctacacctttgggtccttactttcttcttttttttgagacagggtcttgatttgtcacccaggctggagtgcagtggcatgatcactgctcactgtggcattgaactcctgggctcaagtgagccccctgcctcagcctcccaagtacgcaagactacaggtgtgagccaccatgcctggctaatttttaattttttatagaaatggggtctcactatgttgcccaggctggttgcaagcttctaggctcaagcaatcctcctgcctcaaagtggagggattataggcgagagccactgcacctggccaagggtccttactatctacttttaaatttgctcacgtcttccatctgaaataaaggagtttcactaattatttggtattatagatctccttccttttcattatgggctccatcttccatatattcatttcccttaacttcacacactgtgacttacacctctacagcaattattcttctcaagattactaacatttgtatcgttaacttcaatgatttttcatttccacttcttaaaagtcatcctttgtcattcccacagcataaacttaccttcccaccttactgactattcctatctcttctgctaatccattttcatactaggggttttcacaaaggttcttctgatcctaaatctctctctccaactctagcattttacgtgagacaaagttacctatcatttgctttcaggacattcgaacttgattgtcccattagtaacttaaattcaaaatacttgaaagtgaatttatctttctttcaagctcccttcgtctatgtatgcttatttcccaagttagaaaccgttaacaatttggtctcttctcttcccatcacaagtcccaaacctaatctgtcatgaagacctgctacttatttcaccaaggaagcctgccaatttagtgcagttgcaaattaccttgcatctaggtaaccgaaatatgtattcattatgcctccacattctgccactctgattcagtcttgtctattactcttagacttgtaattactttcatggtattatttccgcactcaaggactagtaacacctttctttgctcactacttcaagcttatattcttcggttattatcatcatagatggctttatcatctaacctaatcagtaaaaatctatctatcttcaaccttccccactgatgattcttagtcacttggtcacctgagcctaccacatcaagtcctattgagtttacacacttaacagtcatatactttcctctcctttttttttttttgagacaaagtctcattctgtcacccagcctggactacagtgacatgatctcagctcactgcaacctctgcctcctgggctcaagtgatcctccagctcagcctcgagtagcaggaactacagacatgtgccaccacaccccagccaacttttctatttctctttattgtatagacggtgtttcaccatgttgcccatgctggtcttgaactcctgggctcaagcgatctgcctgccttggcctcccaaagtgctgagattataggcgtgaacaactgtgctcagcccatccttacttttattgctaggattatatggttttcctttttgtctcccagtctggtccttttcaaaattttctacctgagtgattttttttaatctcccaaaccagatgacgaaagtggcagcaacttttataagcaaggtactgctgctctttctaggccagagatgctggtgaaagatgctttcattgcaatgaagacctggacctccatgaggcaaaacagctgttacaggaaaagtagtcatagctactgtaccaggcaggatggccagcttgatcatcagaatggtctgatccataagatctctggttgtgtttaactgaaccctaggaatgaaactgaggagtaactccataaagctatcacttgatttgtatagtaggaaatctgcaggtcaggtgagcacagcctgagttgagccactatgatgagaaatccagggctcttattcagctctcagactcagggtctctttatgaagcagaagccaggtaagcctggggtaggcaacccactgctgcaagtcttcttcctagccttctccaaatgaactttccactatttacctgattttgtttttcctttttttgcagataacaaaactacccaaatctccttcactggctctctactctgtaaaaaataaaactcaaattccttagcccctttataattctgtccttattctttctctagacacaaattttaccacctgtacaacctcaacttcattatggccaaaatgacctaccaaattttctaagcaattttctctgtgttttaacttgtgtttattcttttggcatgaaactttcttttttctggggcaagaactcttttgtatatcacttgtttaactaggagatcagcaagccatttaattaagacttttcttaagtattcttgccattttcatttctgttcttggaagcagaagcctaagctctttctgccaaaggcttttatttagttctccagtcgattttattcttagtagggtcttcaaagcaaacgccttctcctttgtcttcctattgctatctccaaagggttccacctttctttcttttttttgagacagagtctcgctctatcgcccaggctggaatgcagtggtgtgatcttgactcattgcaaactcagcctccggggttcaagcaattatcctaccttagtctcccaagtagctgggactacaggcatgcaccaccatgctcagctaatttttggtagagatggggtttcgccatgttggccaggctggtctcaaactcgtagcctcaagtggtctgcccacctcagcctcccaaagtgctgggattacaggcatgagctaccgggcctggctggcttccacctttctaatttttctctccttgttctacgtatttacctcaagcaatccattccatccatggcttcaaatactaattgtaggtatctattatatacagcctaaatctttctaagtaccagactagagtggcctaatggtcaatgtcatatgaacttggttttaaaacaaggcttgaaatgaattctccaactctagtttttctcaactctcgctgaaaggccatccactcttaccaaagttatagatacacacagatttgtgtgagtgtgtgtgtgtgtgtatctcaatttttagacagtatgctatagaatttgaggattcaaatacaaagaatctttaagataatgtcagtattagcagatgagacacatttaaaaataatgaaaaaggtgattaaacaaggtatctaatagctaatggtgaaatgtactgctgtaacaattctggattttatacagggtaatatatgaagaaaatgaggtactccggtcaaataaatttgtcaatggacctagtagaaatgtctgattctaccataatatgttgtgtatcttgatggtgataactattttcactattgttgatatttttatgatacagcacaagtacctagcaaattagatacatctaacaaatgactgtttaattgtttaataaagtagataatttatctttatatttaataattttaaaagaaacatagaaattttttccagtttgagtgtccaattggttaacaatggtgaaaattagaatgtttaattttcccttattaaatacagtaaagttttatttataaattaataactatatattgccaggtctcacttttgcataaaatacagctttatggcataatgggagtccaggatttattataacaaataagatgggatttcaatatacactgaaatagattacagatttttaatatggtcacaatttcattttatatatattttaatattgaaaaaggacctaatagggcatatggagtaatgctgtatttaaagaagtctgtatttttcataaacttgcaaaaggatagtgctactgaatacaacatttgacttttttgcttaacagctactacttacattttaaatattctggggttaatgaatcactttccagcagatgagtagagagtattttataaacctctgaatgttccccttctgggataaaattaaatatactttgatccacaagatcagactgaaaagaaaattgttaaaagtaaaataacttcaatgattcaagagacaattgctttaaaagtacataatcgctattaaacacagcagttaactttcaattatctgtgaaaaccaacaaatgtcaagttatagaccaaatctcaaaaaataagattgagatcatactaacgtcatccaatccatgaccaatatgaccttgaaagcctgataaattatttgcaaagctgtgtttcaccaaaatgttctgaacatttcaaaatacaacgggaccaagagagttaataagaaaaatctctggcgacaagtcatagccttaccatatactcaaacctatggtaaacaatggtggtatatcctactataaaggactatgcacaagctaaataaagaggagattttgttttggtgtgatttcaattgtccaatgtgtcctttatttcatcttttcctggcatttatcctgcatcccattgtacaaaagccttgtgtttagttatcccccctcaaaaggacaactaatatgttaagcattagaattcttgttaatacacagctttaatcgtgattaatcaatagcaatttgacaaacatcaggttggctacaatgtgccacggctgtggaatcaaagatgaataagatagtttctatacttaagtaccactgataacaaaacttccatgactttacatttgccactacgcattctacctggtttcctgcgtttcaaactgctctgtggaatcctagggatgctgagacagtatctcaaggcctgtaaaggtaggactagagggtggggaagtaaaaaggagctgagaagcagggcccagggtcctgcccctgcattaaactaaagcagttatactttttgtttttattttatgcatctgtgaagattttgtttgaagagctccactgcttaaaaacaaaaaacatacaacaacaaacagaggcagtaagaatggtgagaggggagaaaggggtgttgtattaggttggtgccatacttttaataacaaaaaccgcaatcacttttgcaccaacctaatactattcttcatataggccacacattcccatcatttcttctgtcttttctccagccctccaagcccactccatgaagtgagatgaccttcccccctctctacatatctgtatctttcccctttcaaagaccagttcaaattacttctttcaagaaagcattcccttaacaccataatccacattaaaaataaaattcttttattatttattacttgtattattcatttcccatttagcagaattcagccaaccatggatcaaaactattcaggaaaaacaaaaaacagatggttgtgtctgtactgaatacgtgcatttttctaatcgttccctaaacactatagtataacacatatttacattgtattagttattataaataatctagaaatgatttaatgtatgtaaatgggaagatgtgtgtaagttacatgtaaatacaacaccattttatctatgcggcttgatgatccatggattttggtatctgcagcgggtcctggaaccaaccaattcccccatggataccaaaggatgactatattttaatgtctatgtcctgttgccctatagctgaataaaaggggcctatctcttacacctttatctttctcacttccaatcagggcacattaacaccgtgccttgtgtttaacagttattagtaaaataaatgattttagactaaggaggtatttgataatggcttaagggataaccacaccaaaaatatatctgtatttcagtaaaggatttttctggaagtctgaaaagcctctacaactaaaggagtgaactaaaaattcagggatggctgggtgcagtggtcatgcctgtaatcccagcactttgggaggctgaggcaggtggactgtctgaggtcatcagttcaagaccagcctggctaacatggagaaaccttgtctctacgaaaaacacaaaaattagctgggcatggtggtgtgcacctataatcacagctactcaggaggctgaggcaggagaatcgcttgaatccaggaggcagaggctgcagtgagctgatatcctaccactacactcaagcctgggtgacagaataagactctgtctcaaaaaataataacaataaataggcctgaataacacaaatgctagaaagttgccttctactgacaaaataaagaatcaaaatatagtatatgatattgatgcaaaaaataatctgatatggtttggctgtgtccccacccaaatctcatcttgttgttcccataatccccatgtgtcatgggaggggctgagtgggaggtgattgaatcatgggggaagttacctccatgctgatgttctcgtgatagtgagtgagttttcccaagttctgatggttttgtaaggggcttttccccttttggctcagcacttctgcttcctgctgccatgtgaagagggacgtgtttgcttccccttccgccatgactgtaagtttcctgaggcctccccagccatgccaaactgtgagtcaattaaacctctttcctttataaactacccagtcttggggagtcctttatagcagtgtgacaacagactaatacatcatcttaatagaaaaacatgccaccaacttgaaatattaataggaactaaaattttcatttttgagaatgattatagttttctactattatttgttactaacaatttcttctactactatttggtaaattatgatgtgacctatcttatccttgttttttcatctataacttcataggatgtttcatattcatagagaaaagaaaatgaatgcctgtatcaagagtagtatgatcacaagcaatgcctgccccaacaattctgcctctcctgccactttaataggtgtcaaactttccattaaccactacacttaaaatctctaaatgaggctgaccatactttatgtgaccatacatacactcagttctcaaacacaatcaaacgtaagaaaagaaaatggtaactacttggatctttttatctcccttactcgtttcatgaaaaggaaatataagttctgctgatttacttatatgacataaatcagtagcctttgttttttctacattaggtcaacgttaccatttagtgattggatgacacaaacaattttttaaaatctagaagatgttaataacagaggaaactgggtatagtgcacatgggaattctctgtactaccttgtccatttttctgtacatctaaaaatggttctaaaattaaaaatattttttaaaatgtccagaagaaaatgggaaggtgacagggtttttattgagggaagtgttaatcaaacacttcaattccaatgagatctatcacatgttgtctatttcaaagggcaattaaactcactaaagattagaaagggatttttttaaaacagtcaaatcaagtagcacactcattttcatacattcaacaaataatcactgagtgacgctccaaggaactagctagctcctctggatgcagagataaagttcctgcctttaagaagctacaactaccataactatccaaataaacagaaaattataattctctgtatcatgacagtagtacatacaaggtaacagtagaacagagatgaagggcatcgaattttgaatggaattcaagcaagtgccaagaagcaggctttgagaaagtgtgaacacattgcaaatgatgctctatgactagattatatagtttctgtaaacatgacaaaacctaatacagttatatatggtttaaaagcatacaattatacttattttaaattacttagacattatcttaatcctataatgggattctttccctgggttttcttgctatgaaaacaaatttttttaagttgtccagaaaactcagttaatcagtctgtccttttttctgcctatgctagtttacttatgcattgctaatatctcatgttttactctcaaacatgtttttaaatgttgggcttatcctactatttgagcttactagaaaataaagccccagaagagcagtaaagtcaaagttattttctgtatgaaccaaagaaattagcaaattatgtactgcatggctttcaactttaaaaaatgcccccttgagagcctggacttttaagtgctaaaatccattgattctctttataaggtatgaagtatcagagtaatcagagggagagaaataccacttttcagtatctcttgaaagagacacttacaagcagaattactttaccctgttatagagataagctatttttttaatttttttgtagagacaggatgcttcactgtgctgcccaggctggtcttgaattcctggcctcaagcaatcctcccaccacagcctctgaaagcattagcattaaaggtgtgagccactgcacccagagagaggcattataagagtagtttataagtaactttagaatatttataccatgagctccatcttcaataacatcattacatattaaaaactgaaaactccccccaaaagcctatcagctgtggcacagcacctagcatggtgtctggcacagagcagatattaataaatacacattagaaaaaaagtaagcacataaaccaggtattcaccatcctaatgaaacaaaatatacttttctaattctctatccttctggtcatatagataatgaattaaaatatggccaatatgacattatcagttcaaagtcacatagcataaaaagttctgtatctactatttttagagtgttttttataagtaattctattgagaaaaatatttacaagttgccctaattgcaacaagtatctcagcagaaatttagttattctcaagacattctcagtgatttaacattttcaacaggctgattaaaatggaaacgctaaaaagttagcattagaataaagaagacaggaagaagaggggtcagataaagtggtaagaccttgcactgcataacaatgttttggtcaacattggactgcatatatgaccaccggtggccctaagattacagtggagctgaaacattcctactgtctagtgatgtcatatctgttgtaatgtcatagatcaatgcattagtcatcctttgcacttgtgcttgtggtgatgcttgtgtaaacaaacctactgtgccaccaatcatataaaagtttagcacataaaattatatacagtacacatgtacatgataataaacaatcatcttactagtttatgtatttactatacttttaatgatttagagtattctctatttacatttttttttttttgagatggagtttcgctcttgttgcccaggctggagtgcaatggctcgatctcggctcaccgcaacctctgcctcccaggttcaggcgattctacaggcatgtgccaccacgcccggctaattttgtatttttagtagacacagggtctctccatgttggtcaggctggtctcaaactctcaacctcaggtgatctgcatgcctcggcctcccaaaagtgcagggattacaggcattagccaccacacccagacttatatatatatttttaagttaactctaaaacagcctcaggctggtcctttaggaggtatttcaaaagggcactgttattacaggagatgactccatgcctattgtttctcctgaagaccctccaatgggacaagatgtggaggtggaggacagtgatgttgatgatcctgaccccgcgtaggcctaggctaatgtgtgtatgtttgtgtcttagttttacaaatgtttaaaaagttaaaaaaagttttttaaatagaaaaaagcttttgaaataaagacataaagaaaggaaatatttttgtacagctatatgatatatttgtgtttctgaggcagggtcttgctctgtcacccaggctggagtgcagtggcaccatcacggcccactgtagccttggcctcctaggctcaatgcaatcctcctactagagcctccggattaactgggaccacaggtgcataccacgacacttggctaatttttatgtttttttaaagacagggtttcaccatgttgcccaggctggtctcaaatgcctgagctcaagcaatctgccagccttggcttcccaaagtattaagctaagtgttactacaagagtaaaaaagttaaaaaaaaattttaagtttacacagtaaaaaagttataataagctaaggctaattattattgaagaaaacatttttatataaagtagcctaagtgtacagtgtttataaagtctataaaggtgtacagtactgtcttagtccttcacattcacttatcactcactcactgactcacccaaagcaacttccagtcctgcaagtttcattcatggtgagtgccctatacaggtataccattttttacctttgagactgtactttttattgtaccttttctatgtttaggtatttttaaacatataaatactgtgttacaactgcctatagtagtattcagtacagcggcatgctgtacagattgtagtctaagagcaacaggctatatataccatatagcctaagtgcgtagtaggttacacatcgaggtttttataagtatactctatgatgttcacacagtgacaaaagtgcctcagaacatattcccattatttagtgatgcataactatagttgaatattaagttactacagattagttatgactgagctgagaaaacacatgctgaaacaaagacatacttagagctctgattcctacccctttaacgactgttgtacactgctctcaaagtccacttcccagtgctttagaatatttaaaataggcattttaatacgaagtagattgtaggatctttatacttactggtaaatgttcaagtaatgaagttacactctcagacacatatattatgcttccatctgtcatgattgctaaaaaaaaaccatcaagagcctgaaattaaacataatgatatgttaaatgaaaagaaaaaagtattttgcaggacagaaataaaaatttgagataaatgacaaaggatttaatatggaaatatccaaagttctgtcaaaatataatactagctttccccctttacaataccttggtatgtatctttgttcatttttaaatgcttctggagaaaaaaagtctctctctggccatctattggacaactggtctctaaaagatagagacaatgttctaccttcatcactaggtatattacatgatccaatcatgtatatacagtattatggcttatttgaagatgctaatgtctccaaagcatacaagacatcaacaatgttttgtaggcacacaaaggaatactttgttattatcatggatatgttaacacagaggtgtacatctgaagtttaaggagatatatgaagaataaaataaaagggagtagcaggaaattaaggtgaaaaattaggctgagttcatatcataaaaggctttgaatataaggttaagacataagaattttattccgtatacaatggtaagccaacagaagattttagggcagggggctgtgcttcaataagagtagtgtggaagcagggtgtaaaatggatttagagggaaaagaaaattcagttaggaaaatcatagtggcttttggactaattaaggaagttaatgggaatctgaatgaaatcagtagtattaggaataaagaaaagtacttcgagcaagcattgagaaatgtgaagttcgatttcagaagagaagtcagagcagggagtacaagacttaataaaaatgcaattttgtattttatacactacaatgtattttcatttgagaatcctaggcacagaagtgacagctgaagaaatgagatctacaaaagacaaatcctggaagaattatctacatataagggatgaggaagagaaaaaggccagagaaaatgacagagaagcctgcgtgcagtggcttacgcctgtgatggtagcaatttgggaagccaaggcgggaagatcacttgaacccaggagtttgagaccagcctgagcaacatggcgaaaccttgtctctgaaaaaaaattaaaaaattagccaggtgtggtggcacatgcctatggtcccagctgcttgggaggctgaggcgagatcacttgagcccaggaagttgaggctgcaatgagccacgaccatgtcactgcactccagcctgagcaacagagtgagaccctgtctcaaaatagtaataaaaattgaaattacaaaaaagaaaatgatagagaagacagaatacactgtcgtcaaggaatcaatggaagaaagaatgacaaagtgaagaggagaggaatggtttggtataaaatgagataaagaataagaaaatgagaaatgaattttggtgattttcaaaaagttatgttaacaggaaggcaagtcggactacaatgagtttaaaaatgagtacaaaatcagaaggctattacaagtcactcattcatgaactttagaagggaagaaaaaggcaaacagttctaagggggtgaagtatcaagagaaggcatttgaaaaaagagcaagtatatttgtagtctaagggaaaggaagatccagtggagaagaagtagaagatacacagcacaaaagatactataaaagggattcttctattaaaatggtcaatacactaaattctaatttcttgtttacttaaatggctctcgaaaaggatagtgacctctgataggaaccatgtatatcttattaatccttgtatctgcagcactagtgtagcgcaagtaaaaatacttgcagtatataatttatagagctgggagttagagtaacctttcctaactctatgtaattgacgaatatatagaaaatggtcccctcccccttgtccccccccttcttttgggaaagagatctggatatcacaaagaacttattttaagtagatgcctatcttctagaatggctcaaacaaacccagtctttgctaatatagaagtagaaatcttgtcattcgagcaaactcatgaattatttttttaaatcctttagtacaataatgccagtattattatttcataatagggtcaaaagtagacaactgttcgccaggcttacacctgtaatcccagcactttgggaggccaaggttggtggatcacctgaggctgagtttgagaccagcctgaccaacatggtgaaagctcgtctctactaaaaataaaaaaaattagctcggcgtggtgacacatgcctgtaatcccagttacttgggaggctaaagcggaagaatcacttgaatctgggaggcagaggttgcagtgggcagattgtgccactgcactccagcctgggcgactaagcaagactccgtctcccaaaaaaaaaaaaagaagacaagtgttcctcaatttccccatctgaaagcaagaaacagatactattgtctacttcataataccagctattatgacacacagatactagtgtttacttcataagagtattgtaaggattcagtgagttaatatataaaaattattcacttatttttctgatttaaagtacaggtttaaatgtttataatatatttatactctaacaaattttcgtatggtaacatttctgctgaatacataaagaattaatcacacaattaattgtcccatctaaaatacaaacagaaaaataactcaatttgcaaaatactctaccttgcttcagacttgagacgtggctataatctatttatacaggcataccttgttttattgtgcttcgctttattgaacttcagttactgggttttgttttgctttttgttttttcacaaagtgaaggtttgtagcaaccctgggtcaagcaagtctatcagcatcattttttttaatagtatgtgttcactttgtgtctcttgtgtcacattttggtaattcttgcaatatttcaaactttttccattattattatatctgtaatggtgattcgcccacataaggtggcgaatttaaatgttgtgtgtgctctgactgctccaccaactcactggccattcccccatccctctccctctccttggagctccccattccctgagacatacaacaatactgaaattaggccaattaataactctacaatggcctttaagtattcaagtgaaaggaagagtccctcatctctgactttaaatcaaaagctagatgtgattaagcttagtgaggaaggcatgtcgaaaactgagacaggccaaaagctagacctcttgcaaccaaacaagtagcaaagttgtgaatgaaaaagaaaagttttagtgaacacatgtatgataagaaagtgaaaacagccttattcctgatatggagaaagtttgagtggtctgtacagaagatcaaaccagccacaacatccccttaagccaaagcctaatccagaggccttaatgctcttcaattctgtgaaggcagagagagttaaggaaactacagaagaaaagttagaagagaacagaggtaggttcatgaggtataaggaaagaggccatctccataacataaaagtgcaaggtgaagcagcaagtgctgatgtagaagctagagcaagtgatccgggagacctgggtaagatcattgatgaaggtcgctacactagataccagagtttcagtgcagatgaaacagccttctattgggagaagatgccatctagaactttcgtagttagaaaggagaagccaaagctggcttcaaagcttcaaaagacaagctaactctcttgtcaggggcaaatgcagctggtgacttttaagttgaagccaatgttcatttgccattctgaaagtcccaaagcccttaagaagtatgccctataaatagagcaacaaaccctggatgacaggacatctgatgacagcacatctgttgacaacatggcttactgaatatttaaagcccactgttgagacctactggtcagaaaaatagatttctttcaaaatactattgctcgctgacaatgtacttggtagcccaagagtgctgatggagatgtacaaggagattaatgttgttttcatgcctgctaacacaatacccattctgcagcccatgggtcaaggaataattttgactttcaagtcttatttaagaaatacacttcataaggctacagttcccatagatagtgattcatgtgatggatctgggcaaagtcaactgaaaaccttctggaaagaattcacccgtctagatggcatgagaagatttctgattcatgggagaaggtcaaaatatcaacattaccaagagttaagaagaagttgattacttgtggataactttgaggggttcaagatgtcagtgaaggaagtaactgcagatgtggtagaaacggcaagagaattagaattaaaagtggagtctgaagatgtgactgattgctgcaatctgctaataaacccgaactgatgaggagttgctccactgatgagtaaacaaagtgatttcttgagatcgactctactcctgaagaagatgtgaatactgttgacatgacagcaaaggatacagaatattacataaatttagttgatagagcagcagcagggtttgagagtactgactgtaattttgaaagaagttctactctgggtaaaatgctatcaaacagcactgcatgttacagagaaatcttgaaaggaagagtgaatcagtgtggcaaacttcattgctgactcattttaagaaattgccgtagccaccccaaccttcagcaaccaccaccctaatcagttagtagccactgacactgaggcaataccttccaccagcaaaaagattaagacttgctgaaggctcagatgattgttagcattttttagcaataaagtatttttaaatttaggtatgatcagtattttttatataatgttattacacacctaatagactacagggaaacaaaacaattcatgtgactcattttactgaaatattagctttattgcagtggtctggaactcaactcgcaatatcgccaaggtacacctggatattaagtcaccctgtgatttcttttttgaggaaaataaaactttcaaaaattaaatctggacatacctctaacattaattgtgtaaactcttcattactaaggaatgtaggtttccagtcctgtcgaatttcactagcatctgactgtgcagtgatttctgtaaacagattgacatattagtggcatactccaaccaccggaggagtacaaaagccctacaagttatcttgtctcttcccattctaattaaagatgacaaccgtaggcattaacatttattgggtagatatcaagaggtccaggttttggtatgatgaaatatttgagataacatggcaagttatctccttggatttggtctcttggtaataccagtctcttcggtttttctcttggtactctgatagttatgttgctgatgggcctgagattgcttcctatttgacacaatgaccaaagaagatttttgctccaagaattttgaagcaattctttttttccttttccttcccttgccattcaaatagcaatgtctagagcagcactagggaaattagctgaaaaaggccaaagaggtcactaggtttgctttcaacaaagaatgccttaggcctgcctactgctgggcaaaaagcttcttcccaacattaagtgctctatcttaattaatcaaagagactaaattaatattttatgcaaaaactttactacagtaatattcccacagtgatttttcttagtgtcctccttgtacaacagtagagagatggtgaaaaatttggagatccctgctgtgggacatatgtttgtcacaattattaccattttatttcactacatacttctaatagatttagttatgaaaaagctattcataaatgatgaaacctagtaacaaatgtttttctattttttaatgtagacatattaaaacaagcaggcagaataaaaatctatgtcatagactatattctacaaaatatactctaatttgtagtaagaagtataaactaaattctgattttatcatcagatagagaaatacagcatactgtccctcatcaaaagttagcatattagaaatgcctgtagtggaatatgaagagtaactaagaagtagagctactaaatgtgcggaatacagttgtgtttttcaaattcacatcaattatatacatttgggaaaaggatttaaatccacaaacaaatccaatcaagtttcattaaacataggcctattttaggatgatacatatataaaatccttttaccttaacagaaatactatttttgtgagaattatgtatctgattttgaaaaaaaaaattacctaatgccacaattcatcctctattgacggggaaatatatgcatttcatttcattcaacaaccatttattgaactcctagtatctttggactggtttcaatgagtgtgccatttaacaataggcactgaggttagtgagatactatctgtagaggtaaaatgtaataatagtggtggcaataaatattgacacatttacgaaagaatcaacagaatttggcaactgtgatatggtgctaaggaagctgaaaaaaaatcctaaaattttttcaggtttaagtcttaggtgactaaaaggatggtggtataaaaatgaaaaaaggcaagttaagagaaagaggtaacttgacaaaatgaaaataaattcaattttagatgcactgagtttgaggacatgcaaaagaaagatctagaagttatctggaaatacatggctaaaatgtttgcatctaaaaatagaaatctggtaggttaatagagacacaatagctgaagctatggaatgagataagcaagagaaagagtgtacagaaagcaagagaacaaggataagacttaggaatgtcacatttagagggtagaaagagaggaaagaagttagtttcagttagaaaaggggaggagaaagtacaatataagggaagccaagggaggagggataaaaatttccagtgctgtacagatgcagaagaagatgcggtataagaaaaagctattgctttattgagggataggaaggtaatgtcattagtgaaattaacaaaaacactttcaacgagtggtggagcataaaccagtcctgtaaggcattaccaactgagctaggcagaagtaaaacagaggcactaattactaactgtcctgagttttacagtttcatttgcatttgaaaaaggaaatttccttttacaggttttttttaaatctattattatctgttaccaaaatacttaatattctttaaattttctttccatgactcatttgtcaagatgattttcttctattaacaaatactttattttatagtgttgatttactagatatacattgaaaccttttaaaatgacacataagaactttatactatccagctttttcctttctttcaaatacacccataattttccaacacaaacatgcttcagtgacaatgaagtctccctgcctctctgcttttgcacatattccctttgtgtgacatgctgtcttccttaatctaaaagactcagttgaaaaatcaactattttaaaagtctccctgacatactctttcctgtgtttttgctgcaaacagtttacaagcactactcacatttgtaattatgtgcttacatgtttgtctgccctggcttgacttaacttcaaatccaggactgttaccctgcatcatgaggatttagcatgtagtaggcacggaataaatgtttgttgaatgaaagaatgaacatattaggaaaccttttaaaatgcaattgatttctctctcttaaaaaagccaaggaagcatccaatcttaagcatctctgccaagattctaactaatgctttgagagtctgttccattttacagagttaaaaatttacctttatgttttcgtaaaaaatcaatgcttttctgcagaacagtagatttgtccatctttctagcattaccaggaagcatggatcccagttctttaatgagaacattaaattgatctctacgtttcttttcagatttgtttctagatactctgatgaaatgaaaaatatgcattttttaaacaatccatttaattacacaagtagtttaatacaatgttaatttagacatgacacagcatgtacttctatcaacatagatggtaacaaatatcttccaggttaccaatatacagttaatttgggcaataatttttcagctcagtttattactaaagaaaattttacaaatcatacatttgacaaacatgtttttatgaaaatgccaataagaaaaactgcattcaaatcacaagttttattcaatctaatacttccagtgattgttaacttacatggttattataaatatatgtactaaatgaataaagacgctattctatgtgaagcagtaaccagtaaacaaacagctattgagaaaaacttgattatttataaaacaatcattttatgatacctgtaattatctgctttgaagtcagattttctaattcagtttctgtttaagcaaagcataatacttttccaaaaggtcagaagatatttaatttataaactacataccaatattctaagttcttccaccttgctaatatatctaaactcctaaagcacatagcttttggaaatcatttattcactatttatttaccattatatttatctattattcattcatttactattttatatctctaatcaaactaccttttcgctttgtccttgtcatcttcttccaccaacccatcaaaaatactactgtcatctctaaaagaaagcggatagagaaagtaagagcagactcactaagcaacagcaatactaaagtgacatgtaaatcaactcagttatgccctatgatttttgtaaagttaatgagttataacattcaaactactaacctatttcctagtaaacattcaaaaatcaaaattcagtaataattatatttttaagcttattacataaattgtaaaagtatttatacttagctatattatgaacacatcatgctaaacaagaatttaaccagtttaaatatcttgtttcaaacttttagtaacggtaaaaacgtatagaaagtcagtgtttgccattatataaaattatttttaactataacagcataatttaaattttttcttagatatttactttctaaaaccacaattactcgtaaacatcacaatgtaatgcattaacttatattaatacatttcattcatttactaattcatttgacaaatatgtattagcactcatgtgctctgttctggacatgtttagtaagcaatgaataagacatttagctgctttcctacagtttttccttctttttcctttttttctggagacagggtcttactctgctgcccagactggagtgcagttgcacaaacatggctcactgcagcctcaacctcctgggttcaagaagtcctcttgcctcagcctgctgagtagctgggaccacaggtacatgccaccatgactggctagtttttttatatttttgtagagatggggtcttgctatgttgaccaggctggtcttgaactcctgggctcaaatgaccttcctatctcagcctcctaaagtgttgggattacaggtgtgagctgccgtacccagcctcattttctagtagatagaaacaagtataaaaatgggagatgaggctaggcgcagtggctcacgcctgtaatcccagcattttgggaggccgaggcgggcggatcacgaggtccaggagatcgagaccatcctggctaacacagtgaaacccagtctctactaaagatacaaaaacttagccgggcgtggtgatgggcaactgtagtcccagctactcaggaggctgaggcaggagaatggcgtgaacccaggaggtggagcttgcagtgagccgagatcgtaccactgcactccagcctggccaacagagtgagactctgtctcaaaaaaaaaaaagagatgagttttaattttttttaaaggggtgatgttttagtaactgcagtctgagcggttagtgggggacacgtgagctaggatctaagtgacaagaaggggctggctatgggaagatgtaaggaaagaccattcctaaaaaataaaatcaagagcattggtggctaactcaaccctaggagcaatattaaagtttctgctgatttatgaagttttacataaattccctattcactcctttagccacacctttctatggcctataaaggcctatatgctataaaatggagtcactattgagatcacctgtaacactcatatcatggtggaggtgcatgtatgaacttggggattccatgtaggccctgaaatttataaaaaattgttatatgtatatgaattttccgagaacagagttcataacttccatgacattcagagataaggaacccatattaataatcactgctttatgtctgaaaatacaaatgtcatccctaggtgtcatactatctagaatgggaaaagcataatgccaaattcatattttatccatcaaaggcagtgaagaaatatcttttccaagaaaaagactatcattaattccgcctgtaactatggcacagttcaaagctattgacatggtgcaggcaggcttctttaaggaagtttcttgctcctcacatcttaagttctggtggagtatacatctttactatctagctcataaaaagggagaagagctgtccccagatgtcaaaagtcacttctgtgtacaagtctagctgcaaaactcttaaagaatcccaatggatggagcacaccgaacagtgcaataaacgcattaacaactttaatgtcagacaaaccaacacaagtaaaaattccagatcatatcttactagctatgtgactttaaacaagttatttaacctctctgacctacagttttctcatttgtaaaatcttgcagaattattgaggttaaataacatgtaaaaaagtattctgtacatttgctgtcagagtagatgctttaaaaatgttgttggattatatcaaatttaagatattattgactgttaagatcaccactattttatgtgcccttaagaaagaaaaaaagagtgctaccaattaaattatgataagagatgctaaaatgtaaaaaacaaagacaacttaaagtcttttcttttctacttttactttaggttcaggggtacctgtgtaggtttttcatgcgggtagactacgtgtcgctgaggtttggtgtaccaatgatctcaccacccaagtagtgagcacagtacccaatagttttttaaccctcactgcccccttccaccctcctccaaaaatttcaagtattaaaatcaaaggaatatggagatttacccttttcccaagagtatgatgtaaagattacaattttaactaatgaaatcctaattatagttacttcttatcagtcacaaatgctaagatgcttgaagggatgaagttagataagaagaaaaaggactccagaaggttccaaggaaacatttgcaactgtcagaatttccttcagagcagctatgaccaaatcactaaaaattacaagtcaggactcatttaaaacacacaagccatatgctgctgactttgcctctggaaaatactgatataccttacttatttttttatactatatttgtttaatacagaaactgaatgcaatagtaattatgtttaggcataaaattccttctatcaatttcatatagaccattattctaatagtgcattttaaaataattatatataacttaaaataagtcttcaaaaacatacctgtcaacaatcgagctcattttactacagcttacggtaaacaacataacatactacgttttcgtcttgtagtagacatttgtacttctccttaggtgaaaagaaaaataaatggtcattagttttctaaaaatgttacttccacaaacttatcttgagaaatactatatgttatcacagagacttcaaaacgttttgtttgtactgaagatcagaacattattttcaagcaaatacctatggctgaggtacatttgaggcttcttttcccctcctaaaaaacacctacaagaaaaaaagtaattcaggctcatattaactttctctttactatcaatcaaaataaaatggacattctcaatattcagtatatatttgactatataactacaaatagtctgtaataacaccatctattcagcaataaatatttgttgaaagcctattttctgctaaacagtacagcaggctttgggcacataacagtgaaagacacagtccctgtaggaaaaatttgcaattgagcaggaagatagatatctaaataattataataagaggtataatgaaggtatatactgtgtaatgctatcactgggcaaggaacaattatgtctacccgtgggaattagagaggggaaacgaggaaatattcttgatgacagtaagtctgtcagggagtcaaaattcttttttaatgcaaatatggtgcagggatgggcagcatcaccatcctctgagagcttgttttcaaaggcaaaatcttaatgaaccagaatctacattttcacaagggctccacgtgataatgtatgaccacttaagtttgagaagcaacaggctggaggacagaaacagataataggtgaaagaattttaagcgacaggaatggcaatttgtaaaggcacaggccttagtgagacaaaagaatatcgtatttgagaaactaagaggtttagcattttccttatgaaaaacctgggatgttacaatttaaagttataattactagaccataaagtttgagaatacaagtggtaaactggcaaaggcaagtcaagtacaggagagtcttactataaagagtctcatacccaaattgaaggaagtaaaacttactgctttaaagctggatcacaagcctaaaatttgtctctctatattctataggttgagtatccctaatctgaaaacctgaaatccaaaatactccaaaatctgaaagcttttgagcatcaacataatgttcaacattcaaaggaaatgctcaacggagcatttctaaaccagagaagattaaagatattacaagaacgtgagattctaaacattcagtcactgttttcaaatgcaccttcatgaaaggaaaggagaataaccctggcaacattgctgcattgcctgtatggttatggctgcagaagtagaactgtgaggggctcagaatatttttttttctttttgtttttgagatggggtcttactctgttgcccagggtggagtgctgtggcatgatcatagctcactgctgccttgaaatcctggcctcaagcaatcctgccacttcagcctcctgagtagctgggattacaggtgctcgctaccatacccagggctaagagttcttaaaagaaaatgagtgacagagtcaaagatagaaataataaaataaaaaggactaacaccaggatgaaaagttgtgattttaagtgtctgaggtagtatcagcagatggaacacagaactacagaattttagaggtagaagagaatttaaagaccacctaagtacatttctctggtccaacagacatatttatcttcatggtaagaagtgaggctgattctatcactagaagaggaagaacagtataaaagtaatagggcaaatttcagtgaattcaaaaagaattgttaagagtaaaaagttcaaaaggccagatctgagccttataaggcacccagtaagtatggcttaattatcaaaaggtagaaaataagacaaactaccaaaaaaagggcagggggtggtggcggggactaggcaacgccaagaattaagggttatactacaggaaaagccttgctgactactagaagggtgaatccaatatagtttagaagatgcaggctgatgctttattaggctgttttactattgttgttaacaatattcttccaaaaattatttgtcgtccagctaatagaacaacgtaagatctctctctctctctctttttttgagacagggtctccctctgtggcccaggctggagtgcagtggcacgatctcatctcattgcaacctccgcctcccaggttcaggtgattctcctgcctcagcctcctgagtagctgggattacaggcccagaccaccacaagccagctaatttatctatttttagtagagatggggtttcaccatattggtcaggctggtctcgaactcctcaactctggtgatccgcctgcctcagcctcccaaagtgctgggattacaggtgtgagccaccatgaccggtcagatataactcttaacagtctagcacaagatcttcatctttccagccaattgacatacacattttacttaagggaaaggagtaagtaaaataggctggacatgcaccctagagcaaatgttagaagatttccctaaacttttaaaaatggtgtcaaattaactttaacaagacaaactggtaaggtggaacagccaaaatactttgtttgcagactactgcaagtcccacgctttcaattcagaaagagactagctagagtcacacttgtccatgctgtggagtctaaggatacagatgccatgccacttccctacacaagctgaagtggaatgtcaaacatataatctaatatagaatacatttcattattttttaagttcgacattagaccacaaagatatgcaatgtcttcaaaaggatcagttgcagttactggaatccaaaattcaccagttttatttaaaaaaactaaaatagtataattggattgtttataacacaaaggataaatgcttgaggggatgacatcccattttacatggcataattattacatattgcatgcctttatcaaaacatctcatgtaccccataaataaatatatatactaggtacccacacaaattaaaattaaaattaaaaattccaaaaaacaaagttccccaactataaaggatcaagttacagctaggaatcaaatgctcctttacttaagcaacttgagatcagagtcatctggtgatatgacttcccagctcaacatgtatcacattactattttattcatacacatgcacatttccccaatttctcaatatcataattttggttaggtggttatatttggagttaacatcattatgactccgtaaatgccaattcacagctaagccatatagtatactataattacttttccttttgagcagtttttcctagagttaccattttgttgtttacctagttttgtttatacttactaccaacttaactacaaattcttccctgtctgtatctactatttcttcaaacacattacacattctaccaatttcaccttctcacagtagtatctctagaaatcttccaacctgtttctattgggactggaaactatctactaacctgaggacaagctgtcttcttgtgatcattattcatcatcatcctggtgattccctgggtctctagttaggtcatattccctgttacttgtatcctatgccttcatcttttttagtttacttctttatttttgttgagtaattcctccaataactgcctaagaaaggggacatgacaggtaaattttttaaggcttcgtaagtctaaaactgtcattagtctatccttaatcaacagtttagttggatactgaatacctggttgaaaatcacttttccttctgaatgctgaagactccactatcttctagcttccagtgtggtgtcaagaagtgcaaagccattctgattactgatcctttagatgtgacctgttatttatttcactctggaaactcccttgttttctaaaattgaacagtgatgtgccctgttttggctttttatatctgtactggtcactcaacaggcttttcctaactggtaactcatgtcctctaattctggagagttttctcgagttgttctctattctttgtttttcccctctgtttcctctctctccttctggagcacttatttgaacattggagatcctggacagttgtaattttcttattttttctctaccattttccatttctttggctctttgctctactttcaatagattttatttttcaacctttccaatgaatttttcatttctaatttcatttcttactgtttctcgttcatacttcatggatatagcatccctcttacctttatgtaaggtttgtgtttaattttcgcccacctaactgctctccatttcccctaacttggtgttttaccttttggtttggcctttgtcttgcacataagaggtttttcctcagctgtctactgatctctgaacatgagctcacatttaagggtaagcgctaaaaaaactgaagctctgtgtgatacagcttgctgactgttaactttactgtagggctatcaggttgaaatatttctttggggaattctcaatgtcagaatctttagatcttttaagatgattataattcagagaaaataattatgtatcttctcaactcttgcctgaagagtataaaaacctggtaccctgggttcttaacccttctatttttaacatgtcacccccattctcagccatgtttgtggctcctttattttatccttactagggaataaatctccagacttctgctaagataggaaaaaggtggctgccttggttccaaagttaagaaaaggatccatggaatataattaccccttaaacagatttgcaacaaatcatcctgttttagttccaccatcactcctatttccagaaatagttttcaattcatgaaaattatagaggttctacagtgccaagaagtttgtttcagctttcccacagcaggcttaggatcctgggatttgcaagaaagttactatgctcccttttgcagtcccaaattttgttgctactgtttcttctccattctctctgtcctgttatgtctttcgtaaaaatcttcttactttagcttcagtgaggtttcaagagaaaataaaatttaattgtattgtttgccatctctagcagtttcccatattctttcatcactcttaattaggctttcatccccaccactccactcaaattgctcactcttattagttatcccaaatctccatattgccaagtctaatggctgttttattctctatttgaccgttaagcaatatgtgatgtagacgaccacttctgcatttattaaataccttcttttcttgattccagtgacagaatattctcctgcttttgtactcatcttgctggctgctccttctcctctaattaatactggcatgtgccagggctgaatccttctaaatctgtatacacttcctagataaatcacacttctacatgccaatgactcccaaatccacacccctagaatagattgtcaaatgcagtcagatatccaactgctttttagacatttctacagattttaaaggtgtccaaaatgtcatatacttaaaacagaacacttaactttcttctgtaaatttgcttctctcccagttttttcccccaacctgatctccatatattctccccatcatttactgtattccagtcacattatgctctttatgttcctcaaacatttcattgtctttcttgttctcactatctataaagctcttctctcagatcttcacacagctggctccttttgccattccgatctcaattaaaattcccctttttcaattaggctatctctgactgcctaatgaaagcagtcaccagtctctaccacattatccttttttttgtacacgtaagacaaggtctcactctgtctcccaggctggaatgcagtgacacaatcacagctcactgtagcgtcaacctcctaggctcaagtcctcctgcctcagcctcccaagtagctgggatcacaggcatacgtcatcatgcccagctaatttctaaatttttggtggagatggggtctcactatgttgcccaggctggtatcaaacttctaggcttacacaatcctcccacctcagcctcccaaactgctaggattacaggcacaagccttacagtgcccagccttacactatccatttatccattttaattctctgcacagtacaaaccacaaatttctcacttgtgtattatttgtgtttctcacttgtgtattattcttcttctagaaggcggttctcatgacagcagggacagcttctgtcttgttcatcactgaatccccagtatctaaagtaattatcggaacatagctggtactacgtttggtggtaaattaacacacaaaaatttttttaaattaaactttccttaaattagtgtgtcaaaatagttgatgaattcttttatttttctggaaaaatatcattttacgatgcattctaagatgcacctttctttaccttttgtactccttggatcttttaaactgattcttcaggaaactataggttcaaggtactcttctatatgaccaaccataagtctcagaattctgtttaaacaagaaaaaatgttagatttattcaacttacatagaagtttatcattaaaagggttttaaaataatttttaaaaataaaatttagaactgtcacaaaaatgtatataaccaattttaaattctataaattgtttctaaaagaaaacaaaataacttaaaacatgaataaactaaaacaatcacttaattctggtacagaagttaaaagataaaagtattaaaaaactgtaactataaaaatgttaatgagtatacaacataaaaggataacattgtgacatcaataacaagggaagagtaagaaagttacatttttatatgcaattgaagttagattgttatacgcttaagacagactgttttaactataaggtgtttttatatataagccccatggtaatcacatgtgaggactgacacaagaaaatgagaggggagtcaaagcacaactacaaaaaataaagaaagaaagaaagaaacacagagaaaaacaggaggaaaggaaaagagggacaacagcactacaagaaagacagcaagcccttctctatcagtaatcactttaaacgtaaatggattaaactcctcaatcaaaatacatggagtggctgaatggatttaaaaaaaaaaagaaagatccaactgcatgttgtctccaagattcacctcagatttaagaacagaagctgaaagtgaaagaatggaaaaatatatcccatgcaaatggcagcctaaagagtataagtgaccatacttagataaaatagatgtaaagtcaaatacaagagacaaagaaggacattatatagtaataagagtcaattcattaggaaaatatagcaattataaatatatatatatatacacccaacatcagaggacccaaatatattaagcaaacatcaatagaactgaagggagaaacagcagatacaatagtagcaggagatgtcaataccccactttcaataatggacagataatccaagagaaatcaagaaggaaagcatagatttaaacagtgtatcagtacagtcatcctttgttatctgacatggactggttccaggaccccccaccaaatattaataccaaaatctgcagatgcttaagtcccttatataaaatgatgtagtatttgcctataacctatgtgcctcctcccctatactttaaatcatctctagattacttataatgcataatacaatgtaaatgtgatgtaaataggtgttatactatattggtttcttaaatttgtattatttgtaaatggttttattctctgaatatttttatccacagttggttgaatccacagacgtggaaccttcagatgcagaaggccaactgtatagaccaaatggacctaacagacatacacaaaacattccacccaacaacagcagaatacacattattctcaagtacacagagaacgttctctaggacagatcacctaatagggcacagaacaagttttaacaaatttaaggttgaattatactaaatatcttctctgatcacagtgaaatgtcagaaggaaaactagaaaattcataagcagatgaaatttaaacacactgttgaataaccaaagagtcaaggaagacatcaaaagagaaattagaaaacatcttgagacaaacgaaaacacaacataccaaaatgtatgggatgcagcaaaagtgttctgacagggaatcttatttcagtcaatgactgcattaaaaatgaagaaagattcctgcaggtgtgctaaaaaaaaaaaaaaaaaaaaaaaaggaaagatctcaaacaatgcaactttatacctcaaagaactagaaaaagaagaacaaagcccatagagagcagaaggaaggaaatatgattagagtagaaataaaacagtgaataggaaaaaaaaaaaatcaacaaaactaagagttgtttctttgaaaagactaacaaaattgacaaatctttagctacactaggaataagagaagactcaaaatcagaaataaaaggagaaattacaactgatgtcacagaaataaaaaagtatttttttgagacaactcaataaatatacaccaacaaattagataacctagaaaaaatggataaattcctagaaatatgccatctaccacgaaggctgaatcatgaatagaaaaatgtgaacagagttcacagcagatttattcataatggtctaaaactataaacaatccagatgttcattgacagtacaatggataaacaaaatgtggtattcatataatggaatgctatacaacaaagagaagactgcatgcaacagcacagatgactttacaagagagtacatagtttttttaagaatagacaaattaatcagtaagtcagaatgataaaataaaaaaagaaaatctgagcagacacatataacttgtaattatattgaatcaaaaacttcccaatgaagaaaagccaggaccatatacatgacttcactgaagaattctaccaaacactgaaagaattaataccaatccccctcaaatgcttccaacaaactgaaaagggaacattttcaaactctttatgaagccagcattatgctgatatcaaagccaaagacaccataagaaaaaaactatagaccaatattccttatgcatattgatgaaaaattctcaacaaaatactaccaatccaaacgcaacagtaaattaaaaggattataccacatgaccaggtggtatttatccctgggatttgagcaaggttcaacatatattaataaaaccaatccatgtgctacaccacatcaacaaaaccaaggataaaaatcgtatgagggatctcaattgatgcagaaaaagcatttaacaaaatccaacacctattcatgataaaaaaaaaaaacgccattcaacaaactaggaatagaaggaatttataaaccaagaaaaggaggaatttctctttcttaaaaaataaattggtttgaaaattatgccctttgactcagtaatttcactttgagaaataataaaataatcaaagatgcatctaaacttttatattcattgagatattattaaaaataataaagctaggccagtcacagtggctcatgcctgtaatcctagcactttgggaggctaaggtgggtagatcacttgaggtcatgagttcaaaaacagcctggctaatatggtgaaaccccatctctactacaaatataaaaattagctgggcatggtggcacacgcctgtaatcccagttactcgggagggtgaggcaggagaatcgcttgaacccaggaagcggaggttgcagtgagccgagatagcgccactgcactctgacctgggtgacagagcgagattctgtctctaaaaaaaataaaataaaataaaaacagtaaagctagaacaaatttaaatgtctaactgcattaacagtggcatgaaaatatatcagacataaacctgaatatagcaaaagtatcaactgtgattgctcctaggtagtttatggatggtgttttttgttctttctttagtactttctaaaatttctcccatgaacatgcattacttttataatcagaaagcttaagtgctgcattttttttctttttcttttaattgtccaatactagaggcctagctatacatgaggaggcaaataagataaaacacaacctgttatctattccagagaacaaaaacttaacagagactatttttctagccatttaaagaaaacaaagtttcatctagttaataattttaaaattattaattaaaaatggctaactcaggaatttgaattttaaaaattaaaactacagtttttccctaacctaataacctactgacccactgacctactttggaatttaggtttgttaattctgataccacaggtatttcgggaactgacggatctattaacattaattaaaagtagtgctgaaatttaattgaccggtataatacaaaacctaaggaacaaaccttaactacttttattaccacttatgaaaaattctaacttgcttctgcagattactgattttgtattataactgaaacagtaattatttctaagagaaaaactattttaacttgcaaagaaaggcccaaatatttaatactttttagattcgttgtttaatgtacgaggaaaaaatgaaattaaacagtggttctcaatttattcaatattgaatgtattagccacctctacaaccgatataagatattggcaaaataaaacacatatttggttttacagctatctctacaatcaatttaaatttgaaaactgacctgtaagaataagaaccacatcccaaaccagttttatgaaccagacctcttaaaaccagagaggattctggctcaagacaaacatcaactgacactataactctagcctgctgaatgtcaagatgtaagatattcactaaacctcattaaataaacaaaaactaaaaaattaatacagttctcttagtgggacaatactattccaacgattcaactaatatatatttttcaagtaatgtctgagctttgtattcatataacagactgatcttgcccacagagtataggagcaccttatccccttttcagagataagactaaggcctacatctgtcctcagccccaagtaagccccacataaaacctgaaggtggagggagagcacaagcctcagaatgaatttcacatgtaatcaggtaccataaacctgaagctatacgactctacacctggccttcatcctgacaccagcaggaagaaagagggagccctgtggtaggcagaataacagcctccgaagaatgtccattccctcttccctggaccttatgaagatgttatgtcacatggcaaaaaaggacactgcagatgtgattaaggataaggatcttgagatgtggagattatcctgcattatccaagtgggtccaaaataatcacgtgagttcttaagaggaaaggacctttcctagctgtggtttgatatatcagaaagaacggtcaaaaagatggcaagttaaaggcataagaatgatacaatggaccatggggactcggggagaagggaaggataggaggggggatgagggataaaagaccatacattgggaacagtgctcaggtgatgggtgcaccaaaatctcagaaatcaccactaaagaacttatccatgtaaccaaacaccccctgttccccaaaaacctactgaaatgataattcttttaaaaagatgcaaagttgctggctttgaaagtgaaagaaggtggccacaagccaaggaattcaggtagcctctacaagctggaaaaaacaaggaaacagattttctcctgaagcctccagagagaaatgcagcccgctgacaccttgggttcaggtcagtgagatttgtgttggccttctgagctgcagaactgtaaaacaataaatttgtattgtcttaagccattaagtttgtggttatttgtatggtagcaacagaaaactatacagaatccggtttctctcgataaacctggctctcaccaacacttccctttcagtatttacagcaacctgcataggagatcatcaaagagaatcccattatgccctccattctttttacatcagtcaacaagaaatgcccaagactcccaagtcatcccccatccctatatactttcatccctatatactctgtatgtccctacactgaccccttttctcttcctcccccaattcccgaaatcctttcgcagtgtcttctggaactcatggtacacatcgtcgttaaaatatcctatttcctcagtattgttgttgcacactcttcaccttacttgctcccagctgtaacctctctcccctctgggagttctgctctaactccagccctttcaaacaatggcttctctctcatgtgagataaaatatatttactctcccatatctcagatgaccaagccctgttggtggggtgaacttccttgtaactcactgtcatttctgaattattctctccctccctaaaaccttagctttgactctcatgccaccagactacatcagctattatcccctccttattgtagtcattcacaaaccccaggataagccccttcactccacgaagggtgtgaccctctccaatacctcttttgaatttcaatgtacacaaaatgatcccccaaaactggccagtgagttccttgatctcttctgcaacaattttgtgttccaccccacctcccactcattctgctagtgttaccccagaattcaccattactaatatccaaaagaccctccgtatcctcaattttaagcatctaagccctctctcacaaactgggatagcatgtgatccacctgatgcaaaaagacaaaaaacacaaactttttttaaaaaaacaaaaaaactgctgggcgcagtggctcacacctgtaatcccagcactttgggaggtcaaggtgggtggatcacctgaggtcaggagttcaagaccagcctggccaacatggtgaaaccccgtctctactaaaaatacaaaaattagccgggcgtggtggcaggcgcctgtaatcccaactacttgggaggctaaggcaggagaatcgcttgaacccgggaggtggaggttgcattgagccaagattgctccacagcactccatcctaggtgacagagcgagaggtcgtctcaaaaaaaaaagaaacaatcaaaaaacaaaaacaaaaaaactgacaatatagctctaacttatttatgttgggtctttaaaaagaaaaaaaaaactgtgccagctcataatctttgttggagcctcagtttctcttcctagtaaaggcacaagggagtaaagcaagtttatttgacatggtcgggaagactaaacatagtgacagtcaatgattggttatgttgttaattaccttctatgagaaatgcttcattctttttcatgtttctctaaactctagccttccttttgaccactgagtcctttatacacttatcatattgataagctattctgtggcaaaatgtaatgattgcttaccactttaatatagttcaagttgtgctgactataaaaactttttaaaattccaatttacagtatttactaacacaaacacatataatgcaaataatgaaaaacttgttcagggctctaaggcttctgaagattatttatcacattccaagacaccaattttcctttctagctttagtcttatttctccttcctcatttcccattctactttactgtacacagactccttattctccagctacactaaggaatcacgtcaccattcctagatagtagaaaataaagacctctacgtaaaacaaaggtttgtccaccagtacccaatatattatcaacataaatatcttaatacaataaactggaattgaccttcacagaaaatcatattgtcattcacatcaagattcaactaatcatgatataaactttatgttattagtgaaaaactgaagaggtactatgtgcttcctatggcctctataaaaattatcacaaagttaatggattaaaacaacacaaatttactatcttacagttctgttggtgagagcccaatataggtctcactgggctaaaatcaaggtgggctaaaaccgaggtgttggcagggctgaattccctcctgtaagctctagcagagaatgtttccttgccttttcaagctttagaggccacccgtattctttagctcatagctccctctactccatcttcaagccagcaggaggccaagtccttctcgggctgccatttcttctgcctctttcttcccttattacattaagcccacatagataatctaagataacctccatattttatggttaactgattagcaaccttaattattccttgccatgtaccctaacatagtggcaggttccaggaatcaggatatgaacctctctgaagggtcagtattctgcctaccacgtaccatggaccaaaaagtctctgtttggcaaagacaaaatcaaatattttttgaggggaaaggtgaaacatcaaaggataatttgatctattaatagataaaagactacagtactatgccagtagttcttaacttctgaactatcttaacctttcatatttcttaaagggaattggaaaataatgtgtatgacaattcaggctgcatgcgttcaactgtaactaaagtctaactttattgctatatggtagcaacaggctctagggatattcttctgaacggaaaaatctgtcaatgtccaaatgaatactagcacatatttccccttttggaaaactaattgttacaccataaacacatatgatgtaatttatatgcactaaacagattgtccaaaaaagatgaattaaaccccagactttgtagaagcctattttttaaaagggcaaatgtatatagatttctgagatggatctccagaaaaaaaaaaaagagatacagaattttagcaacctaaaagaagtacagaatttcattagtactataaatcctctagggacctcttaggaaatcggattattaagtagtactttgacaatgctaggtttagagctaattcatgagttgtttaataacatacaactaatatgtataaatataatgacaatgtttgacatattatgtactacatctatgaggtcaccagagccacttaaaacaccaccaaaaaatgcatcaattttcaaggccacaagtattcccctttgtgcaataatcatttcactgaaaagacagttgttttgacttattaaaactcgggtaaactgccagctgcttttgtgtagccaagtaggcccggcaaattcaaaatcatctgaaaagtatttcaaagaagtttagatgcatcctgaaccacagataattcagaaaaaaactaccataaagcatgtcttcttcactaaaataatcattatatctaagtttatatttaggaaaaaatgtaatccctttgaactagaagattttgcaatatataatttatacatatgttacccatttctgcttttctgtccctatttactttcaaagctttcaaatttaaaaaattgatctatctagttccttattattattattattattattttaacccactgactgtttgatccttaccctaaaatgacaaggtgtggaaaatggcaggccaagaccatatctcaatctgtggagtggcaggggagatggggctcaaactgcataggtctttgcatcacgtaagtaggagtaaatataggataaatgaggacgtgtaggtagtacaagaatccaccagccagaaggcctgtgaccaggtttcacagaatccaacatggacataacaagtatattatagaacagacatatactcttgatacagaagacacgagatctgatgggatttctactgattcatctttaagctcactgactcttctgtcatctccattgttactgagcccatgcagtacatctgtatttcatatattgtatttttcagctctgaaatttccatttgattatttcatatagtttttatttttcagagaactatttttacactcctttcagaagtgttcacttttacctcatgaacatgagtactttaaggcttttttctgataattccatcatctggatcatctcagagttgtcaactggcttatgttctttttcctttaaaaatggtcagattttactgtttctttgtatgtcaagtaattttggatcatatcctggacattctagatattaagttatgagattctaggttccattaacatcctctaaagcagcagtcctcaacctttttggcaccagcgactggtttcatgcaatacaatttttccatggacagcggggatggtttctggacaaaactgttccacttcagatcatcacacttgttagggatggtttctggacaaaactgttccacttcagatcatcacacttgttaagttagattctcataaggagcatacaacctagatcccttgcactcgcagttcactgcagggttcacgctcctatgagaatctaatgctgctactgatatgacaggaggcggagctcaggcgctaatgctcactagccagtcacctacctcctgctgtgcggcctggttcctaacaggccacagtaccaatcgttgtttcagttttcaaagcgttcacaatgctgcttaaatctatcctccgcatgcatctctcaggggcaactctgggatttgagcagtggtttacaccatagttcagctctctaggtctttgccatgtttctttcgctctgttccatgtacgtgtagctcatggatgcagtaggtaggacctttgtgtgttcatacatgcaattagggaatctccccccaaactaggtgtcttctctttgagacttccaaagcatgctccagcttccagagttctctttcccaattcctctggccagagagacggctttcttcttgggattttaagtacatataccactatggcaatgtaattttacaaatggagatggtctcagggcacagctgggagagaaaaaaaggggggaattttctttgtcctatgactagaaataaagggtttctcttggagtttttgctaactgctgcactcaacatgtacttctacaacccagcctaccatttggttaaagctggataacaaaaagaaaaaaaaaatggtaagctaagcactacacaagctattcaggttttgacttcccttctcagtttgcctattactgtttactttcgaaagtcttcagataattgtttttgtttctatctagagggtttttgttgttgtttttgttttgtttggggggagtggtgtgttttgagatagggcctcactctctcaccaaggctgcagtgcagtggtgtgaacacagctcactgcagcctcgacctcctgggctcaagcaattccctgcctcagcctcccaatgtagctgggattacaggtacacaccatcatgccctattgatttttaactttttaattttttgcagagacaagatctcattatgttgcccaggctggtctctaactcctgggctcaagcaatcctcctgccgtgacctcccaaattgctgggattaaaggcatgagccatagcatcggcctaaccggggttttaagttctaatcagagaggcttactccacttttgcctatccattatgttttatccatttcccaattaaatttcacctaatggctttagtagtcacgactaattgttatctagaatcattatttcattaggagtatgcactgtggtgagtttgtaagccgatcgttctccagtgtttctgtttgtttgtctgtttttgcgcttgtttttgagacagggtcttattctgtcacccaggctggagtgcagtggcacaatctcagctcactgcagcctcgatctcctgggttcaagtgatcctcctgcctcagcctcctcagcagccgagactacaggcatgcaccaccatgcctagggctaatttttgtgtttttagaagagacgaggtcttgctatgttgcccaggctgatctcaaactactgagctcaagcaatcctcccacctcagcctgccaaagtgtttggattacaggcatgggccaccacatctgacctccaatgttacttaatagctacaattcttctaaagatatgctttccctcttaactatttggtagtcctggaatataatctctacagaaaaagattaataaatggttgactttttcctttcacttaccaattattttcagaataataaattggtgtatatgagggttttttaaaacaattattatgaattcttgaattactacatttttgtgtatttcagtgtactataatcattacactttttagtatttatttatattaaaatttctgtctttttttttaagagacaggatctcactctgtcactcaggctagagtgtggtggcctaatcacagctcactgcaacctcaaactcctaggctcaagtggccctcccgcctcagcctcccaaggagctgggactacatgcatgagccaccatgcctggcttatacatatttttttaaatttgtcaagtgcagtagtgagaagagggtgaaagagtagaacaaggagttcaatctgtaacggactgtgaacaatcaaatgaaataacccattacctttagactagtcatagtacacttttttaaacctatttttatgggaaattacaaatatacacaaagttagaataataatataattaatcctatatatccttcacccagtttccataattatcaactcatggctaatcaatcttgtttcatctgttctgctccttcccttcctctccactctttcggattatttgaagcaaatcccaagtactgtatcattccatctgtaaacagtccagtatatttgtataaactacaagggcttttataaaacataactacaatatcattatcatatcttacgaagtcaacaaaagacatataagacctgtttttacacgtaaaataacaaaacgccctgagagaaattataaaagtctaaatgtaagaaggcatacaaccttgcaattgattggaagtctcaacactgaaaaacatccaatatctccaaattgatttataaattctacactaagctagacaaaatccaatcaggtttgtggcgggtagtgcggaggactgcttataagctgagtgcagaatttttattgaaattcaaaggatcacgaaagccaaggtaattctgaagaacaaattagaggatttaaactatcagatatcatgacttattataaagctacagtaattaaaagagtatggcaatggcatgacagaccaacagaatagagtccaaaaataaatccatgaataaacagtcccttgcattacaacaaaagtactactgcattacggtagggaaaggatgatcttctcaataaatactactggaacaactggacttccacacggaaaataaaatgaactatgaggcttacatatatcacacataaacctaaatgcaatagttgtaacagtcaagtttatagaagaaaacatagataacatcttcttggctttagggtaggcaaagatttcttaaatgaaacataaaaagcgttaaccataaaaaaatttgataaaatggacttcattaaaattaagaaattatcttaatcaaaatacactactagagtgaagaagcaagccaaagactaggaaagatatcttcaatacaactgaacaactgaaattatctatttctggggtaatcaagacaaccaactcaacagaaaaatcagcaaaagacataacagtcatatccccaaagaggatattcaaatggtcaacaggcatttgaaaatattctaagccttttaaatcatcagggaattacgaattaaaactacaatagacctttactacatatgctccataagagctaaaattaaaaacactaataatttcaagtgttggtgaggatgtagaacaatgagaactctttgtacactgctaatgggaatgtaaattaatttaactactttggaaaactaggataatctcctaaagctaaacagccagataccttaagacccagcaatttcactcttaggtgtctactcaacagaaatgtgtacacatgtggaccaaaagacacgctcaagaatgttcacagaagtattcttcataacagccaatactagaaacaccccaaatgttcatcacagtagaataaatactgacatatccatacaatgaagtatttcacagcaacaacagaaaagatgaaccactgctacatgcatcaacatggatgagtcataaacaagattttaaaaggctaggcacagaattcaaaaatagacaatactgaatgagtcacataatagttatctttgggagtgtgtaataactgttaaggggcatgaaggaggctcctgggttgacgaaaatgtcctatatcttattcttgatattagttaaatgggtgttgacttcataaaaattcatcaaaatgacactcaggatttatgcactttataatatgtgtgttataatttgatgaaagagtaaacaaaaaaaagttagtgatatcatgtcagtcccttgattttttaaatttaattttttttggttatttgactatgaaattaaaaagtctagtaaagctaagttctacatcagcctgcctctttgtgggtactaaaagtcatgttcacgttctttcttaacacaattactgaggaattgtcttggtatgtggatccttcccataacatgaggtcaacagaaagtctagcttgaagctagagttatccaatattcacaaactagaaaattgtaacactgcaggtacttcttcttagtgtaattataaacaatcaatttttctttattacattccagatcactagtttccacagtttctatttggcaaaaagaggtaaaaaaaaaaaaaaaaaaaaaaaaagccgggcacagtggctcacgcctgtaatcccagcactttgggaggccaaggcgggcggatcacgaggtcaggagatcgagaccatcctggctaacacagtgaaaccctgtctctactaaaaatacaaaaaaaattagctgggtgtggtggcaggcgcctatagtcccaactattcgggaccctgaggcaggagaatcacgtgaacccgagaggtggagcttgcagtgagccaagatcgcaccactgcactccagcctgggcgacacagcgagactccatcaaaaaaaaaaaaaaaaaaaaaaaacacaacttgaggcttcacatctaagcttagttttagctggaattgaaaacactcagcaaatcaaggcaatgtatcacaataaggttgtcataagaatgaaataaatattaaatgtaaagtgcttagaatataatgcctcaaagtaaatgctcaaaattgtattaataccgttctaagaaacacatgtaacagacccttattcttgaatttccttcaaaatataataaatatatggtagtaaaaccagacccacttttaaacaaagtatttttatggagctgagaacaaaatcaatttttaatgaatctgaactgaacatattaaagtacaggatcaataaaaacttagtaaattgtactcaagaattttttaagttctaaattatacttattggtatttaactatgaccctacgattaaaataactgagataatcaggaaaaatactgctaatataaagagctcatctttgcattgtattttttacatttgcaaagttgtatttcatttcattaccatattactataaaataattaaacctattttataaaacttaagtcataaacttattaaatccagcaaagaatcgcagaacaggccaggcgcagtggctcacactgtaatcccagcactttgggaagccaaggaaggcggatcatgaggtcaggagttcgagaccagcctggccaacatagtgaaaccctgtctttactaaaaatacaaaaattagccgggtatggtggcacacacctgtagtcccagctactcagaaggctgaggcagaggttgcagtaagctgagacaatgccagcctaggtgccagagcaagactctgtccccctcacccccccaccaaaaaaaaaaaatcacagaacaagaaatacttatacttgtgatcacataatgatacgccaccaaacaaaaaaattcttttcaataacagtaccatcatgtaaacaaagtatatgtaaaagcagtttgaaaaaaaaaggggactatattttttaagcagtcctattgcaatactctaagtgtatttttaatggaaataaatgttaatttgaaagtaacagtagccaggcaaggtggctcacacctgtaatcccagcgctttgggaggcggaggcaggcagatcgttagagctcaggagttcaagaccagcctgggcaacatggcaaaaccccttatctactaaaaatacaaaaattagctgggtgttgtggcacgtgcctatggtctcagctacttgggaagctgaggcaggaggatcaactaagccctggaagtccaggctgcaatgagctgtgactgcaccactgcactccaggctgggtgacagaacaagaccttgtctcaaaataaaaaataaaaaataaaattaactggatgtaatttccagttttatacatagctgctaaacatgtttcttaaactttatacttggaaatcattcaaacatgcagaaaagttaagaatagttcaaagagcttctacatatcctttatcctgatttgaccaactgtcaacaacaatcctgttgaccaactgtcaacattttgcattattgtccatatcatacataaacatattttttgaaccatttgaaagtaaaatgcacatatcatacctttttacctctaaatacttcaactatacctcctaacaacaaggatattctcttaaatatctacagtatagttaccaacttcaggaaacttaacagttatacagtatcttaatgtaatgcctattttctctctttttttgttttagttgagcaaaaactgccctccaagactttttccctcttccaatactgaatccaatccagggtcatgtactgcatttagctgtcatgtctacccagacttctttaagctgaaacacttttctttcagtaaatatcttttgttttgtttttttgagacagggcctaactatgttgcccaggctggtcttgaactcctaggttcaaatgatcttcctgcctcagcctcctgggtagctgggactaggggtgcataccaacacacccggcttctgctaaataccttttaaacaatcttatctttacatggtatcctgcaagataagattttaaaagtggaattcttaaaaaaaaccatatagggaagttccattaaaaaaagaggttcagtgtaagagctgcgaaaagttcagaagacttaaataaaaaaaatacataaatcttcctattcaagagtggctttttagcatatggtatttattttattttatattttattttttttaattttttttgagatggagtctcgctctgtccaggctggtgtaatctcggctcactgcaacctctgccttccgggttccagcaattctctgtctcagcctcccaagtagctgggattacaggctcccgccaccacacctggctaattttttgtatttttagtagagatggggttttaccacgctggccaggctggtctcaaactcctgaccacaggtgatccacccacctcggccttccaaagtgctgggattacaggcgtgagccaccacgcccggtctatagtatatacattttaaagctttataatgaggaggtttccaggtttctttgagatcagcaattcttagattagaggtttatattctctctattaaatagcaatatacaatcaatttatacaaataaatttggccaatgatttgattggtatctgcagaaaatggacctaggctgggcacggtggctcatgcttgtaatcacagcactttgggaggctgaggcagaaggaccacttaagtccaggagttctagagcagcctaagcagcatagtgaaacctcatctctacaaaaaataaacaaagttagctgggcatggtggtatgcacctatagtctcagctactcaggaggctaaggtgcgacgatcgcttgagcctgggagatgcagtgagctgagatcatgccactgcactctggcgtgggtgacagagcaagaccgtgtctcaaaaagaaaaaaaggtaggggggagccaggcatggtggctcacacctgtaatcccaacactttggaaggctgaggttgggggaacacctgaggtcaggagttcaagaccagcctgtccaacatggcaaaaccccatctctactaaaaatacaaaaatttgccaggcatggtggcgcatgcttgtagtcccagctactcagaaggttgaggcacgagaatcacttgaacccaggaggtggaggttgaagccaagagagcaccactgcactccagcctgggtgacagagcaagattctgtctctaaaataaataaataaaataactttttaaaaaaggatctacagaaaattactattttcatcaaaattctctcctccagttaacaaaaacacccagtctcaataagcaaacctttaaagaatggggaatgattttgatcatgcatagacataacagttattggaactggcacataccttgttctttcactggacacttactgtgtgccaaatatgtgccaggcctatgctaactgtggagttgagaaatccagtggtgagctaaaaaggcacagaacccactcttaggaaactggtaatttagcaaaccaccaagactcctgttttcagacagtaaaggtattagttttccctaatttggaaatgaagcaattagattcagagtggtaaatgtgccccgagtcacataactaagtgttctcaagggacaaagaaggtaaacacaaaaattatggtcttctatctcctaatatagtacttaacctgcctgtgtctgactacaaaagagttacttaaccatatcctttaggcctatccattgactccaaagggacagtgtactttcatctccaatgaactacttttgtttcattgagtcagtcatcaactaatcttttaagtacttaagatgttaggtatgtaaggtattatagtaacattaaaacttggttaaaaacagagcagcatactaattttctttctacatattcccacatattcattttagaataaaaataatagaagaatccatttcccctgatttactattttaaaatgacacaggtcaatataattagaatatgtgtaatactttccactaaagaaaaaagtataattaagtcactgagaattggcatggactcctatctctctctaatttccccccaattcatctcttaaaccatagcactcaaatctataaatactccttcagccatgtagagcaaggatcagctaaacttattctgtaaagggccacacgggtaaattttttttttttttttgagacggagtcttgctctgttgcccaagctggagtgcagtggcatgatctcggctcactgcaagcgccgactcccgggttcacgccattcttctgcctcagcctcctgagtagctgggactacaggcgcctgccaccacgcctggctaattgtttgtatttttagtagagacggagtttcaccgtgttagccaggatggtctcgatatcctgacctcataatctgcctgcctcggcctcccaaagtgctggggtctctgctgtaactacagacatatgtcgtggggatacattttgagaaatgcacaggcaatctgtcattgtgtcaacatcacagactatttctatacctagatggtatagcctactatacacctagacgatctggaatagcctattgctcctaggctacaaacctgcacagcatgcaatggtactgaatactcaaggcaactgtaacacaatataagtatttgagtatctaaacatatcttaacatagaaaaggtaatgggttgtgccatgatgacatgatggccatgatgttaccaggcaatagcaatttttcagctccattataatctcatgggaccactgtcgtatatttggtccatcactgaccatgtaatgcatgactgtacttaactgctgctatagcctaaaagcagtcatacacaaaacctaaaaaataagaatggctaatgttctaataaagctttactcataaacactaaaaattaaatttcatataactttcacgtgtcacaagttagtcttcgagattttttttcaaccatttacaaatgcaaacaccactcttagctcatgagtcataccaaagcaggcaccaggctgaataaatttggtggtgtgcagaccccagtgaaggcctgcttgtaaagaggagctgcagtctggctcttcttttacctcagtcagctgacactttatctctatagctaaggcctggcaggaaataattcttactcgactttcagtcatttgcaaatcatcttccttaaactcaggaaaaggtaagttatgactcttacttttgagcactagttttgagaaatttcaggaattgctaaaatactttacatctggatttcaattatttttcccaataaataaccttcttactcctcataagaatgaaaattctaaagataaataaaagctgccaaggaaagtagcagatcattacccaagtatttttataattccttgtcctatgcttccaccggtacactgcaaattccacccaaccatgattaagggaaaagaaacaaagatagcatacctttgagctcaaaatgatgattgaaggtatctagtgagacttgccaagttctaaagattcatttaagaggactgtagaattatccaaaggcatcttacaatgtgatagaatcagcttctgagctccagcagctttgcaggaacaagtaaaaattctgcaaagaaacagtacttactgaaataatgctaaccaatttaagtaacattattatcactagtatttttgtttcatcgacgtatagaacatttattgcgagcctcctctacgtgccaagaattgggaatgtgtcaataaatagatcagatctcatcaacccctctgggaactcaaccgtaaatgggacaaaaagtttgaaaaatcacgatggtgtgaagggaaagcataacagagatacaaaccagtttgctggaaattggttagaaaagttctcctgggacgggtgcggtggctcatgcctgtgatcccagcactttgggaggccgaggcaggcagatcacttgaagccaggagttcaagatcagcctggccaacatggtgaaacctcgtccctactaaaaatacaaaaattagccaggcatggtggcatgcacctataatcccagctactagggaggctgaggcaggagaatagctttaactcgggagatggaggttccagtgagccgagattgcgccactgcactccagcctgggcgacagaacaagactctgtctttttaaaaaaaaaaaaaaaaaaaaaaaaggtttccctaaaggaagagaatttaatgcaagaatgtgtatgatctagccaaataaagcaagagggaagaggtgagaaagaaaattttttgtccaaagggaacagtgtgttcaaatggctaggtgtaggtgaaaatatgacatttgtgtggaagtaaaagaagtccaatgtagatgttcagaatgaaacaggaaatgagaaagggcatttcctgagacaagatgggcaaagaaagaaagcaaaaggtgaagcaatttgccctgaatcacacagggctaaaggcagagcccattttaaacccttaccacttgactgcaatatactagccattctgaaattctaagcaggaaactaaaagttcctagagaggaatttcaggggacctttgcaagagcccaaggaatgactgccctgggccaatagctgaccttgccatggatggataaaagaatcaactgatcatcaagcgtccattgtgcagaatgagaaaaaagtctcatcacaattctcaactaataattaacaattactaagcactttactatgtgtaaagccctgttttaagcacttgacatatatttattcaatcctcacaacatcactatcaagcaagtgctttcattatcctatctatctaattttaatgacacagtccaatcatggctattaattttcttgtactgacaacaagaaatgtcaacaatacttcttgacacaatattgaaagcactttagtgactcttctttcagaaaagtactgctcaaatatcaacaaaaaaagactttagaacattaatttggttcctttagcttttctaatttaataccactgtttcaggtccacataaaaaactgagggtaaagtacagagatttcccattgactccattaatgcacagccttccccatattcaacattccccaccagagtggtacatttactacaactgacaaacctacactgacacatccttatcacccaaaattttaggcttcactcttagtgctgtacattttatgaatttggacaaacataatggcatgcatccactatcatatcacaccgaatagtttcatcggcctaaaagccctctgtgctctgcatatgcatccctcccctcactaacccctacaccacattcatttttttattacctccataattttgccttttccagaatgtcatgaagttggaatcatacaatatgtagtagccatttcagactggctcctttcacttagtaaatacacatttaagatttctccatgtcttttcacggcttgataatttctttttggcactgaatgatatattccattgtctgaatataccacagtttatccgctcacataatgaaagacattttggttgcttccaagttttggcaattattgaaaaggatgctataaacttccatataaagatttttgtatggatagaaactgtcaattctttggttgctagatcatatggtaagactatgtttagtttcgtaagaacctgccaaactgcctttcaatgaggctgtaccattttgcattctaaccagcaatgaatgagagttcctgttgttccacatcctcaccagcactggatgtagttagtattttggattttcaccattcaaatatgtatgtagtagtatctcattttaatttgcatttccatgatgacagatgatatagtgcatcttttcacatgcttcttgaggtttgtatatcttctttggtaaggttatctgtcagtgtacctggcccattttttaactggtttgttggttctcttactgttaagttttaagagtccattgtgtactttggataaaagtcctttatcaaatatgtcttttgcaaatatcttcaagtctgtggtttgtctttttattcttttgataagtacctctcacagagcagacatttttaattaaatttaattttttctaacacggaatacgtctttgatgttgaggataaaaactcgctgccaaacccagtcatctagatattctcttacgttatcttctaggagttttatacttttacaatttacatttaggtctctgatccattttgagttaatttttatgaagggtataaggtctgtcgagattcatttttttgcacatagacagttgctccggtaccatttgttgaaaactatcttttctccattgtattgtctttgttcctctgtgaaccattagttgactatgcaatcatgaattgcattaacaatgtttcaggacagaccgtatatatgacagtggtcccataaaattataatatggagctgaaaaattcctattgtctagtgactttatagctgttgtagccattcataacattgtaatgcaattgctttttaaatacatttagtgtagtctaagtgtacagtgtatataaagtctacagtagtgtaccctaatgtcctaagccttcacattcaatcatcactcactcactgactcaccctacgcaacttccagcccaacaagctccatggtaagtactctatataaagtataccatcatcttttaaactgtatgtttacattccttttctacattcagatacacaaactcttactgttatattaaaattacctatagtattcactacagttaacatgctgtacagtctagtaacagtaggctacaccatacagcctaggtgcagagcaggctatacatctaagtttgtgtaaatatactctatgttatttgaacaatgacaaaatcatccaacaatgcatttctcatctcagaatgtatccctgtcattaagtgacacatgactgtactgatgtggatctattcctggtctctctattctgttccactgatctattaaaatatttgtctatgctttcaccaataccacactgcttgatgactgtagttgtaaagtaagtcttgaagtcaggcaatgttggatctccaattttgttcttttctttcaattttaagttgcctattctgggtcttttgcctctccatataaacttattggaatcagtttgttaatatctacaacaaactgcaattttgactagaattatattcagtctacaaataaaattgtgaagaactgacaccttgttaatatagtcttcctatccatgaacatgttatttagttattgtttatcagagttttgaagttttctttgtacatattttatatatattttattagatttatacctaagtatttattttgggagatattaatgtaatggtattgtgtttttaattttagaattccacttgttcactgctggtatataggaatataatctacttttgcatattaaccttgtatcctgctaccttgtgcttattggttccagtttgtcaattcttttggatcttctacatagacaatcatatcatcttgcaaacaaaatgagttttatttcttctttcccaatcagtatacatttcttttcatttttttatcttactgcattagctagaacttccagtatgatgtgaaaaggagtggtaaaacgggacatccttatcctgttcctgatcttactgggaatcttaagttctagattctcaccattacataaaacgttagctatagttttattctcacattcataaaatacttttaatcttccattcatatcccaataccaacacctaattcagtgacgctctttactgcatttaggctgttatgtccccttacctcttttgaaaaaattattatttaccactctgaagcacaattcacatactataacactcacccatttaaaacctacaattcagtattttttagtgtatttacagagttgtgcaactatcactacaatctaattttagaacatttttatcccccccccactttgctgagctgtagatttttttaatagatgttctttctcaagttgaagaagtttctctctattccaagttttacagttacagagtttttttttaaatcatgaatgggtgttgggttctgtcaaatgttttttaaacatctattgatatgatcatatgatttggttttctttagccagttaatgtaatggattaatttcttacatgccttggataaatcccacttgatcacagcatatagttcattttataaatgttgaatttgatttgctaatattttgttggggatttttgcatttatgttcataagagatattggtctacagttttcttttcttgcaatatctttgtctggttttaggattagagtaatactggcctcacagaataagttagaaagtattccctctgcttctgtcttgcaaaagagaatgttaacattggtgtaatttcttccttaaatgtttggtagaattagaactcaccaatgaacccatctggacctggtgatttctatcttaaaagattataaataattgttgactcaatttaatagatataggcctattcagattgtctacttcttgtatgacttttggcagattgcgtccttcaaggaattggtccatttcatctaggttatcaaattcgtgggcacagagttgttcataatattcctttatatttttaatataaatggaaatctgttatgatttctactttcatgtcttctattagtaatattagcgtatcctttttccttagttagcctagctggaagcacatcaattttattaatctcttcaaagaaccagcttttggttttgttgattttctctatgatttcttattttccatttcactggctgttttgtttgttttgagatggagtcttgctctgtcacccaggctggagtgcagtggcacaatctcggctcactgcagcctccgcctcccgggttcaagcgattctcctgcctcagcctcccaattagctgggactacaggcgcctgacaccatgcctggttaattttttgaattttttgtatttttagtagagacggggtttcaccgtgttagccaggatggtctcaatctcctgacctcgtgatccacccacctctgcctcccaaagtgctgggattacaggcgcgagccaccacgcccagcctctgctctaatttttattgtttcctttcttctgcttactttgtatttaatttgctctactttttgtagtttcctaaggcagaaactttggttttagatctttactcttttctatgtattccacgctataaatttccctctaggcattccatttgttgcatcccgcatattttgttaagttgttttcattttcatttagttcaaaacatttttagatttctcttgatacatcagtgtagtgtggcaaaaaaagatgaaaataaaaatttttttaatagatttcttgagaatctttgacccatgtgttgtttaatcttcaagtatttggggattttccagctgttactgatttctactttaattatattgtggtctgagaacagatactgtctgatttctattcttttaaatttgttaaggtgttttatggcccaaaatgttgtctcttgtggtgagtgttccatgtaggcttgagaagaatgtgtattgtgctgttgttggatgaagtagtctatagatgtcaattatatcaagttgtttgacagcactgttgaattcatctatgtttttactggttttctgcccgctacatctgtccatttctgataatggggtattaaagtctccattataagagcagattaatctgtttctccttgcagttctgtttttgcctcacatacttacatgctccactgttagctgcacagatgtttaggactactatatcttcttggagaactgacccatttatcattatttatgcaatgcccctctttattccggataacttccttgctctgagagctgctctgtctgaaattaatatagctattcatgctttctttcggttagtgttagcatattgtatttttctccatccattttcttttaatctatgtatctatatttaaagtgggtttttttggtagacaacataaagttaagccttgatttttcatccactctggcactgtcttttaattggtgtgctgagatcactaacatttaaagtgatcattgatacagttagattactagctaccatatttgtgattgctttctgttctttattcctattttagtcttccagtctttttctgcctgttgtagttttacatgattctattttcctctcctttcttggtatacttttttgcttttttgttttactttttttagtagttgccctggagttcacaatacacatttacaactaatctaagtctactttcaaataacactaaaccactttatgggtagtacaagtaccacgtaataatcctaatacctccctcctatcctttgtatcattcctgtcattcatttcacttttacataagcgcatacatacatacgtgtatatataagcatacataattgaatacactgttgataacattattttggacaaaccatcagttaaaaagataatgatttttccttaagcctgttaatgtggtggatcacactgatttttgaatatttaacctgccatgtatccctagaataaactccatgtgattactatagtgtaagattcttttggccgggcacggtggctcacacctgtaatcccagcactttgggaggccgaggtgggcggatcatgaggtcaggagatcgagaccatcctggctaatacagtgaaaccctgtctctactaaaaatacaaaaaattagccgggtgtggtggcacgggcctgtagtcccagctactcaggaggctgaggcaggagaatcacttgaacccgggaggcagaggttgcagtgagccgagatcacgccactgcactccagcccgggcaacagagccagactctgtctcaaaacacagaagattatttttatattttgctgaattctatttgctaatattttgttaaggatttttgtgtctctataaagaatattggtttttaatttgttgtttctgttctgcctttgtctggttgcagtatcaggataatacttgaaatgttcccttctcttctgttttttagaagagactatgtagattagactctgcagtgaaaccaactgggcctagagatatctttttggggagtttcagaattacaaaatcaatttgcttaatggttatgggatagtagtagtagaatgttggctttttcattactctcatacattgctggtgggagtataaattgatataaactttatagagaacattatgtcaatacccttaacaaaattacaaatgtttttaccctttggtacagaaatataggggttataaccagcattttaaaaatgaaacatggtggggggtggggagtcggatcgcaggacacctagttatggtaaagggtatttcctgaaactgttgtttcagatatgtgtgtatgagtgtactaggtcataacataaaatatatttcttactatgagttgtggtcatagaagtttgggagctattgtttcagctttaaaaggataacctgaggcaaaaattataagctgacacttagggaagggagggtataatgtcaggatatgaagagaaagttaaataaggcagataaggagacaaagcaaacgtgaaatatgacattaccaagctatgcagagccatgagaaaactggcctatttggggtaaatgcagaggagagaggacggggagaatttatctgaccagtgctaaagagacataagagatctggcaaagattttcccacagggtattaatccctaaacaaaaatgccaaatatttattgttttcctcatgacactatctttgcttaaaaggttgactgtagacattcattgtgctcagacttcaaagaactatatcagtgctatggtctaaatgtttgtgcccctccaaaattcttatgttgaaacttaatccccaatgtgacagtattaagacatggggcctttggatggtgattaggtcatgagggctccaccctcatcaatgagatcagtgcccttataaaaggcctgagggagcttgttcccctccctttccatcatgtgaggacacagcaacaaggcaccagaatgggccttcaccagatactgcatctactagcaccttgattttggacttcccagtctctagaactgaaaacaataaatttctgttgcttataaattactcagactaagatactttgttacagcagccaaatggactaagacaaccgacaagctataagaggcagttccaatgcccctggatgacactgaatcccagatcatcaatgagtaccctcatgtcaatacattttcctcaagctaaccttatattctgccccccacccaatccaacacctttcaaaacattctcatacctgtttccttggtttctccagatgcttattattcaagtcctgcaattttattttattttacttttacttgatagggtttcgctctgttgcccaggctggagtgcaatggagcaatcataattgactaccgcctcaaactcctgggctcaagtgatcctcccgcctcagcctctggagcagctagaactacaggcacaaaccactatacccagccaatttttaaaaaaagttttttgtaaagacaaggtctcactatgttgcccaggctggtctcaaactcctagcctcaagtggtcctcctgccttggcttcccacagcactgggattgtaggtgcaagccactgagcctgcagtcctgcaattctttttgtatataggatagttctttccagagcagggcttgtaattctcttcttgggatgtgctaagaccctgactatagttattaaccagaggataatgagtcatagtagaggcagatcttaagaataaatgtcattggaccaggcgtggtagctcatgcctgtaatcccagcactttgggaggccaaggtgggcagatcacctgagttgaggcattcgagaccagcctgaccaacatggtgaaaatacaaaaatacaaaaattagccgggcgtggtggtgcacttctgtaatcccagctactcaggaagctgaggcaggagaaccaattgaacccggaaagcggagaccgcagtgagccgagattggccactgcacttcagcctgggtaacagagcaaaaatctgcctcaaaaaaataaaaaataaaaataaaaataaataaacatcattgaacatttatggggtcactgcacagtcttcaagcaatgatgacaggaggggtggcagggggtctttcctctgccaaagggaaatgggatgcttctccttgccaggaagcttcagcatgaattgtaggattaaaaattctgaagtacagggatccactctttccctattagggccctgacttagacacacaacacctgcaaaggttgcatatttagtcttctctgcagttgtatcaccttaataatccgattcaaggccaacattttagcatagtctccctgaagtcaacaggataagattctgttatcctataaaactgtcatagaagccctctgggttccacagtatgccttaaattggcaattagttgtgctaaatctaaccacttttttaaggccaccaacaaaaacaacctcataccacaatccttaaaattatcactgcccccacaccgatcaagtgaagtatctgttttctcccaaaaccttgacttctatgagcctcactcccattaattacagatgaaagctttagaattacaatgccaactgtatccaagggtcatcaacacctcatttactaacagcaatagtttcccctaatatgcagatgaactggtgaaaattcaactccaaaaatggcattatgaggatctgcttttgtagtatgaactactcctagaaaacaacacctgaggcaaaacagactgttgacacaggtatcccacagcttcaaatttatattaattttacaatatacatttaaaataaataaatccacagtagacatacagggtttttctccctcccaaatctttttaatactaaggttcagttctaaggaaacaaagtgaggtaatgttaaactcatacaagctacaaattttagaggtattttaaatactctttctcccttactccttcacaattttcccaattctgtgactggaattaatcttcataaattcctcctcccatcccctgcctccagcaccagccctcttgaatccatcccttgctttatatcagaagactctaacattcatatttgatcatgtcactcaaattccttgagatataaaaattgctccctataacaactcctttgtgaactccagatttagtccccaaggttcagccttatctctttcaagtctctcatgatttaaccttttccatttacttgctattccctacatacatcaaattttgtcacacctccaagtctatgctcacggttttttcagtctacaatatttttacagatattcttacaaaagtgcaattttaacgttggtaaaatggtttctttctcaaatgtactagaaaaaaattcaattttaaatggaactacagtaatttgtgtcccttaattaatctgtcacataaattcaaatttctattttttttgtgtttttttgagatggagtttcactcttgttgccaggctggagtgcaatggcatgatctcagctcactgcaacccacacctcctgggttcaagcgattctcctgcctcagcctcccaagtagctgggattacaggcatgcgccatcacgcctggctaattttttgtatttagcagagacggggtttcaccgtgttagtcacaccggtcttgaactcctgacctaaggtgatccacctgccttggcctcccaaagtgctgggactgcaggcgtgcgtcaacacacctggctcaaattactatgttttatagagctcaccttatagattttagatgtgtgctgctactctcaaaattctgattcttgctatggttataccataccacggtggtaacaccccatgaattattggccttcacaaatatgcaaaggaaagaaatgggcctcagactcagacatacttgagcaaattattcactttgcttgaatttcagtttcctcacctctgaattctctctaaatacatctatggatgctatgcaatttttactaatatcttatattgatttgtgtccatatggtatgcatatatgagtgtgtatgtaactagacaaactgatcttagtatttatgtggaagagcaaaaggctaagaatagctacaataatttgaagaagaaaatggagagagcagtcctacaaataatcaagccttataatatgggtctttcaaaacagagatagagagatcacaaatagagtcatatgtatattaaaaaggcagcattataaacaaagagggaaagaatggactatccattaatggtagagacaacaggtacccaaatagggcaaaaagttataccggatttctttcttaccacacgtaaacataaattccaagtgcttcagacccaaatatgaaggcaaaacatatcaatttttagaagaaaacacacaataccttcatatctatagaggagaaaataactttcttaaactatcataaaccttaaaggaaaacaagccaagcacaaactttaaagaaaaaaaataatatatttggcttcattctaattcaaatctgaagtctaatttaatttaaatttttaatttttctaattaccaaaatatcccataaacaaatgaaaagacaaaccacggactgagaaaatataccacagaagattagtatccaaagttcgtaacaagatactacatatcagtaagaaaaaaagataaacaaaagatgccaaccagtaataaactgtttttttttaaaaaaaaaagaagcataaagaacgaataaacataagaaaacatgctaaactttatgaacagaataagtagttggaaaaataggtaacttaaacaggtatcctaccccttaaggaacagtaagattaacagccatatattcttaacctagattcatcaactgttaacaatttgccacatctatactctttccaccatatatatgtatgtatttgtaaatgcacactttccctctctcatatatatgtatgcatctccatatacaacatacaaacatgcacatgtacacacacaaatacacacactcatttacttctgaaccatataaaatgactaactctaagcttgaaagcaaggaagctatcaaaacctaatatggtcatataaaaaagatttagaagcaaatctgaaggggctcctactggccagagacaggccaggttgaataaaaagaaattgtgaggcacagtaacatataatgtgtattgtttagcataagacaaacgaacaggctgggcgcagtggctcatgcctgtaatcccagcactttgggagatggaggcgggcggatcgcgaggtcaggagatcgagaccatcctggctaacacggtgaaaccccgtctctactaaaaattaaaaaaaaaaaattagctaggcatggtggtgggcacctgtagtcccagctacttgggaggctgaggcaggagaatggcatgaatctgggaggcggagcttgcagtgagcgagatggcaccactgtactccagcctgggagacagacccagactctgtcaaaaacaaacaaacaaacaaaaccagacaaacggacaaatgtagaactctcacttgtgaccaaagagtagctagagtatcaagtcaaccctcagggtacagaacagtcatcactatttacaccttcttggtccaatggaccctttatattttcaagtcatcttatgaattatttatacgagaataaagggataataaaaaaaattgacactgaaaaattaaacatatcacaaccaaatttttattccattttttgaggctttgaaagtgtatctacatgacatgggtaatgtcctctgaatgcaactggctgatcatccatgcacgaatctggaacataatcatcctgtactgcttccaggtttcatatacatctctaatacctctccagatacatctccacatacatttcaaatatatttctaatacttctccagatttctaatacatacctctaatttcatatcagcttatcaatatttctactcttcttgcaatttcatcataaaaaaaattgaagaagtttttgaaacctttgatggcttataattttattgaagagtggataccatctttttttgctccaaaactgtaaaacattcttgtttttaagcatcaattaaaatgagcaatccaacaacttttttctttttaaataatctatttccttccagtcacctttgttacatgtctttagcattacaaattgttatccagtaaattttggcatgcagacaccataaaagacgtaagaacacatcattttagcaaaacaggatggtgtaaggctcatcagaaaatattcatacccggccgggcatagcagctgatgtttgtaatcccagtactttgggaggctgaggcgggcggatcacttgaggccaggagtttgaagaccagcctggccaacacagcaaaacccgtctctactaaaaatacacacacacacaaaaaaaattagctgagcatggtggcaccagcctgtaatcccagctactcaggaggctgaggcagaattgcttgagcctgggaggctgagattgcagtgagcggagatcacaccactgcactccagcctgggcaacagagtgagactctgtctcaaaaaaacaaaaacaaaaacaaaaaaaaagaaaaaagaaaatattaatacctattaaatgactgactagacaagaataactatatttatatttttacactcagaaatataattcttcatgcattgatttctgagtttgagaaaattcacctattatatgaataagtgcagcctgagattttgcttaattcatttgacctagttttacttttttattttaaattatacctactacttacatttgtggttcacataaaatttctattggacaatgatggtccagtgattcacatgaaatttctattgaataaagcctgaggtgcatttatttttctttttgcatttatgtgctggtttgtcaaagagatgtgaaacatctttctgtaatttttcctctttgccataatgagcagaaatgaaaatttctaaattctcaactgtttctaatgaaagctgaaagcggcctacaatgatgatatctccagacttataacttccagaaagatgatgtaatactttgggaaatgcaaaaatcttaaaaaaaaaaatacaatagtgacaatttatttccatattctatcactctcctaggtgattccatcatttttccattttcatattatcttttaggagggacagaaataattgatgagtaatttgttatgaatgaaatgaaacaaatcttagtaatgaaacaagtcttagaatgatgaaatcacaatccttaaagctacaggaatataaccaatgaaagatagaatgagttttattcagtttttaaaaagaaaattttggctgtgcacagtggttcatgtctgtaatcacagccctttgaaaggacaacatgggaggatcacttgaggttgggagttcgagaccagcttaggccacataccctgttctttagaaaaaatttttaaaaagaaaagcagccagacatggtggcacacgcctacagttctagctactcagaagtctgaggcaagaagatcacgtgagcccaggaattggtaattatgataagctatgatcacaccactgcactccagcctgggtaacagagcaagaccttgtctctaaaaaaataaaataaaataaatgaataataaacattttttttttgagacagagtttcactcttgttgcccaggctggagtgcaatggcacaatcttggctcactgcaacctccgcctctcgagtagctgattacaggtgtccaccaccatgcccagctaattttttgtatttttagtagacacggggtttcaccatgttggccaggctggtctcgaactcttggcctaaagtgatccacccgcctcggcctcccaaagtgctggaattacaagcatgagccaccacacctggccaaataaaaaaattttttaaagtatatgttacctttctactttcaaaggcctttaagaaaaaatgagtcaagaaattattagtccttccatagttagaactgctcaaaaaaaaaaaaaaaaattccagtgtgtactgatggtatgccaagggttaatacgaaaatgtttaactataggttgagtatccctaatacaaaaatccagaatctgaaatgctccaaaatatgaaactttttgagcaatgacatgacactcaaaggagcatttcagatttcagattttcgggatactcaactgaaaagtatactataaatattccacaatctgaaaaaatacgaaatccgaaacgcttctaatcccaagcatttcagataagagatattcaacctgtaacaggaaatttacaaagcattttccttgactggcctgtcaaactgtatttcaaggtaggcaaagggaccaaagtactgaaagctactcctttaaagaaaaatttcaactaagaagaacaaaagaaatgacataaataggcaaaaatcatcaatcctaaaaaccccatcaggagaaaaagtaatggtaaatttcacaatggatcatattgtcaccaactgaattcactgatcaatcttaacatctttaacactgggacaaccacatatcatgatataacatgtagtaatagtactacttacagaatattcttgttaagagtcaaactagaatctatgaacctttagatcatacattctcaacagtagcaatgtcacattcaagaaggcaaagaaatcttaaacagtaaattaagacagtttctcatcctccaaatcatactactgtgtctgcccccaggtctggggaaaaggtgcagtgtagacagtaaggaaaaaaaaagctctaggccgggcacggtggctcacgcctgtaatcccagcactttgggaggtcgaggtggtcagttcacgaggtcaggagatccagaccatcctggctaacacggtgaaaccctgtctctactaaaaatacaaaaattagccgggcaaagtggcaggcacctgtagtcccagctactcgggaggctgaggcaagagaatggcatgaacccgggaggcggagcttgcagtgagccgagatcacaccactgcactccagcccgggtgacagagtgagactccgtctcaaaaaaaaaaaaaaaagctctaaaaactccgtaatgaggcaacaattaaaaaaaaaaaggttagaaacactgcttcacatccaatttccagttacatgaatacaagaaagtaataagtaaaatgacatcaaaaggaataagaaaatgcagaatgtgaaacgttataaagaaaaattgacccagttacttcaacatggagggtaaaaagactttactgcggtaatcatatttagaaatatactttaaaatattaacagataaataatatgtggaatatacttcaaaatagtattagaagagggtaaggagattaagatatagatgaaacgagagttgttgagtaaataaatcactaaaagtaggtgatgggtacataggagttcattttactattctatatactgttgtatatgtttaaaacatcctgtaaaaacaaaagcatgtttggggcacattttgctttcttaggatattagagagaacaaaactatacaacacatagcttgcccatatattttctatcaaaggtgatctacaaactgatgtcattcctctcccaaataataccttttttaaaaaaagattcaatcattatataggcatgactgaaaatgagaaaataaaataaaaattttaaaagactaaaaaaacataactgggaggtatgtacctgattcaaatcctgatacaaataaagcaacaaaaaggcatttttgaaaaagctgaatatgaactaggtgttttatgatattaaggaagtatcgttaattttgttaggtgtggtaatgataccgagattatgaaagaaaatatcagctgggtgtggtggctcatacctgtaatcccagcactttgggaggcctaagtgagaggatcagttgaggccaggaaatggagaacagccttggcaacatagcgagatctcatctctaccataaaatttaaaaaattagctgggcatagtggcacatgcctattatctcagtacttttggaagaccactttagcctaggagttcaaggctgcagtgagctataattgggctactgcacttcagcctgagcaacacagcaagaccctgtctctcaaaaaaaaaaaaaaatcctatgttttaaaataaatatattgaggccaagggcagtggctaacgcctgtaatcccagcactttgggaggctgaggtgggtggtcaggagttcaagaccagcctgaccaatagagtgaaactccatctctactaaaaatacaaaattagccaggcctggtggtgcatgcctgtaatcccagctacttgggaggctgaggcaggagaatcacttgaacccaggaggcagaggttgcagtgagccgagatcatgccattgctctccagcctgggaaacaagagcagaactccacctcaaaaaaaaaaaaattaattaattaaatatattgaagtatttaagggtgaagtgactatttccttcatccccccctcactgccttattttaaagaaacctggggagtgaatgagatgatgatggtgataaacactcatgtttgccgcccctccatgcagaaagtctgtgcagatgagcacataaaaacaaacaaaaaagaataaatctataagacaatgaaaagaacagagagaaagtgtttacaatagatttctggagaacagaaagcagacccaagtgtgttaagtttaaacagaactaagcgaagcacagcccaaaatctacacatgaaaggactacagtggaggtctaagtcaatctttcagagattctacgctcccctcaatgactaagcaagggccagtgtcacctgtaggtacaaaaagtgaaatactctttttttcctaaagacagttaacaaactgaacagaaagaaactgggtcttctggtgtcaatgtcagtatctgtagagcccatttctatatggcaattggaaagctccgaagcctaaaaacaggttccctgatcttttgccctaaacctaacttgccagcaaacaagagatgctccaactatgtacaaagagttgccagtcttctcattccaagatggcaattagaaaacaagtccatgactacaatccaggaaaccaacagcagtacctaatataatcaagatggtcctttagcaagaaccatgaactaacaataaggatccccagatatacaagaagaaacaccacctagaaaaagaccaagataaagatattatctatttttttagtttttaaaagagacagtcttactttgttgcccaggcaggagtgcagtgacacaatcatagctcactacagcctcgaactcctgagctcaagtgatcttcctgcctcagcctcccaagtagctaggactatagacatgcatgaccatgctcaactaatattttaattttcttgtagagatggggtctcattatgttgcctaggctagtctcaaactcctagcttcaagcaatcctcccaccttagcctcccaaagtactgttattaaaggcatgagccactatgtcccacccagaccaagacaaataaatagatcaaactgacttcaaaaaaatcatagtttattcaggacatagaagaaatctcaaaatagaacaaagtattctcaaaggactactgaagataccgcattcaattaaacaaaaataggtatatttaacaaataataatacaagagtccactatgccaagaactgttacaaatgcttaataaatatgaactcctttactcacaaggtaggtattattatcctcattttgtagactagaaactgaggacaaagagattaatcatttgcccattgtcatggttttgaagttgtggagctgtgatctaaacccacacagtcaggaagtctggttccattgtcaatgcttttagctactatcctgtgttgtctcttgaaatgataccagcagaaaataagcaaaagctactcattaacaatttataaacattcgcaggtcagaaacatacaattgaaaacatctgtcaaaatacagaataaaaaagacagaaaacttgagaaaagagataaagaaatgaggatcaatcaagaaagccaatattctgctagtaagtatcccaaaatgggcaaacatagactaagaaatattaccaaggaaataataaaagaacattttccataactgaagggagacacttgcatttcaactgaaaggacctactgagtccagcaaagaataacaaaaacaattcatatctaaacacataattataaaattccataactacgaaggacaaagataagatactaaagcttatctttgtgagcgagggaaaggatcatttagaaaataacaagacagaatagcatcagacatcttaccgtcttgatgctcaacagaattgagcaaaaacctctaagttgtaagagagaattaatttgaatttaaatttctacacccagccaaactatcaagcaattatgacccaggccaaagctattttcaaacatgcaagaattcacaatatttacattgtaagtactctgtatactggagttaatttaaaatacattcaaagcaggatgcagtggctcatgcatataatcccagcactttgggaggccgaggagggtggatcacttgagataaggtgtttaagaccaacctggctaacatggtgaaaccctgtctctattaaaaatacaaaaattagcaaggcatggtggcaaacgcctgtaatcccatctactgcggaggttgaagcagaagaatcagctgaacccaggaggtggaggttgcagtgagccgagattgtgcccctgcactccagcctgggaaaaagagcaagactccatcgcaaaaaaaaaaaaaaaaagagtaaatacattccagctaaaaaaggaagaatgctataaaagaggaagatgtcgcatctaagaaacagtaaatctaaccagaaatgcagacacggaatagctcagaatgacatatacacagcagcttccaacctgtcaagactgaagcaggaagtaggagggctctaagagtgatatctccaggaaaaggcattccacctaacagttaatagatattatgatccaagcaggaaaaacatctgagaatatgataaaggtatatatttctctaaagaaaaaaagacaattacaaactgtgggaggaaaagatgaacaaaaagtcatctagaatataaagcaatctagcggcatgatttcgaaaaaatgatgaagtacaagaagaaataagtaaatattttatttcttgagttccactagcattatgactttagacccatagaaaaaaaaaatagccccagcactataattaagtaaagtgtaagtgagctaaatcctcatctttcttagcagtgagtcaatagatataatttgaagttagtaaatcaagaaataaaagcagatctcaacaacaacaacaaaagcctaggaggctttactggagaattctatcaatcatttaaaagaattaaccaggccaggcgtggtggctcatatctgtaatcccagcattttgggaggccgagaagggtggatcacaaggtcaagagatcgagaccatcctggccaacatggtgaaaccccgtctctacgaaaactacatcaattagctgggcgtggtggtatgcgcctatagtcccagctactctggaagctgaggcaggagaatcgcttgaacccaggaggcagaggttgtagtgagtcgagatcacgccactgtattccagcctggcgacagagcaagacttcgtctcaaaaaaaaaaaaaaaaaaaaaaaaaaaaggaattaacccaatcctcctcaaactcttccaaagaactaaaatgggagagaacatttccaaactcattctaaaaagccgccattaccctgatataaaaaccagacaaagataccacaagaaaagaaaaccacggtaataaccataatgaatagtgattttttaaatgttaaaaaaaacaaaaacaaaaacaaaaaaaaccccagcaaaccaaattcaacagcacattaaaaggattatataccatgaccaagtgggatttataccagaaattcaaggatggttcacaatacaaaaatcaattagggtaatataccacattaataaaatgaagcacaaaaaccacatgattccaattgacgaacaaatgcatttgacaaaattcaacacccttccatgataaaaacactcaataaatgaagaatagaaggaaactacctcgacataataaacaccatatatgaatatcccacagctaacatcctattcaatggtaaaagactgaacacttctcctaggattaggagcaagtcgaggatgcccactctcatcacttctattcaacacagtaccagaagtcctagatagagcaattaggcaagaagaataaatagaaggcactcaaataagaaagaaaattatctctgtatacagatgacatgatttatatgcagaaagccctaaagaagaatccacaaaaaaactgttagtactaatacatgatttcagcaaagtttcaggatccgaaatcaacacacaaaaatcagttgcatttctatacaccaaaaatgaccaactggaaaggaaaatttaaaaaaaaaaatcccaatttactatagtatcaaaagaggaaaggcaaaccatggtggctcaaacctgtaatcctagcactttgggaggccaaggtgggagaactgcttgaagccaggaatttgagaccttatctctctataaaaataccaaaaaattagccgagcgtggaagcatatacttttagtcccagcttcttgggaggctgaggtaggaggatcatttgagcccaggagttcaaggtcacagtgagccatgattgtgccactgcactccagcctaggtgacagagaccctatctctttaaacaaagaaaaggggtcgggtcgggggggtagtgtggataaaaatactaggaataaacttaaccaaggagataaaagacttgtactctgaaaactacaaaacatcgctaaaagaaatcaaagagagaatacaaataaatggaaaaacattccgtgtttttaaactgaaagagttaatactgttaaaatgtccatactacctaaagcaatctatagattcaatgtaatccctgtcaaattctcaatgacattttttttgcagaaatagaaacaaaaccatcctaaaattcatacagaatctcaagggacccccaagtagccaaaccagtcttgaaaaaccaccaaaaatttggaggcctcatactttcttatttcaaaacacactacaaagcaacagtaatcaagacagtgtggtactgacataaatacagagctacagaccaatggaacagaacagaaataaacgctcgcacatgccaccaaatgacttgcgacaagggtgccaagactacccaatggagaaaaaacagtctctacaacaaacagtgttgggaaaactgaatatccacatgccaaagaatgaagccaaaatatgatattactaatttattttatgatgacctaaaagttttgatttccgaatattttttcaacactttttaattaagtattttagatacatattagaatatttttctgcctagaaagtaattcaaaccatatcactgactaaagatttttgggattgtttgtaaatccgtgaaaaagtgcttaaggccaggcatggtggctcgtgcctgtaatctcagcactttgggaggccaaggcaggtggatcacctgaggtcaagagtttgagaccagcttggccaacatggtgaaatcccatctctactaatagcacaaaaattagccaggcatggtggcacacgcctgtaatcccagctactcgggaggctgaggcaggagaacagcttgaacctgggaggcagaggttgcagtaatccaagatcatgccactacactccagcctgggcaacagagtgagactccatctcaaaaaaataaaacaaaaacaaagtgcttgtttaagatgcaggagagtggacacttgtttactaaattcaagacacactacaaaacttttgcttttcagtaaactctcgatgttttcctttttgcctgtgtcttaaaacattaatgtataaagaacccaatagtaataaaatgttttgtacatttgtttgccatttaatctagcttgtactaccctatgattaacagcactgaagtaattaataattacagttgtaatatgcagcgagtcaagtggagcatcagtgcaacaataccaaacttgaaacgagtgcttattctactctcaactatcaccaagccaatcctcctcaaactcttccaaagaactaaatgtgagagaacatttccaaactcattctaaaaggccagcattaccctgatatcaaaatcagacaaagataccacaaaaaaagaaagctacagcaataaacctaatgaatactgatttttttacccttaaaaaaatactagcaaaccaaattcaacagcacacagtctatgtgctgttgtactgcagaatctaatactcctgggtatttttgttatagcagccaaaactaagatatccattctatcctcacatgctaatagactctaatcccctacaccttgatttggttttctctacaatacaaatatccatctagcatatatttaactcactagtttctcatctggtttcctcagttagaacataagctccctgaaggcagggctttgttccccagcagacagaatagtagctggcacagaacagaatgctcaataaatacttgctgaatgaacaagatgaagaccaccattaaaggtatactaaaagacttcaaagcactactgagaaaaatgaaaggcctaaatgaatggagaggtatactgtgttcaaggatcaaaggactcaatgttgctatcagttttctttaaattaatctatagagtaaatacaaccctaaacaaaatctcagcagccttttctgtataaagtgagaatttttttttttttttttttgagacagtcttgctctgtcatccaagctgagtccagcagcacagtcaatggctcactgcaacctcaacctcctgggctcaagcaatcctcccatctcagcctcctgagtaggtgggatcacaagtgcatgccaccatgtctggctaatttttttctatttttttggagagccaaaggcctcgctatattgccactacactccaacctggtcaatacagaaagacctctttatcagtataaaaaaaaatttttttgcttcttgattatggtgattacaagaatgtttaggtttgtcaaaactcaagctgcatacttaaattgggcagattttaacatatatacattataccccaataaaaatcaattttaaaaaatatacatcaaaaactgaaacccaacaacaaaatacctaaagaacactacataaaacagctcataaatattgagtattctgcatacctttaaaaaatgacaggcgccagctagagtggctcatgcctgtaatcctaataatttggaaggtcaaagcaggaggatcacttgagcccaggagttcaagacaagcctgggcaacaaagtcacatcctatctctgcaaaaataaatgacaataataataataataggaaattgtctgcacttaggtaaaatgaactagtttgaagcaggccaatattcttgctaagaacaacttaaaaagctaaataaattataaaaatcatatttttaaagttagtgaggagctgtggaagcatgggaaagaaggtctaaaattccagtgatgggagaatctttttttttttttttttttgagatggagtcttgttgctctgtcacccaggctggagtgcagtggcacaatcttggctcactgcaacctccacctcagagatggggagaatattttaaaggtatttagatgaccagtatctgtcttttccctgggagtatttcctaattattgcttgggttagaggctgaaaattgaggcctgacctgtgtaaaatattgttgctgaggaacacagaagccaggacagcttttggtgttcacacagggctggaataacaacactaggagactaattctcctaaaaagtttcacgcaaggacctcaagcttaaaggtggtatctcccctcagcatacttgctgaattttaaaaccgtgcagggtaaaaggctacaaagtcaactaaaaaactttgaaaagcaaagtgaaatttcctacctttggcattgctaaagggacaagaccaataggctttgaaatgaatgccttagaagacaacatctgaaaaaacaaggaaaaataaggatagcaaactattaaaatagcaacccagcctccacataatttaagatgatgggctcctgatatgggttggatgcttgtcccctccaaatctcatgatgaaatgtaaatgtaattcccaatgttggaagttgggcccagtaggaggcaactggatcatgggggcagatccctcatgaatggtttagtaccatctcctcggtaataagtgagttcacacaagatctggttgttgaaaagtctgggacctgccccaccttgctctcttgctcccactcttgccttgtcatgcacctgctctcccttcactttcagccatgactagaaacttactaagcctcactataagcagatgccggcaccatgcttcctatacactttggagaaccgtaagccaattaagcttcttttctttataaattacccagtctcacgtattcttttatagtaatgcaaacagactaatacagctccctagcctatctgcatagaaaatgaacttccccttcccccacccctctcccaacccggcaaaatgtaccattacctggtaatgcttacttaagttttttactacacaatgcctggcattcaataaaaaattatgagacataaacaaaacaatcaacagacttgacctaactgacatttgtaaaacactccacctaacaacaaaacacacattcttttcaactgcacatgaagaacacttacaatgatagaatatattctaggccataaaataaatccgaataaatttaaaattatctcattacaatggaattaaattaaaaataacaatgatctctggaaaatcctcaaatatttgaaaactatataacacacttataaataaactatagacccagtaagacatcaggaaagaaattataaagtactctgaatggaatgaaaatggaaacatatcaaaaactggaaacggccaggagtggaggctcacatctgtatcccagcactccaggaggccaaggaaagaggattgcttgaactgagttcaagaccaacatgggcaacacagtgacatccttgtcttcagaaaaaattgtaataaactctggccaggtgtggtggcttacacctgtaatcctagcactttgggaggctgaggcaagtggattgcctgagctcaggagttgacgaccagcctgggcaacatagtgaaaccctatctctacaaaaaatacaaaaattagccaggcatgatggcacgcgcctgtaatcccagcacttaatagactctggtgcgaggatctcttgagcctgagacgtcgacactgtggtgaccccgtgattgggccactgcactaaagcctaggcaacggagtgagacccagtctcaaaaaaataaaaataaaaataaaaaattagccaggcatggtggcacatgcctgcagtcccagctactcaggaggctgaggtgggaggatcacttgagcctgagaggtcaaggctgcaatgggccatgatcacgatactgtactgcctgagcagtagtgagaccttgtctcaaaaaacaaataaataaattataaacaattaaagggaagtttatagcatgcttacattagaaaagaaaaaaggtcacaaatcaatgacctcagcttctatcttaagaaaccagaaaaagaaaacaaattaaacccaaaagtaagctgaggaaaggaaataaagaccagggcggaaataagaaaaccacaggcagtcaattaaactaaaagttaactttttaagaacctcaataaaattaataaacttctagccagactaatcagggaaaaggggagcagagacaaattactagtattcggaatgatactaaatctctacaggttatacagatattagactcattacactttctacagatattaaaagaacaataatagagtattataagcaactttttgcaataaatgcaacaagttaaatgaaatgggtaagttccttcgaaaacttatcaggcatgtgaagagacggaacaatacaaccatatgaccaataaccaacagaaaaacaaacaagataaacagaccaatagatgatgccgatattggaaaagacaagcatttaaataactataattagtatgttcaagagaactggagtctattacaagtctataaaacaacatcaaaggaatactctagaactcaaaaccacaatgtaaaattaagaacacaaaagattattttgacaaaaagagaagatagttttggcatactggaaggcaggtcgatagaaaatatccaaacagagaaaaaaatttttttcaacatgtggaacatgataattaagtttaatatatgtgtaattaggatccaaaaagaaaaaaggggcagaatatatgaaaaggtggtaacagaactttccaaaactaaaaggcatccagctagattcaaaaaactctataaacataaagcaacaaagaaaaccacatctgaacacatcaaagtgctttaaaagtaacacagagagtcttaaaattagccaaggaaaaataaaagacacattatcctcagcaagaatatagctaatacattgccttcaataagactggtagctgacttcaacaaaaagaaaggaagacagaaagcaaccaaacattcttaatgtgttgaaagaaaataactaccaacttagaacttaatagccagtgaaaacacacttcaggccagccacagtggctcatgcctgtaatcctagcactttgggaggccaaggtgggcagatcacttgaggccatgagtttggagacctgcgtggccaacatggcaaaatcctatctctactaaaaatacaaaaaatttagctgggtatggtagcacatgcctgtaatcccagctactcaggaggctgtggcatgagaatcatttgaacccaggaggcagaagctgcagtgagctcagatcacgccactgcactccagcctaagcaacagaacgagactgtctcaaaaaaacaacaacaacaacaacaaaaaaaacaccaaaaaccacttcaaaaaaggtgaaactgccgtgcatggtggctcacacctatacccagcactttgggaggccaaggtggggggatctcttaagcccaggagttcaagaacagccggggcaacatgacaagaccccgcctatacaaaaaatttaaaaattagctgggcatggtggcatgtgcctgtggttccagctactgaggaggctgaggtgaaggattgcctgagcccaaaaggttgaggctacagtgagccatgttcacaccactacactccagcctgggtgccagagtgagaccttgtctcaaaaaaaaaaaaaaaaaaaaaaaaaaaaggtgaaattgagatattttcagagaaacaaaaatagaaaaaatcactgatactaggtaggccagtatcaaaatgcatgatatagggaagtgacagtattattatcctaaaaattgaaaacaacttcaatgtccaacagaagattgataagtaaattattacacagagatgagaatgttacatacctactaaaaataatcacatagcagaaaaatactgacatgaaaatatgttgatgattcactgttaactgaacagcttgcactgcagtggactacattaggagcccataacatcatataagtatacatatacttatgtaatggctcaacaaaatgcaggaagcagatagataatcaagaagattaacaacagcactttcggtggtatgatctccaatgatattaattttttttttttttttttgagactgagtcttgatctgtcgcacaggctggagtgcaatggcgtgatctctgctcactgcaacctctgcctcctgggttcaagcaattctcctgccttagcctcccaagtagctgggattacaggcacccgccaccatgcccggctaatttttgtacttttagtagagacagggtttcaccatgttggccaggctggtctcaaactcctgacctcaagtgatccacccacctcagcctccgaaagtgctgggattacaggtgtgagccactgtgccctgcctaaaatgtaatctatgctttcttactgtttcccacattagggatgtgctattttttaattgggggcaagagaggaggggagaggaggggaggggaggggaggggggaatggagaaaggcaactctttacattaaaccatattttaatacaaatgataagttcttagctaggcatatggtctaacctttattggtatatcccccatgtgtgctttttaatttttttttgataccaaaacctgccaacatgaatcaacctgtactttcattttccactatttggaccttgagagcttgctcgaaggttctagcaggggagcgcagctgctcgtatacccttgacccaagaccagtcctcctctatttgggatggttgtcctcttcaaccaagcacgcagcttcagcttcaggagggacgcacgtggagtggagagggaggaaggggacacctgccgagccagccagatgagctgaatcaaccctggggatcaatggggtaacatgtcacagccagatagccctcacattcaattttccactatttgggatgagaattaaaaatgttaagtacctgaatgtgacctctttgaaaaagaaacttaatcgtcgtcattattaatgtaaaaaatgaaaatgtttctgaaaaatgaaaagcaaattatatccgaaacagcatactttaaaagacaaagtaattcataaaatttcatttttcacaagtgatttctgtagacttctaagacttaaaattaacagaattacatctctgtgaaatatccaactaaagtaataactcagagttgaggctataagagtaagtttaaataattcaacatttgcataatcaaaaaaatggaaaaaaacaggaatctcggtatccacctgtttcacagaagttacacctaatagggcttttaataaatggttgtaaagcaacctgtaaatataaatgccattatgtaattatagtcaattagtaacaattatattgctctgacacttgagtgttctataaataattcatacaactccatctagaatttttgatccagaaaaggagaaaatgcaacagccattggtgtaatgcctacaaggaacttaaaaaatattttactttatgcatctgtaaaaaactataaggaaacagataaacatcaaaaggtttagctacagtgcagaactttgacttttcccccacaatattgttttattaaaatagtcacagtaaataaatgctttatttgacacagcactagaagtaaaaatgtgtggaagaggtgacataatatatatgcttcaagattgagataagaggaaacaattttcttttaatattaacactggctgacatatttgatggtagacaacagttaactgataggatttaatttcctaatttttctagcaatcctgaaatgattaaagaggctgtattataattatcaaataaaacatcaaatggttctttccagcgggaaagcttaaaaaaaactactgaaatagctatcagtctcacagatgcctgctaaaagaacataacaactccttacgttatcaagagctaagatctaagtttcctttcttaactaattaaaaggttaagatacgtattctccctcaaaatcccatgcctctccccccaccaaaaaaaaaaaaaacagccagaaataggctcatccttacaaatgttgtatgtaattttcttataaaatctatcattttccaccttgtgttataatgtctatgcttttcagttgggcatggtggctcatgcctgtaatcccagcactttgggaggccgaggtgggcggatcacctgaggtcagcagtttgagaccagcccggccaacatggagaaacaccgttgtctactaaaaatacaaaaattagccgggtgtggtggcagatacctgtaatcccagctactcttggagggctaaggcaggagaatcgcttgaaccaaggaggcggaggttgcagtgagctgagatcacgccactgcactccagcccgggtgacagagagagactctgtctcaaataataataataataataataataataataataatattattattattattattattaatgtctatgctgttttaaccatactagatttcaaaaccactgaaggcagggtcaattatactgcatctttctaggtatctcccatagtaaatagtcttgatcaatactctgaactttttgcaaactccatcagctaaaaagaattaaggtttggtaattctttgtaacctggtttaaaacaaaccctctggaactattagagaaccagagggatggatggaggagagggtagtgcatattagttgtttgttgtcagttaagcaaaagccaaaccaaagagcctcttctctccttttcccttcaaaagctaaattttatccaagtcagtatcagtgtcccttagttaaggacagtctgcttaggttcacttcagaggagctcaagaggctggtgtaatctacgaggctttcgtaggagtctgcaagcaagtacagaaggaaaaaaaatcaaagtttaacccatacactatcgatcaagtcaaaagccaaagaaaaccctaaaacttggactctaaagagtcctataaaattcatggaatccaagcaccttttgggtttgttttgtttaaaacagggtgtcactctgtcaccaaggctgaactcctgggttcaagtgatccctccacctcagcctcccaattagctgaaactacggtgtgcaccaccccatctggctaattttttttaaaaaaattttgtagcaaagaggtctcactatgttgcccaggctggtcctgaaatcctgggctcaagccattctcccacctcggccgctcgaagtttacagtgaattaaatctataccagataaaactcacatcagtatgacctcccttcaaactctgcaaatgcctccataacaattggcccctcactagtgaaaagatgagtatgacctatggtctatatcagatgttaagctttctgacaggctccaagtcatgtccctgtcctgtaggtaataacagagcccatactggaggcaaaatggcaaagcagatgatcattcaagatgattccgttttcaaggctgaaaagaacatatttgcaaatgcacagaaaaagatctacaagatcatacagtggtgttaacagtgttacccttcagtcaagggtatacgagtagctgtgctccctagattcctctggggaggaatgtgagctagaagtggatgtaaaggggttgtcacttattatatatacactgtattaactttttatgagcatcaatttacttctgtaattttaaaaataagagtcccagctactcgggaggctgaggcaggagaatctcttgaacctgggagccggaggttgcagtgagccaagatcgtgccactgcactccggcctggtgacagagcaagactccgtctccaaaaaaaaaaaaaattgaaatgtaattccatttttaaaaaagattgaacggacccacatggaattcaaatgaaaaataagtgacactttgcagaagtctattagaaaaacctacatatcaaacagaaataatataagtatcctatcctacaaaataaaaaggaatactggtaatattacaaaaatgcccacagcaactgcaatccattactcactattcactactttcattacacaatattagtcaccagggggagtttgagggtcccctcccaaaattatatctcatctaacagctgcctgtgcagtcttaacctcattaaacaggttttcaacaatccagtcctaaaaaaatgttcattttgtacactttcatgagaaacaaccagacacacacacacacacacacacacacacacacaccccaatttacctttcactggggttcatgtttgatttcctcaaaagaaagaaaagtttcccaacctgaaaagcaaactaacctagacaatcaagtttactagcactttaagggaatgttcacatcctcctcataattgtttgtcatgaaactttggggttaagtaaaattttacccatctatgactcctgaaaaaaagaggagggggaaacacaaactacactctgaaagcagcataatccagccataatgccaaatgtaaacagtcatatattttagcaaggcaagatataactaaacatctttaaaagataaatgcctgtgacctctgcaatcttaaaaattaaagtgtaaatagtcataaaaggtatcccaaacttcctttttagttgattttcctaaaaaatatgaaaagcaatcatattgaaaatgactcaaatcaccataaattaggcaacaaaaatcacacaaattatttgggggaggaggatttttgtttaatccagtttatgagtccataatacacacaaaaatttgaaaacatgaagacatacacataatacatctcatttcccaccattccctcagactatttctccctctcctctattgttagttttctaaatcctcccataatttctttatataaagagcaaacataaacttgtattattacacctcgcccttaagatgtaacacactattcacaaagtaccgctacaccttgcttttttcacttcatagcaaatttttgcaatctttgcatgttagtacgtagaaagcttccttattcttttttcataactgattacgcctagctttagaacattttcagtctgctttcttcaggctaactttttttttttttactttttttattattatactttaagttctagggtacatgtgcacaacgtgcaggtttgtcacatatgtataaatgtgccacgctggtgtgctgcacccattaactcgtcgtttacattaggtatttctcctaatgctacaggctaacctttcaagacattctgttcagccaaccacttatcacaggaattaatttccttcccccaagctttgaaaaccaatcagatttgaggtgtcccaagggataagtttcagagaaagcaattcattatctaaattacatccttttaagaatgtttattttcaaacaggtagaggggaatattgcacaattttctctaatcgcttaaagctacaaatcagaacgcaatcttcaaagtgaaattacctttgatttggggggatcagcgttatagtcaaatcaacgactgtaaaagtttacttcttgtgcttttcttccactgtaaaaatttttttattttttaaagaaggctaaaaagccttaaagtctaatagcacggcattctaatagcaggaaaccacaatctgatttgatctttcatctgccaggtcagagactaggcttttatcttgcagaattaggctcacctaccatcaacaagaggacctctacaaagctacaaacactttcaaagaatataaactctgcggcgctgcgtgtaggaaattacactccaggggccagagcgccagagccaactccagaaaacccagcttcactggcggaaagaaatctacaaacgccagcggcggtgacggggaacgggaagcgcgggtggacggaagaagagaaaccgagcgcctcgccgccaaccctcgaacccgcgcgcggtcgctggagtcagacgctaatagccgcgcgctgcctaggaacggaaccccggaaccaccaccactaacggaaccagcccgcggccggcaacggcggccgttcggactgcggactgcggcacgcgggccgggcgccgggagggcgggggttccccggaggagctggccgccccggcgccccattgggcgctgctccaaacgtgcccgagtggtgacaggaataaagtgggtcacaaggcctagcgggtccccagcgaaagctctctcggcacccggtccccgtctttccccgcctcccagctgctggaatcggccgcagctccgggcgccctcaagccgcccggccccgccgtgcaccccactcccgcccctgccccgcaggtaaccccagctgccccagagggcctctcaggcagggcgggcctcggcccgaagtcccgggaaaagacacactagaacgacacgccaaacttgggcttcagctcccgccttccccacccttggccgccgccccccggccccacacacgccgccccccgctccctccccttccccgcgccctcaccgtgtggcttgcggcggctccggcttcttccctcccccacccaggtctcccgctgcggtgactcggaaccactaccccgcctgtgtccaggaggcgccgcggctcccacctccagcagcacctggggctgtgagtggcgccccccacccacccccccaaaaattcgccgctcctgtggccagctcctcctccccctcccttcccttcccctcctccaccagcccaggagcgcgcatgcgccgccaaggaagccaaccggcactcggcaggccctgggcccaccgggcgggcgcctctcaccgggagcgctcgcggcggcggcggccagatttccttcgcgctctcgctctccggggtttccttttttaaaccggcagccgcaagccgagtccgtgattgcgccccctcccggcgcatgcgtcgtcagcgaccccgcgggctcagacggccggcggaggctctgcgctcgcccctcccctcactctccctttccccagcgcggctcggtgcgcatgcgacttgccccgttaggcagcacggagccgcgccaggggatcccggacgcccgaagagactcccgcgccccttgggccgaaatctggctctgcaggcgcaccgttccctgccccggccgggaacggcgccggttactagaaagccggggaggcggggcctggtcgggtggagggcgcggccggccggcagagcgctagccttaggtcctggaggctctttggctttccccccgtatgccgggggctaggaggaggaagaagagcttcctgccggatgagggatccagaggccagaaaaggaacccgctctcccttccaaagcaaaacactgccgacgccagcttagatttttcgggtgttggcaggagactttttcccccagtggcatcattcgtgtttcctctcctggtgctgggagagaagagttgcaaaggcgcctggaccgccagtaacatcttctcccatctcctgagggagcgcggcttgggttgcttcttcttggtgggtgggcctggggagacagggcatgcgccctcggccagaggagggaagcgaaaggaggtcgggatttatttgctcatttggagatttttcccttgcccttttattaaaaatcaagtgacagtgtaatggaagatggagaatgaagcatcagaaataaaccaggaccctaatttgcatggatttcctcgttggaacaacgtgtgactactacttatcttcgggaaattacttatcttgatgcgttaaggcacatttggtccacatgagaaagcacatttcagtgcttctactggaaaagagatctttacagtcttaattcctagtaattcctatgttttaatgaatatcttttggatttgaaataaaagccatctttttctttcaaaaaatgcacttttctggccgtaaaatcctccctttaaagtaacagtcacctcagtaaacattttcaattcttgctgtatgctctgggcaaaagaacatcaaactgaagcacttattcagatccttgatcctgcacctaaggatttttctttcaggagtgggaaaacatgatttgttaatttaccccatcatatagcagaagatattttggtcgacatttttgcctgttcagcattcattccctattctgataatttcttttgaagaactatcatttatccactctcagtccatatggtctgagcaggacacaaggggaaggcatatttgagtttaatcctcggttgcaaactacggttcctaagaagggtgttacgtctttaccaatgggtttaaatctgggagaatggagacctggagccatctttccacacgtgaattctgagaaagaaggcaacacggaaaaaaagcagatttgaagacaggtttggcctaaagacatgtttgaggcctggaaacaaatgtagattagattcctctggaaatttcgttaaaccagtcagtaaattcttgcatctgttttattgcttaaaccagtgagaggttttctttcacatgtaatcaagagtcccgactgacaagaggtaggtagcaagacggaggcaaagttattaatactgataaggtaggttgcagccagacaagagagggcttgaatgctttccctaggatggatttttgaattttattctagagacactgatccctccttatattccccatcatctagaacatattatcttcaaaatacctttgccctttttaatgatttcattgtcctctcagtcaccaagatcaaaccatgtccatctttgactcctccctctttcactgtatttaattatttaccaagacctgttgataatcccccgtttttctgctcagtcctctctcactgcttgaacatttcccatggttcagttcacagcttctcctttctcccacattctctccaagaaaagaaaaaatgtactggatatgtcttttttttgagacagattttttgagacagagtcttgctctgttgcccagctggagtacagtggcatgatctcagctcactgaaacctctgcctcccgggttcaagcaattcttgtgcctcagccttccaagtagctgtgattacagactcccaccaccacaccagctaatttttgtatttttagtagagatggggttccaccatgttggccaggctggtcttgaactcctggcctcaagtgatccacccacctcagccacccaaagtgctgggattaacaggcgcgagccactgtacccagcctgtattggatatttccaatagcttttccaacttccagatcccacatttccataaaacaaaaatcctgcctcataatttcatagctcctaaatttatattccatagccttaaacataatttcagatattctgttcaccctttcttgtgaaccttgctatcatttaaactgagtatttccaactcctctgtcaactgatttcccccagttggtaggcaacgtatcatagtggttaagagtacaaaattaggatcttaactgcctggatttaaatcatagcttcaccactaatattctgcatgactttaagcaagttatttctctgttctttaatttcgtcatctttaaaatgggataattacaatcctatctcatagcttaaccgagacagtgtgtgtgtctgtgtgtgtgtaattttatctggtacataagaaatcccatagaaatgttggctattcttgtcaatgatgttcctttttgggtaattttcatgtctcttttgctctaattcttgccctaactcctatgtcccatcagtcacaaagtcatatctgttctttcatagtaactcatccattcattgacattcctagttttactaccatactttaaggtgaattggagaacaggaagctttaagatatgcttaatagagaatataaggttaagtatttttttaaagcttgcatagtttattcagttactcatattctttctaatccctttaaaatggaactacaaaaccctgcctcatagttgaggtagtattatagactttgtggtcaaaactcttggcttaaattctgactcatgctgagagatagtgagcaaatcaagtaattcctctgagcttcaggtacttatctgtaaagttacaagactaggcatttcagagaactgtgatgatcaaaggtaaattaaactgctacataaaggctaggtggtgacgatggtggttgtaaatctttacaatttcttgttggaaccctaagaatagttgaaatgactcacagatttttaactccagccttcacttctcccttgggctctatacacacgtctgtttatctacctgatgtctcttcttctgtatcacaaatatcttggatgcttctttcaatctattctccacagagcagtcaaattattttgaaaatataagtgaagtcacattattttcttctaaaaccccttttgtcatttcccattacatacaaattcctaattatggtcacaataacctgtttgatctggcccctccctacctctccaacctcatgtcttaccatttttttccttttcctgtgacactccaacccagaaactgcctttcatttctttgctaatttatctctgctctcaggctttcatgcatgctgtgcccttgcctggacccctcctaccttttctcatggctggctccttctcaaccatcacatctcaaagatctaactaccctatttaagtaggtctccctccaacaccccacctgcccccccaccaccaataatatccaaagttattctcttctgttgtgtccagtttcccccataatacttaagtttaaattatgtatatattagttatatgtatatatgatatttgttttcttattaactattttccctaccaccacaagataaactccagaagggcgagaaccatgtgttttctttgccactatacgtgtagcatccatttcaatacctcaggtgagctgggtagagtgacacgtacatgtagttccagctgagccgggaggattgcttgagcccaggagttaaggaacagcctgggcaatgtagcaagaccccatcactaaaataaattaattaaaatttaaaaataaaaaccaggttgggtgtggtacctcaagtctgtaatcccagcactttgggaggccaaggcaggcagatcacttgaggtcaggagtttgagaccagcctggccaacatggtgaaaccctgtctctactaaaaaatacaaaaaaattcgccaggtgtggtggtgcatgtctatagtctgaggcttaggcaggaaaatcacttgaacctgggaggcagtatctgcagtgagcccagttcgtgctgctgcactccagcctgggtgacagagcaagagtcagtcgaggcaggataatcacttgaacctgggaggcagaggctgcagtaagcccagatcgtgctgctgcactccaccctgggtgacagagcaagtctgtctcaaacaaacaaaaccaccaatgcctgaggtgaatgaatgatttaatgagtgaatgaaatgccagaaagatgatttttagaatcatctttgtcccaaattatgactgtaggcagattattgtcaaggggtagccttagtaatgtgcatgaaagtgtgtccggaatttattccttccggtgggttcctggtctcactgacttcaagaatgaaaccatggacccttgcagtgagtgttacagctcttaaagatggtgtgtctggagtttgttccttcagatgttcagatgtgtccagaatttcttccttccagtgggtttgtggtcttgctgacttcaggagtgaagccgcagacttttacagtgagtgttacagctcttaaaggtggtgtgtccgcagtttgttcctcctggtgggttcatggtctcgctcacttcaggaatgaagctgcagacccccacagtgagtgttacagctcataaaggtagtgtggacccaaacagtgagcagcagcaagagttattgttaagagtgaaagaacaaaccttccgcagtgtagaagggggggccgagcaggttgctgctgctggattgggtgccagcttttattcccttatttggccccgcccacatcctgctgattggtccattttacagagcactgattggtccattttacagaatgctgattggtccattttacagagtgctgatggtgcgtttacaatcctttagacacagagtgctttagacatagagtgctgattggtgtgtttacaatccttcttagctagacacagaatgctgattggtgcgtttttacagagtgctgactggtgcatttacaatcctttagctagacacagagcgctgattagtgcatttacaatcctttagctagacacaaaaattctccaagtccccacccaacccagaagcccagctggcttcacctctcaaaagtacaaaagagaagcaaactaaaatcagtcagtgaaatatgatgtgactaataccgttctagtgattgaatacttgagaaccagcaagaatatgtaacactaatagatacagctaatacttgtaaaaaagatgctgactgaaatctaaaatagggtacaagtgcatgaagtacctcaacttctaaacagctgccaacatttggggtcagatacccactccttcacccaaggataaaagttggacaaaaagggatctaccatagccaaaacctccaactctctaccctcagaccacataagttcaacacttggcaagaggaaaaacacctgacagaatcactgaagccaggttcctggggtgtactatggtttttcctttcctttttatgcctcaccctatcccaagtgaacaagactccaacagaatcagctaggtgactatgagggagggagagtggcatctcattcactatcaaacttgctgatattgccttgtacctacatgaaacaggaaaagagttggagaaatagctggccagggagtgggctgaaataaagcaatctgcaacatctaccatgtggtatagcaaggataccgaggatgtgtaagtttctcatgggtcaatcgatgctgcgtagaaaatgctgtccaggtttgaactatcttgatcctgaagggggaaagaaattctagcagcaagaggctggatttacttctgggagaggaaactaagagagttagcagagatagagctaagactgctccatcgcctgtgttgatcgagggactgtgcagttgggaagctgtttcagagtttctaggagaactcaatgtgccccattaaagagtgaacatttggatgcagtattcattgtacagttaaggaaaatttatccctttcatccctattctctctcccagtccccaacactagagggataggccctgaaagtgttactgatagagggtcttgactgcaaggtgtccaagttctttgcgttttgaactaagaattggacaaaacgccccgcaaagaaagaataaagcaactaaagaacgaaagcagggatttattgaaaatgaaagtacacttcacagtgtgggagccggcgtgagtagtggctcagaatcttctccggtccaaatacccgctagaggcttcccattggccacttcatttcatgaagtggtggcttgcaattggtctgagtggttgccaaaagcaagcaatcagaggctaaggtgaagttacaaagttgcaaacgaactctcagccagcaagcagtgtgattggttgcagacagccaatttcccatctgccacgcacagaaggtgggggtttgcaaagtagcctctggtccttttgttacttaggcatggcaagttagggttttcctttaaatctggctctaagaagttggagtgaaacagccttaggttccctgcctccagaccttattctcctgcctcaaaaggagagggaaaaactggttaaaaaccccacctttcatcttcagagttgcttaagtcacgagttcagccagagaatgtttgcttggaactgacactggagtgttcaactagacagacttaataacccacactgtgggatgggtaaaagaagttgctcaggttgtctttaaaggatttgctgtgtagtgcttctcgaattttaatgtgcgtgtcacctggagatctcattaaaatgaaaattatgattcagttagtctgggatggggccagagattctgcatttctaacaagctccttaggaatgctgctgattctaggaccacatttaccacattttgacaaaaaaggcactatagagaagggagattcaatagagcacacttggcaaaaatagacaaaaatattaggataaaatatcaatttttatagatcaaaaaatgactgaatattggcaattaaaaaaactaactttgtaccccattgaatattcattcagtaaaatggggaacaatattacatattaaataatttctgcatatcctgacaaatatttttaccctagtcaaatgagaatgtatacatgaagcactgtatggaagtagtagtgacctgtgttggtaggcatcaatcagtccttgctaaaagaatgtgtgtgtgcactttgctaaagagcggggctgaaatcacaagcagtcagttctaacatgatataattttattatttttacaaatgtcaaagtctccagaactgtttgtgggtaaaaacttactgccacctggtggatctgagttaagacaaagggaaatagatatcttttttaagctctcctaaatactattattatttcctttgttcttttaactttaaaaagaaaacaaatatgtatttactttttaaaagactacatttgggggaatttctgcatttggtttcaattggaggggaaaataatgtatatgaatgttattttgataaatatggttatatgcattagatgttatatgcattataggcattagagttacattgtaactttagaagatggctcttcctttcatttccacggctgtttttatcctgaatagtaacttatccatccatttctggaaggttcaggaattggataaataaaactagataattacctgaagtgtgtgtaatgctgtaataaagaccactgtgtgtgacctctctgaactttcctccatctagtcccaagatgtatctcagaagaattttcctaatccttcccagaattagatcaattgatttcacctggtgaaataaattctcattaccttactcaaatgtgtatttaactttccttccacttcatgattctctgtagcctctaagatccctaaacccccaccaatagcaagaaagagccttttcttgactcaatgttcaactgcctcaattctcaccaatttatttttgtaatctaggcatttaaacctagtctagattctcttacaaatatcagtgaacatccataatgagaattatggatcatgaatacaaacaaagtagaaaaaaatctgttactgaactattatatgctggatttaccaacctttcctctaaaagtgatgttcattattatgccaagacgaaacatcctataggccttctgcagtgtactaatgtatattttctcatgatgaattcttctgtgattactgttaaaatataagtcatcctacaatatatttttctcacctctgctcaggatttagaaacttacatggtgtagtgttctaatgattctatactttaactattaatgagaatacttagtaattttctaacttaatagtaactactcagaacgataataatgaatagagatgttttttatgtacttttcagaatctattaattgcattatgctattaagtggttaatgttttaataggtaagggattccaaagaaaaagcattatggccataaatttaaaactttttacttaagtctctagattttaaaatgtgttgacttaaataaaatttcatggttttcttacattgctttaatttgtagttctctttggaagtgagtaagcaagaaaggtcttgtaacatttgtgtttttgtccaacatgtgttagaaaaaggataaaccacagaaaaataccaaaggcttaacacaaattctgtttttttgttttgttttgttttgttttgagatggagttacgctcttgttgcccaggctagagtgcaatgacgtgatatcggctcaccacaacctctgcctcctgggttcaagcgattcttctgcctcagtctcccaaatagctgggattataggcacgtgccaagacacccagctaatttttgtatttttagtagagacgggggtttctccatgttggtcaggctggtcttgaactcccgacctcaggtgatctgcccgctttggcctcccaaagtgctgggattacaggcgtgagtcacgacgcctggccgccaaatactatttttttcagaggcaatgaatattctgaaatgcctggaaatttttaaaatgacatatatgccataattctaatataaaaatgaaaataaaataaatctatttatgacttttctgatccctaatataaaagcagtcataagtaaaacattcagtacacatatactaaaagctatttattgaatatttctctctatttggtatcattatcactgttggagctatcactgtcatcatgaatagaagtgtttctaattgaagataccatcatatctaccatgtcttttctggggttttcttccaaatcagtctgtattgctccaacttctgctagcttccattcaagttctgtaataaataacccatcattcagttaaaaatcttgaaaaaatgaataatttttcatctatatgaaacaagagttgactcttagtaatattaccatggaaatgatgatatatttattt

(The sequence listing continues in the following parts.)

What is claimed is:

1. A method for treating noncardioembolic stroke in a human, the method comprising testing nucleic acid from said human for a polymorphism rs10757274 comprising G at position 101 of SEQ ID NO:1566 or C at its complement, detecting a homozygous genotype of said G or said C to thereby identify said human as having an increased risk for noncardioembolic stroke relative to not having said homozygous genotype, and administering a statin to treat noncardioembolic stroke to said human.

2. The method of claim 1, wherein said testing comprises amplifying by polymerase chain reaction (PCR) a fragment of said nucleic acid that includes said polymorphism rs10757274 to thereby create an amplicon containing said polymorphism rs10757274.

3. The method of claim 1, wherein said testing comprises sequencing said nucleic acid.

4. The method of claim 1, wherein said testing comprises contacting said nucleic acid with an oligonucleotide that specifically hybridizes to said G or said C.

5. The method of claim 4, wherein the nucleotide sequence of said oligonucleotide consists of a segment of at least 12 contiguous nucleotides of SEQ ID NO:1566 or its complement and includes said position 101.

6. The method of claim 4, wherein said oligonucleotide is detectably labeled with a fluorescent dye.

7. The method of claim 4, wherein said oligonucleotide is an allele-specific probe.

8. The method of claim 4, wherein said oligonucleotide is an allele-specific primer.

9. The method of claim 8, wherein said allele-specific primer comprises the nucleotide sequence of SEQ ID NO:1757.

10. A method for treating noncardioembolic stroke in a human, the method comprising testing nucleic acid from said human for a polymorphism rs10757274 comprising G at position 101 of SEQ ID NO:1566 or C at its complement, detecting a heterozygous genotype of said G or said C to thereby identify said human as having an increased responsiveness to statin treatment for reducing stroke risk relative to not having said heterozygous genotype, and administering a statin to treat noncardioembolic stroke to said human.

11. The method of claim 10, wherein said testing comprises amplifying by polymerase chain reaction (PCR) a fragment of said nucleic acid that includes said polymorphism rs10757274 to thereby create an amplicon containing said polymorphism rs10757274.

12. The method of claim 10, wherein said testing comprises sequencing said nucleic acid.

13. The method of claim 10, wherein said testing comprises contacting said nucleic acid with an oligonucleotide that specifically hybridizes to said G or said C.

14. The method of claim 13, wherein the nucleotide sequence of said oligonucleotide consists of a segment of at least 12 contiguous nucleotides of SEQ ID NO:1566 or its complement and includes said position 101.

15. The method of claim 13, wherein said oligonucleotide is detectably labeled with a fluorescent dye.

16. The method of claim 13, wherein said oligonucleotide is an allele-specific probe.

17. The method of claim 13, wherein said oligonucleotide is an allele-specific primer.

18. The method of claim 17, wherein said allele-specific primer comprises the nucleotide sequence of SEQ ID NO:1757.

* * * * *